United States Patent 9,976,180 (METHODS FOR DETECTING A GENETIC VARIATION IN SUBJECTS WITH PARKINSONISM) - sequence listing, part 24

SEQ ID NO: 365 - DNA, 671070 bp, Homo sapiens
gctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtaagattccccatctctcttggttgcctggtatccgctcccaggcagccggatgtaaacaggcggttcgctctgcctggcggtgggctccgtggattctgatctgctcactgctctgtcgtctcctggggcttttaaagaactccttgtgctttcatttcttctcttctttatttttatttttagccgcgggagggtgaagggagggccaatgtgtggtagtggtctctgcattacctccccacagtagcttgccacggagatgatgatgacgatggaggcacggtcagccgccactcccgcctgtctcccccggcgccctgcgagcttggaggggtgcgcggtccgcgcaaaagtgcgcgccggggctgcacgcctctcagcttgcggggctggtgagttaacacctggtaactctttggcgagttgcgcctgtccgcttccgccagtgaccagggcagttctcacgtgcaaatgaaaggtactaacccttttgatttctttttccagagagccttttcgattgttttcaccgcttttccagtccctggtgcccttactgggatgcagagctttaaaaaatgttctaagattcgaggttctacttaacacagggaggctgctacttagctggaacgaaatagcgtcaaaattagaacggcattttgtttgtttttaacttgctgagtccccctctcacagctttctggacgttatggactaattaatgaaggatagtatctggggcggtggggaagagtagttgtttaaggagggttgactaagtctgcatctttcactttggcaagacgaaagacgttaggtagttacatttttttatggaaatgtattgcttttctaagaatcagggtttctttggagcttgaaggaaaatctaaacgtgggattccagtggaaaccctggtcagagggtcagagtgattgcttggagaaaatgaagcgtgggcgatgctcaggttctctggatggccaaaggagttttagtaggagcagaactagtcagggaaagttccctaaagcagataagaggaagaaaggagaaagccaacaggataaatgctcccattgtaggcacttcctctgacagttcaagtggattcagaccaaagagtgcaggacaccatgtaatcctgagcatctgtctttgagataaaagcagacacattaagtcactcggtcaaatttaaactgaagagtgattgcctgcatcttctatcatgccaacagcatctcctgtctttccattttaccatgtgtgtgttttatccccccaatgataaaattcaccatctctcctaggctttgtagaacaaaggtagggatgtttcacatacattcaaaaagggaacctcaccgaccacacatacacatagatgcccacagtcaaaaagcctgctgatgataaaagaggcactgggttatagctggattcccactgtagtagttttcatgcttttttcatgcctttagatggtacttaagcacgttgctcttagcaacaagcatccacaggaatgattgtttctgtggacaggattaaacaggtccgtataccattggaaatgtgtgtgtacgcacacgcgtgtgtgtgcatgtgtgttttttgtgtgtgtgttttcagcagttaggcttcaaatatggtaagtgctacagtatggtagtttgcccaatatttcgagtatttcatcctaattatgtggaatcctgaagaattctgaagtgtgtttgtgaatgagtgtgcgttactaagtgtgtttgccgactagatggaaaaaagaagacttggagccggaaaactgccaccaatactctaaggatttaattattgccgctctggtcttgcagcacaatatttgctgaatcactagattgttacactcgctgatcatttcatatcttcatattaaaaatcttggcgactgtagcagagtgcgtagcagctttccaaaagagctctctctctcacacacacgcacacacacgcacacacatacacacacacaaacaagctttcttagaccaatgcttactaaaaatgtctttaagaaatacggtagtaggcaaagatctccacactagtcccttgacaaccctaaaccaacagtccagcttctagataacctgctgttttctacgttaacttaaaacatcttccacgtggagatgcatttcttctgatttctgacctaagttgtggggaagaaggactgtgtacattgttactggaacatttccctgttggggctattttgatgtaatggtgggagttttattttcttctgggataaacacgttctgagtggattggatggttggttgagcacgtataagccactcttgagaatggttattttcaactttggctcaaaagtccagccagtgcctcatgccctggacccgtgccttggaagggaagagcttggagttgcacgtggcgcagctgccccagtggtggagagacccgccgcctctgctggggaggcagcatccagtgtcccttccatcccccacccttggcgtggctaggcgccggcagccgccaggcgcctccgccgcggcgctatggcaacggcggagcccgcccaggcggccaccccagccccccttccccgctagttaaggctctgtgttatccttccccttgctcccgctaggactgtgattcgacccagcgtcctcctgtcacctcctgcgaggtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacacactcaaacatagacacgcgctcgcgcgcactaagacacatgcgccctccgggtgcatttggcacagtgacgtctctctagtgctcaagaaaactttgcagttacacccaggagcgtctctgtcctgtttcccccttaacctccagcctcagccgactcccacttggctgcacaggctggcctgctcctctgcagccgctcagcaaacatctctgagaaaaggtatccggagcaccgaccctagggtgctgccccgaggctctatggcagcgacctgagggtcaaccaagggtcacctccaggcaggcgggcgagcccctgacattgagtcttggttgtcaccccgcctttgatcctgtgttgggacaacttgggttttcctgggtgcccacccggcgggcaaggtgcattttagagagtcagttctcctgccctaggtcgagccagatgttctctggccggcttttctgggagcagagcctgcgactctcccaggcaggcgtctccagagcgctggcgcggcgggcacagggcatccagcgcgtcccagcgtatgtaaatgaggcatctttgtttcgccgcagctgcgtcccggccttgcccgccccaggatagggtgaaggcgggactcttccgtccgcgggggtgtgaccaattccacggcctctaagctgaactgcggcggcggaggtaattgaacctttcttttgttactttagccggtccttctcttccgggcatgcactgaccccagcctgtacggaagtgcgagggagctcagaagccagctccggctgtgtgcccggctggcctagggttcaccgttcgggagccctcacatgtttaagcatcctttttaagaaatcactccccaagctatcacttgtttccgatcttcaaggtcaggttttcattcaaaatctttatctgaactggaatttagagctccagtagcaaagacatcaacccaaacttaggctcctgggcaccatctccaaggtttccttgccgaattgctgagcatatggtaggccatgtcttcccttctgatgtttcgacctaacttttctcttaaagacaagccagtggaactgctctcttaaaggtttcccagcagaagtcttccctcccagacgcgctggggtctctttggcactgcacactgaccacctgtttgtgggacagcaatcacacagtcacctccttgcgtacacgaagaaggtgaacacagccagtttaagggaccacctatacgttgtgggataaaatcaacgtgagagagaacagaaagtgttcctatggaaatcccgttattttgctgggcatcccatttgctcacagatacaataattagtagcagatgtactgcaacatcgaatagtgagactgagcttacaagccgccactctacaaattctttgaaagagatttttcctcctttgagaggtgaggtgggcgggagggaggagtggccttacatctggaagcaggaaaactgactcttgggaggcggggatgggggagtaatagcggctactatctgcaacagataaagcctgaacacctgcttagctgagctgtggaatgcaagggagagaaatcattccaagaatcgccaacacaacgatcacactttaaaaaaatcagtttttctcataagttctcacttactcttaaagcttcaaagaataacttgatgtgatccatcaaaagaggcacaatcatttcagaaaatgactttgaaaaatgatctttttgtcttctagaaattgcacgctttctctacccagatacatgaaactcaacacattttctggctttgtgagattgtctttcagaagcgaacatggtttatacgtcagtagacatttcttcagactagctttgctttttggtttaatgcaagtgatcattacgatgtgttcattccttaaattctcagatgacactctttcaacatttactcagcacgggaaagttaatgtgaattcctctcacacgaagaaggaaaataccatagatcaaacgatgatgtatcattgattatcaaagccttttcaagttttctcaccattacataaagtgttgtctatgataacaatgacataatctttcatgccatttagttatcataatttctgataaagaaaatgccttgctcttttgtggtagaaattaaacgttcaggtgagagaaattacttcactttgtccttcagttattaagatttgactttgttatggtagccccaattacatttattgcctggaaattgtcagtgcacatttttgcacatcagattagaaactagtttactgtctttaaaatgtaacatacttaaattattaatctactgcatgcttaatacttagggcttgcaggagatccctgattttcctcagtaggatggtatgatatattgaaatttaagtgttgattgtttttcatttgggtagtgaaggtttagcttcaaagggctttcaatttgtagtccagttatcaaagtgttagaagtgcttcaattgaatcttctaccctaaatcttagcatgaaaagtgaggtcagaaacccctgaaagggaaggaagtaggtgcacatcatcattattgactagtctagattaaacactgaagaggaagatttcaatctgataacatcatagggcttcctgtttttctttgctgcttctgctgacaattttgtaaggtaattaaattggctgattgaagtcacagcggtcatggggcgataaagaccatttggatttaatggaatttaaaacaacagagcacagaacacaactcttaccgaacaagaattttaatggtccattcagggtgctgactaaatagaacgcccttaacaagtttaattgaaagggcaaggcagattagcactatatagtctttatggttgaagattggggaattaaaattatccctttaaaagactcattaatgcattatcaagatttaatgtaggttaaataagctttcttcaaacctttatcatatactgtgaacctaggtttaggaccaagtttcaataataaaacatttttaagagctgatttaataaatggaattatagatctttctcatttgaaaaaaaaaaggcatttaaaattgagcatatacagtgtgttgaagggtaagtgttgatgataaattctctatgttctataactgaaagaaaatttgacttttcttttaaaatttgattgttggtattttttcatataaagaaagcttgtcagtagtagagaaaccacagagacaataaaggaatattctttctgcagtttcaatagagtaataggtatttgatctattttaggttgtttttaaaatcctgaccttttttcttgctgaaacttctatattcagattattaaacttcaatgtagtaagtcccttctgcccctgaagaaagggtagatcactgcttaacattgggaacattgaagtacaatcagtcccaaggtgaaagtcaagcctcagtcacatatgagattattcactccacctgtttcttgccatgtggcattgccgactcagagttgtcagttccttagatatttctagaataacatgaaaccaaatttttgtataaaaatctcccaaattttaattgtatacaattttgaaaaaagcttttaaacttcagatttgtaaacagcaaaagcatacagcaggtgaggggggatgtggtctcatttttaccttctcgcccattcacatttcacagttcctctaaggcacacctgcttccctcacatctctttgatcaccaaataagtaaggtttatttgcctcttgcctcacacccttaaagcaaactatgttatattcttgtattttcaaagtgacagttacctaacctgataaaactaatttgtggtaaagtgagtggggagtttagaaaagactctaaaaacttttctgcaggattttttttttaatttttaattttacttttgcatttgggctttgagaatcctcttcaaagatagcagcattcagatatagtatttggtttttaggtttctgcctatagattaatttaaactctttattttcttagctaaaaactgaaaattcttttctggatttagtagaaaggtcactagacagcagggccatttgtgaagatctgaaagggtttggggagggtatgtcttttagttattttttctactgatacatatacttctatcagtctttctttttggttaagtattgccctgttccatggccttattttaagacaagtatattctggaagaggaacacatagtctcaagactgtagagttaggatgagtttattaggatcgatcgatactgtctgtgacagagatgctcagatacagaagaaaatactgggtgcctaagggagtgctgagtgattagcatgggtgtggaagggaggctgagaaaagagagaagttaaatgacatttgatacacagtctttttcaaatttaccgccagacatcccaatgctttgtaaattgatattttgcttgtattaatccaaatcttttagcataagtgattattttaaataagatgtaaattatattcttacattgacattttctccaatcaaaatgatttttaatgctttttacctccttttcaatcaattagctacttttctattattaaactaaagtaagaatttggaagatgttgcctctagctctcatttgtgtctccagctcagtctcagtctaagtccttgacctagcacaatgagaatattgtgctaacatgatcaaataaacaaaacaaatattaaagtaatgttctgcttctgaaatttcagtatattcatagctatttggtctattttatgttgtcatttaatccttcctttcttacctctccctttactttctgaagcttcctgcattcaattcatcatagattttagtacattcgggtccttccttccccagaagaaatgaaatgggaactctctcaaaatgaatgaaaactatagaatcctggattatctaagctaaaggggaactcaaaggtccccacgtttagagtcttaagtttagaggtgaattgccaaggacagttaaatagcttgttctaaattgcaattaatgtcagattttataccaaaacatgattaccctggctgccaaaattcaaaaaactgaattttgctgtttttttcagtgtagcctctgactccctgtgctttgaatccattttagaaagaaatctggtagctcccctagaaatgtgtctactttgtttcctttaccttttctttcctagtacattatctcatgggttattgctcttttctctttttttttccttaatgtgtagctctatcagcctcttgcatacctgcttacttgttcctttactcagtgtcaaagcttttgctgcatccattcattcaacaatattaaagtgagcacatattatgtggcaggcatttggaaaacagaattctaagacttagcttctgatattaaggattgtgtaatccagttaaagagaaaagatatgtacatattaaagtaccaattgtatggtacagaaaatatatacaatagttgtttaaatgagattattgcgggcttaagtttttccagaagagataggattctggctggtgcctgaaaacattgtgtggtagaaagaagggggaaatgtatcattggtggaagactcagcacaagaaaaggaatttaggcataaattaagaaaatgagtgttgggacagataatgggctagcactgaaggggcatagataaggccttgatttttcagagctttaatatttaggttacagggtttagactactgtgtgtagccactggaaagcaattgaaaatagaggatgggcttgacatggtgtgcaataagcagtcaaatgattttgcagtgtgttgcttacattttatgaagaataagtggatcttctttctcttactgaaatggaagcaaaagacacatcttggtccttgatcactgaaacctttaagaagttcttgagctcagatcaaagattatgttagtcaaaattctccagagaaatagaaaacacacatacacacatgcagcagggaggaagtgagagagagagagagagagagaagaggagggtgtgggtatttattataagtaattggcttacatgattatggtattatggatgctaagaagtcctaagatctgcagttggaaagctagagacccagtggtataattctagcctgaagaccagcagacttgaggtccaggaagattcagtgtttcattttgaacccaaaggcatgaagaaaaaaagaaaaagaaaacccaggcttgaaggcagtgaggcaggaggaattccctttttttctcaggagggtcagtcttttcactctattcaggcattcaactgagcggatgaaacccacccacattacggagggcaatcttctttgctccatctactattttactgattcagatgctaatttcataccagaacaccctcacagacacacccaaattgtttgaccaaatggctgggcaccccattaggcacccacggcctaatcaagttgacatataaaattaaacatcacccagataattccaaagcaaaattctgaaaggaaataaaggaatgtcttcttaagacatggccagatcaaatgattaagcaaggaaaagttaccaattaatcttaaggaaaatgcattagagaacaatttacaagtactatatacatctttgagggatacagtaaattgcccccaaggaattctcaatgttttatgtttagttccaagacatttctattacctgaaacattgtgtatgtgtgtgtgtgtgtgtgtgtgtgtgtgtgtgtgtgtgtgtgtgtacagttaagattataataccatatttttactgtatatattctgtgtagaaatgtttagatacacaaatatttaccattgtgttctgattgcctgccatatccagcagagtaacatactagacaggtttgcagcctaggagcaattggctgtaacatatagcctaggtatatagtaggctataccatttaggtttgggtaagtacactctgtgatgttcacacaatgatgaaatcacctaacgatgcatttctaagaatgtattcctgttgttaagcactcatgaatgtatatacataatatgtctatcaattatttaaaatcagaatttaaaataaatagaattaaaagttaagacaactttagtagaatagatttatttttagtaatattttctgattctacacaaactcaggatgttagaccgtgaatttagttgtttgggtcatgaattttactcttgattttgtcatctaatattcataaattaggaaaaataagtaaatctttctggcccttgactttcctgtctgaagaatgagtattatttgctacctgtttaacttccaaggataatagataatgttggatttaataggaaaatgtgtagagctctgagtttattagcagaaaaggccttttagagttgaaaaaaaattgtttatttactgtgtatgtgtggaataaaataatatttattatcactcatgaatattgtatctaacttcttaaactgtgtatatttaagaaaatcagcttttctaaattattcattaaaaatcttccttgaaatatacctcaattattacaaataggttggtaaggatttattaactaatagaacaaacttctgatttagttacttgatagaagagtaagtctgtagtttctttttcttccttaaacatcatgactttaattggtgttctcaaatatatacaacatcagaagaaacaaaccaaaactgaaaacaaataatgaacaaagaaatcatgccaagttctgtggtttaaatttttttcactttttcataagtatattgttctagtttacctacacaagtattttctgatttttatatatacatcattctttatgcatctgcctatgatgaacttttagttatttcaaggtttgcaaacatataaataactatctttgatccatttgtgttgattcaggaaagtttcataaacacttggatttgctacagttgtttgagatggatgtatgggactttccagttgttatattggctgcttaggcaatttttctggtgcttactttttaaggtagaacagattttggtaccacccctagaccactaacctcagcattcttccttaagtgtcctctaaactgacttaaaaaaaaagatctagcccagtgttgggggatcagcatagaagtgtctagggagagacaagagaggacaacctacacctccttgagcagtggtaccatgccagagaatccacaggaccatttgaaaaggtgtattgaacttaaatacaattttatatttgcaaaattaaaaaattttaaacttcaatgtataaatactctgtacacaaaatcccagcgacatgcaatttacctgtattacaagcctgcacatgtacccctgaacctaaagtcaaagttaaaaaaatgtaaagtttattgggaaaattgcctgactgttgaagatacttagtttttaatcagtaatttgcaactgtcaagggtaaggtggaggacaatcagtctcaagatttttacgtttatctgaagggcaactagactaagcacagtttgaaaaacaatctcctagcttaagctcaagtctagtttttgtgtttctggaaacagccttcccatgatgcagagcggatgttggaatatatgaagaatatttttgaatttttgcctctaatgggtgaagaaaggtgtcccattctttcatctttccctaaggattctgggttgatcactcaggaagacttcctggagattaggggtgatcttccaatgattcatcttcagcttgttcccttaaattcatttctctttcttttgctcttccatgtatcaactatctttcaaaatctaattcaagttttgcctcctgcaaagatatgttttagataggcattctgcagaataaattcaaacattgacaagataatttgatctaatcagtggttctcaaactttatatcagaggaaaggggctttacataatttaaatgtctggtccccaaacctagaaattctatagtttaatatgttactagatttagttagcatgttacaagtgcataactgcatagttctatgtggtggttcttagtccctttatttattttaccaaagtaactgtacttaaacaaaataaagatctcacacactgtgctagataatcctaagaagtttttgacctttaagtttatgattcttctatttataatgagcagcggcatcagctttcggaattagcagttgataatcatgtctagatgatgaaaaacaatgagtaaatgttgtagataacagttggggcttagatattttataattcttcacagaacacagagtgttggactctcagaacaccactcaagggcttattctttaaaacctaatcatttagaatatttatatccacacaaccaaccccatagcccaaagggatcttaaacaggtgttgttttataaataatgtctaatatgatgtatggttgtgagactttcctctctcaatctcccacactaaaggatcccctaatagattattttaaaactttgttttcccagacttagaaaaagaactccagcagacatttgctgtagttgagaggattccaacttttcagttgccatgaatacatcctaatggtccagaatctaggctgaaaataatgtccagcctagatggtatttattagaaaacatggaaatctcttggacaataccatggcacccccattcccatccctaatgctctgattatactctctggacctttgttacatcatggtgctgagacataaaatgtggacactacatttggaattaaaccagaatattcttatatatttgttttaggtagataaattgttaataattgcatatactgatttagtattgaaataaaaatggtttttatctgtctaaattattgatatctaagtgttttctgtattgattgcctcctcggtgaaacacatacgtttgttaaatatattcctataattaaacttgccatctagatacagacttctgtataggagacactttactgacagtatgatttaaaagtagcatgattataggttggatagagattccaaagtattaatatcatgataatcacatgctaatggaaattttaagataaatattgaagaaaaaactcaagttaacttcattatttctcagaagctttctttttggactcagctatgtttagcaatatgtgtctaaatattttcaattcttttaataataaattattcataggtgatttagcaattgagagcatgtaaatatgtaatttcaagaaaatgcatccagtggtgtgcagttctctggaagacaaactatgaaaaatccttctacatgatataaatttcacagtagcttacattcatatatattcatctaattatggttctaggattactatacctttgacctttctattggtacgggataaattgatatacgtaaatgtagaatgtgaaaaaaaattcacaacacagaataataattcatttattttctttaggtaagagtctgactttactaaacccgatagccacaagtaaatgttaatggaaaggttttcccaaggttctttgaatttcatacatgttttaattcctggcaggtagccagactatatcagcatttaaaatacaaaactaggatagaattttacctatttcaaggtagtatagtttgtgagtaaactgtggagagaattttaacctttaaatttgtttattgtttctctgtactatgtgtaagatgactaaacttggctacaaaaaatagctatatcttaataacaaacccctatttaaacccctatttagtataatttctctctctctcacccctccctcccttcctctctttgtgtgttgggggtgttattcttcaagaaagagagatgaagttaaatttatttaccagacaacaaacaaatgctttatgtgttgattgtgaaggaagatgctgaaagtttcctattaactctttcaatttcatttccattttctatttaaattgccattcatttcaccaaatatttattcagcattggtgtcttgtctggttttttaattatttgcataacaaagtaattgaaaaagcaagatataattaaaactttcagtaaatataaaaatttatctaaaacatgcttgattatttttagaaatacattacatgggggatcctaatgagatcctgattgtttttgttctgaatggcatcaagatgtatatgtttcagtttcattctataggttctgtttcagtatttcaattcaatttcttattataattgaaggattatcttagtaaccttaaagaaatccacaattaatgtaatttatcaatatgtatttatatttgaagatgattattgtctaacatttagagtttatactatgatatatacacaactattatattttcaagtctttatttatacaagcaaccagtcatacaatttgctatttgttcaagtctttatttatacaagcaaccagtcataaaatttgccatttgttcatttatttattctttcaatcattcatttaacaaatgtttaactgcttacccatgtgccagacacttgactgagcaataggacaccaataatttgaaaataaaaagaactggtctctgcatcaagaaggatatcatattctatagacataggtaaccacataaatacaaaacagtgtgacaagtgcacacaataatatgtaaatattctaacatgaagggaggcatctagcagttcttagaataaagtatttctaaacctgttgtttgcatcttgtgctaagacttggatccactgaggacctcattcagaagttttattcttgctatcagattagaatgaccatgcatttgtgctccttttctccactgcccccagcaccagaaaccctcaactagacctctagtatcaaatcatagtgatgccattaatttatttcttctgtatttttatatgattatatatatgaaattatttttaaaactagtccaaattattttaagtgtttagttactgtatttgtcaggatgtagattcggtgacatatcacagatcccccctggaagtccccaaagcaaaaacaaaaggtagttgttcacttctcatgtctctctgcagatttgggtatttcagggatggtatgctggatctgtaagtttctggggtctatgctgtttccagctctctagtctacatctttaaggaatgttgttttgcatgatctaaaaggatgctgtagtgatcgcagataccctcccagcagcaggatggacacgttttagatgttgcacacgtcattttacctcacatcccattagtcaaatagctattccctggtgcacagaaggctgggaattgagttcctcttatggaaaatgtacccagctgaaacatctcagggtcttttcttgtagaagatatgggatatgcacgttgaaagaccactggtagtctctgccacaagcatctgactaaatatttcagaaaaaagctctgtagagttttaaacttgtgtgtgtgtgtgtgtgtgtgtatgtgtgtgtggtgtgtggtgtgtatatgtgtgtggtgtgtggggtgtgtgtgtgtgttgttataaagtaatgcattgtagcttatttggaaaatatgaagtgtgaaagtgaaaataaaacctcccataattacaccatgcagctataatcactgttatcattttgtttctattaattcttgttaaaaattaaaacaaatattttggttgatttaaaacgtaatacatgtttattgtagaaaatagaaaatatatagaaaattataaataaatatcacccattatctcaccataagtaatattttatatttatccttgatcttactgtatatgttttgttaatttttttcatttaaccctttattgtggacatttttctgtcgtcaagtatttttccataactttttttttttttttttttttttgagacggcgtcttgctctgtcgcccaggctggagtgcagtggcgcgatctcggctcactgcaagctctgccccctgggttcacgccattctcctgcctcagcctcacaagtagctgtgaatacaggcgcccgccaccacacccggctaattttttgtatatttagtagagacggggtttcaccttgttagccaggatagtcttgatctcctgacctcgtgatccacccgcctcggcctcccaaagtgctgggattagagccttgagccaccgcgcccggccgtatttttccataacaatttttaagtgtctgaatttgtattacagaggtgcttataatttatttaccaatccctctattgcttgggttttagaatcatatatacctgaatttgaaactggctctccggcctttgagcaatatgattggaatatgctaatgaatcttcctaaattttagtttccttacctataaattgggaatgataatattatctaccctttaaaagtattccttggaattaaaatagataaaatagataaaatgcgcaaagtacttagtaaagtgtgtggcacctaagtccctaataagtgctagcataaccagtcaatcaatcaatcaatcatttaattaatttcaccacagaaagtacttgatttctgtaattgtttcagctaatttagatctgatgcttccaggtcttatcctgtctcttcaagggtggttggacccctgcagaagtcctgtgaagtgttttaggccagtgaggtggcctttaggaacacaaagggccagtttgtcaaccaggagccttgtgatctgtggagacaggaaacagacatttagatgggaacttacgggataacataagaatatctgtagttttctacaattgtaggctaggcgtgatccgtgttagaggggagaagaaggagctggtctgaggctggtctgaggctgaggagtgtggcctgcctctccctgcttgcttcctgggatgtctcctcagtgtcagtactggtgaggctggggcaggggaggagcagcagcagttttaaaatcagacttctctttgctttttgatttgttaagcaaattccaggtgtctcacttgctaatcacattgtcatctctgatgcttaattattttctttagggaaatgaagttgtttggggctttcaggaaattaaattgaacttcaaaaaccacttccacataacaattaacattttgaaatggataattcctcagggtttgttgctaggtgagtttacccagtttttcctttaagagatattctttataatagtggatttatttgttcttttaattatagatcatatttttaaaaattggacacattaaacatccattaagtccctagtaaaatgatataaaaatgtgtggccattgcctttgagacagactaatgttgtcatctatggagtaggaaattggtggtgattagctcttgggctctatatttgggagaagccttcatcattggaaggagttacatcttggcctgctcagaaaaaaggaagtagtttcaatgttagtgcagcaaaaatgcctaaaggtgactgtgctagtctgttctcatgctgctaataaagacatacctaagactgggtaatttataaaggaaagcggtttaattgactcacagttccacatggctagggaggcctcacaatcatggcggaagttgaaggaggagcaaagctactggcagcaggcacgagaatgtgtgcaggggaactgccctttatgaaatcatcagatctcatgagacttattcactatcatgagaattgcatgggaaaaacatgccaccatgattcaatcacctcccaccaggtccctcccacaacatgtggggattaggggagctacaattcaagatgagatttggttggggacacagccaaaccatatcagtgacttacatgtatgtaagaaggtgaagttccatgtggcttgtgggcatcattcccatcttctaatggagcctatacaacctcagcacaaatgttttcagtcccatttgaataagatagagattctagaaattctaggtgttgctgctctgtgccctcctaaacatgcctcctctagtcaatcagatttgtctttaacacatttaggctgcctttaagttctgcattttctactttgcctgcacacagatataatcacagtggaatcctaaatcttaatcactccacctccccctaaaaggatgtgggcgtagaattacttaaatattgccgtatgttagcctttgagaggcttttgcaagttatgagaacccaaccagttgctaataacctactattgcttctggcaatagtaggatctgatctagaaaaggcacggaaaatgtggtcagaaagattgggattctaggagaaattccaccacttacaaagtgtgtaaccttagtcaagttactcaacatttgaatgtcacttttcttatttgagaaataaagtccttgcatgtagaaaacatccaaaaacttccctttcttttttgttatcctgaaaatctgggtgtggaagaactgttgaacaataggttagctctatgttctacaacagactgtctctcaaatgcagagttctgtgtgtttattgactactagcgtcagcttctgtgcagctgagatacaaattcagccctaggcttttatccacagatctgagaggaggaaggcaggcaggcacctgtaattatagcagcagtgatgaattgcagctgaattgcatggtgtgttaaggcttttctgtgctggttggcttgggtattagtatagtgattctgggagtaacagacagtattttagcaagtgtttgtctttctattatccatttaaacataatcctagaatctccacagacatacaggagttcttttgttgctttctggcagtggataaaagtgtccatttttattaagtgctcagtgcagagtttaacagcccttttatggactggtactagattacgtatcgaggggtggggtgaagatagtttttctatcgacatttgtaaaaccttagatttgggtttccatgaaccagaatactgctctacagacgtcaaagactctaaatgttgcaaacgattgtcttttgtttcttcattttcctttttccaggttgcttggtcacaaaagacatctgtccacctgatctttccaagggagtatggtgggggtggttggggctttctgtgagggtgatagttaggcagggaaggaaggtgggagaggagaccactttgctttttctgcaaacccctgttatcgattaccctgtttgttcctttccccttaaactctcctaaaagaagggtcaattctctcaacatcagttgaatgaaaaatagcaatttgaacagcatctgcaaagtgacatgtataaaatccaaaataaaatgagtcctcaaactcatgtaattttcaattttctctcatttatttgaaagccccagtagcagggtcactatgacatggcgagaggatggaaaatctttatcagaatttattgagtaggctgttaataatatttttaatataatgtctacatgacttccctggcctttaagagtagaggtgtatcttaactctgccaaaataggaaagaagaaagactcttacacatccttcactaatcttcctcttacttactcttatctgactctttttctggggtagacagctatgatgactttttgtttttcttttttctcaactgaggcacgagcaggttttatttagttttcttacttttcctgtcacatgatctattctccccatggatgtaggacctattcctcacacctttcacctttccaggacccatttacagttctttctacctacaaccacccttatctcagtgtagctctttctttgtgtagccagtagcttcattcaataattaagagctcattcaggcctgtgcaaagaggctagggaggggtggaggtatttgggcctcttgggaacatacaaaggtggctgaggtcctgagagagagattctctacagctacagtggacatattttatagaccaaatattaacacacagttctgacatgtgagggtggatttagagggacggagcaatagtgtggctgaaactgagactgtctctctacacaagtagataataattgtatagtgctttgcattttatatgcatttacacacgcagtattcattagtccctatcataagcctagaaactgggtgccattaattccccttcacagaggaagaaacaggctgagagaggttaagtaatttgttccaaatgtcctaaatattgaggaatttgaagttgctttaggcttctgaccctgccttatgttcctttcacttcaacaacttgaatgtagttgaatttcactactgtttgattgggatgtgagattctccaatcacactgtcagaaccaaagcaggtgttgcatgctgtaacaaaaatgttttccttggcaggatgagacattgctcttctcagatgaccctcaagcagcctttcctaattccggttcacttcatccccaaataaaacacataaaagaatatgctgtattctaacctctagagtgcagcccaatgtgaagataataataacagtgaaattaataatgatgatggttactctttgttggatatctgacagatggcaggtacaatgcaagtgtttttcaaacattatattatccaatcctcagagcaagttgatcgccctcattttagaggtcagaaaactgaggatacagaaagataagttatttacctggggcttcccacccagtaaatttcagagtaagaattcaaatgtaggtcagtctggctcctgagcccatgctatctagttttccatgtacacttttgcttgcttttgaacaggagtaagctcaagaaagaatataaatacctacattatatttaacgatttgttcataaatattaactcataaacatatgaggttgaaccatatgaaattgctaatatttggacattgtggaccaagaaaaatggtcatttcatgtggcttaacacaaaagttcttaaaatgtggcctctggaccagcatcatcagtaccaccagggaagttgttagatatacagattctcagattccatcccagatttcataaaaaagaaactaggggtgggctcagcaatctgtgcccgaacaggacctttaggtgaatctcatacccaccaaagcttgagaacccctaattatcctaatgtatttgttaaacagcaactctgtgtcaggtgctgtgtgagccactgggttttcaggaagagcagaaatggacatgcttcttaccctcagagagcttactctttactggcaaagttccacgatgtgcaaatatgaaggtttttttagaggtatttatattgtattagagtttctaggtctctaccaaaagaatgaaatgtttagaggcacaattagaggggaaaaagggttaacatttcatcacagagatggataccaaccaagggagacaaactgatccagggactggcgtgcaggaaaagacatggggccagtgctctggactcagtgctcaggacacagcactgtcaaaccctatatcttggactccttttcttccccttctgtcatcttatctccaaggatggctctgttcactttgaggccatgtttggatgggaagagtacactaagtccacttctcagcatgggacaactcgggatgtctaaggtagggcttggtctgcctccactagctggccaagtagatactgatctgctgctaccttctgctctgaggagctccattttgtgggcaggtggcaaggtctcaggaaaggctttattccagaactttgcctttctctctcctgtaagctacgcagcatgacatggaggatggcactgcctttagcatcgtagaagttggcttagggtttactcgcacggaagaaagaggaggaagcaggggtcattgggaggtcagtgggaatgaaggcaatgtgggaccttccagttgtctgcgtctccccaagcctgagaaatggtgctccttaatatatgttcattaatcctttgtcattccaaagggagaaagggagacattcctaataatcttccatttactaagacagttttcagtcctgaagggttaaagaacattactttattgagtaatgtcttaaagtcagatcatcttgggttcatattttcttaattttttaaaaggaaagctgttttttttctccaaaataacacctaagtacaaataaggcaggttgaataaatccctgcttttttggaagcatcacaaggttatttgttccaccaagtttccaaagaaaagggaataaacatctgttgtatgatctcttagagaaacaacaataggatttttaagcaatctcaagtacgtgagcatcaaatctcacttgaatttcatcccttccattggtaacatgttagaaaataatttgatggaaaatttcatggtgagattggaatttgaaggtatttagggagaagaagaatgctttgtgacaatttaccttttaagttaccaatgacacttttgtatgacattaaaagtgttgctcctattattaatacttcatttgaattaaattcccaactcttattctggccttgttataggagaaataattcacatacacaaatagcagcagttgtgtacttaaaggcaagccaaatgcatatcatgcatcagaaatggaagtaccacctctgagaattcaggagtgttcacataatcggcacaggtttttacccaattgattaaattacattcctctgctttaactgagggggagtaattctaaaggttatgaaatcaatgcaagctgctcttggattgtattatttacttgaatttaggatccagattcttctcatcacctgaaagacaaatcatatttttctcctggagtccttcagaaattcccagagtaggctcaagtattacatgaataattcattttactcactacacattacagcacttaacaaaggctgcggccagagtctcctccttggggaagctaatttggagcatcattatggttctgattcccaatgtttaacagctttgtgacctacctgatgaagtcctttttgttcagatctgttaaagaaaaacttcaagtttaaaatttcattgagaatattattagaaggaaatactcccaggctttcacatttactccacccctgcctttgagtaaaaagattaaaaaaaaaaagaagaagaaacaaagagacacttttgaatataaattcaatctactgcccccaaatattttcttaacattgaaaaatcaaatgacatgatttaagtatcatacatatatttccccttgatttattcaacattggaactcaaccagaaaaaataattatgtgaatacatatgtggacatcacttagaactctgtgtggagttctgtatattttccttggtttacagtgcattttttcttatggctcttatgggaattcatctgaactttcatgttgtcataacacttcaatgttctctcagttataattcattaccacatgggatgagatgggctgtgcactttagcacatgctgaaatataaaagtctgaaggcactgctgactattcagctgactctaacaatgaccaatatagagacaccggtctttgtatgttactctctttctctatccatccacccccattcagacaaacccttggataaattgaacactcttagataccaaaggttagaaatagtgagttcttcagtgactctaatgagctcacagctgagtatattttccagactaacttagttttgaatatcaagagagacccccattttattcatgtgagtagggaagagaaacttgttcttaggtatactttaaaaagctctatttttaaaatttggatagacttccctcgtgttttccatagcaacagcaccattttacagtcctgacaacagtatacgagtgttccaattttccacattctcgacagcacttgtttttttatgtatttatttttgaaagtagactaacagatatgaagtgatatcattcattgtagtctgatttgcaatttcctgatgagttgttttgttgagcatcttttcatttaccagttggccatttgtatatcttctttggtgaaatgtctattcatgtctttgccaactttaaaatcaggttatttgtttttgttatttttgctattgagttgtaggaacttcttatacagttttgatattaatcccttatagaactaccttataatcagtcaatccaacttccaagcatttattcaaaacttttgatactaatcccatattgaactaccttatgatcagtcaacccaacttctgggcatttattcagaagcattgaaatcagaatcatgaagagatagctgcactctcatgttcattgcagcattattcacaatagccaagatatggaaacaacctaaatgttcatggatagatgaaaaaagaaattatatggaatgtaaggtagctgtgggagtggtaaatgtctacagccagagtaaagattataatgattactcatgaggatttgatttctcctatggaaaatatatgtatttgggggttgttactattttctgtaaagaaacaggagattcaacttgcaataaaattcataacaagtgctatgaatcttgctctatccaaattttttttcttcagaattttttttatttttttttattatactttaagttttagggtacatgtacacaacatgcaggtttgttacatatgtatacatgtgccatgttggtgtgctgcacccagtaactcttcatttaacattaggtatatctcctaatgctatccctcccccatccccccaccccacaacaggccctgatgtgtgatgttcccattcctctgtccatgtgttctcattgttcaattcccacctatgagtgagaacatgtggtgtttggttttttgtccttgcgatagtttgctaagaatgatggtttccagcttcatccatgtccctacaaaggacatgaacccatcattttttatggctgcatagtattccatggtgtatgtgtgccacattttctttttttttcattttttaaaaattattattattctttaagttttaggttacatgtgcacaatgtgcaggtttgttacatatgtatacatgtgccatgttggtgtgctgcacccattaactcgtcatttagcattagttatatctcctaatgctatccctcccctctccccccacccacaacagtccccggagtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacacgaactcttcattttttatggctgcatagtattccatggtgtatatgtgctacattttcttaatccagtctatcgttgttggacatttgggttggttccaagtctttgctattgtgaatagtgccacaataaacatacgtgtgcagtgccacattttcttcatccagtctatcattgttggacatttgggttggttccaagtctttgctattgtgaatagtgccgcagtaaacatacatgtgcatgtgtctttatagcagcatgttttataatcctcttggtatatacccagtaatgggatggctgggtcaaatggtatttctggttctagatccctgaggaatcaccacactgacttccacaatggttgaactagtttatccaaatttttatagataagcataaaaactagtagagacattagatttaataaatactgtagaacaattagtcatactactgttgactagcactctgttgtaccagtttaattatattttaacaagtatattttattatataatttctataattatattgcataaaacatggaaaattgagagagtaagacatcactcacaagagcaacttcacacaactgctgatagtatttcagcgtattccatttcgtgtttttccaaaatgcatcttttttcccaaatttttactgtaactgtatacaatgttatcctacatttttcactttgtattaaagttttaaagacagcaaggcatatttatttttgaacaattgaattttcttgcaatcaactcatgtatcacaggccaattcaaatttatgatagactgatttttactggctttgtttgctcttttcctagacctttaaaatctaaatttctctgagaattgtcaactctgctctctgcatgcccagcattcccctggcttctactaacactccttttgcgttattcctgaggagagttctgtcctgtcttctgagcatcagttttcctctccaggatttgaagggcatactgattggcaagtctcactagcactgaggccatctattattcacaagttagtttttcctcgtgaatttcctttttgttgttgttgatggacttttcattctttcagacttgaaagcttggaggcatctttgatttctctttttcttctttacccacatctattgagaggtggccatattgtgatcattacatcttttcgctaagcattcaaattcctaattccagtctttattaataatcttccactttgtgtattgagacacagtacaacactgtgcttaaggtgatgggctctggagccagacctctgggagtaaaacctcagctttgttatgtatgcattagctgtgtgacctgtggcaggattcttaatgtctctccttgtctctgttgtgtaagatgagtaatactatagtacttaaccaacatggttatggtgaagattacagagtgtcttctagctattttgaaacatactataaattcttaattatagtcaccctgccacgctattgaacactagaacttatttcttctatctaactgtatttttgtatcaattaaccaacctctctttatcccccctcctccctacacttcccagcctttggtagccaccattctatttgttactcccaaaatatcacatgtatgccataaacatatacaactattatgtatcaatacaaaaatattagtagtatcaggaaaaataaaagtatcaaatattaaaaagtttacagaagatctaccgtctacaggcactcaaatggtgtagcccctgtcatatttgtacctgcctctctctttctaatctgtcctatgcactactgccagattgattttcctaaaatatggttttgctcctactgattccttccgttttcttccctttcacccttcagcttcaataatactgcttgctaaatgaaattcaaactgcttggcctggcatttaaagtcctacataatcagatttttaagacccctttccagcggtcctctgtgctctagacaatccaaacaatatgctatgttttctttaaaggcctagtttaagggtgatatataatatgcttaatatcctgtaaagcacagacacatatcccaatctggagtcaggtcttagggagccagccatgccttaaaatgttagttgtttaattgtgagaggccccatgagaggggcctgtggagcttggatggcaggaaggccttggggaaggttggggcagaagccaattaccacatggtatggaagtatctcaatatattaacaacttctacagctgaaccaaggcatgacaactaaatgtcagcattggccaggtgcctacttcttgacaccgctcctcccactcattgaactttttgttgaaatttcttccacattcaataaaacctttataaagtgccatccccattctcattgctctgcttttctgaaattctgtggttcatctaaataatcctgttttggaagttacatatttgtcttcccttttcatagttaactttatccacgaatatatttagttacatatggttacctaagtagctggaaaatgtgcatgaaggcaggtactatatacttttcatctctgcatccataccctggtgctgttatcgtaaagtgcagccagtcaatatttgctgaatgaacaactaagctggcacaattcagtactttattatttttctagcaaagaatgtacctgtgctccctggtaattttgaatatggattacaaattaccagatttgaattatggcaatactttgtatcggtaaattttgtgtgcatgaaaatataaaattttgggtagaattaaatgattcatttaggtgaattggtcattcagtcagccagtggggtcattctgtgtttagtcagtctgttagtcagtcactttgtctaccatttatccattcatttattcattcacttaataaatgctagcaattcacagctaaaagatgttggtggtctctgtgatgtaaaatttctgggatgcttcgatggatcacagaggcaatgggtagtatttttgagaatgttaaatgctttgctaatttctaaccttcagatgtatgtactcggaaagtggttctggagtcatcttttgcttaacacatcctgctattagattttctttaattagctcattaggaattaatatctgtgtttgaattacaaatccacattttatcatctatggacaaaaatgtcagcgattttgtttcatgtgaaccagaccaacacacagtaattatttctgaatatgaaacacgttaaaaataaaacaaaaatctggagttcccttgagcttgacaattaccttgttgtctactctgtttgctagttaggcactgaaaattctttaatacagctttgatttgttaacatgcagtttttaaaaatgctgccttccttattgaagtgagggaaatgcatttctactggttacagatatttttacagaattaaatgagaggaacaaaaatgaatggattttgtcagtcagttgccaacacagaagataaggcctaaggctttggtcatttaacatttgtgatataattttaaaaatcttagtaggattaaagaatatcacattctattatttctaattcgatttttagaagacctatggaaatgttgatttaaaaaactatattgaaataaaaaatggttcttgcagttacgtaaggaaattattaacattattaaacaatatagaatccttaactttgacaaagaaccaagtttgaatgaaaatacatatattagtttaaaaaatatgtaatgagaatctataaaatcatagagcttaaaagcaaaggacatcttaaggctttgttcagtagccttgtttcctctcctaaggaacgttaagtgttgaagtaattagtgttagtctgcaggtgggtgacagggggttagacttctgctcacatccctgtcttcctgctcttccactgcatcacactgtcattcttttaaatatgttttatcattgttctttctcctttcaaattcttaggtttcttatcagacttgctgcattagaattctaagacaaagactttgaaaaattcaatgactttttaattaactacaactttaaaatgctgacatttgcacctcaacctgagtccaacttactaaacattgtgtgttttgcaatctaattatatgttctcttgggaatagcaaagtcatagtgaccttggtgtccccataatacctactgagaatgacacatatgaactgaaccggatcttcagtcaaaatactttacaagcagctatttacttgttattcctaattcaggaaccacaaggtcctcaattttgtaaatggcacattcagaggggaatcaaattgcagatgaatgagagaatttacgtaggactaggagacatgatacccttgttgctcgtaatgtttcattaacacttaactagagagagatgtagtgcacaccctaactacatatgcactgtccttcttcccttatattttcagcagggtaattcacagctgtgagtcagaatgatagcataagggcttcagagctctgatcacagaccaagaattatcttggcagagaaatgaggagcagttagtaccaagagcctaaaaagaaagtgctaagtagataattaacatcttttctctcagtggcaacctggaaaagttcttggtaaggagccataaagaggtctctggcctataagaaggaagaaaaatgtaacagacttcctgaaaaaaatggagagggtttttttctttttttctgttttctttttttccaattatagcagcactttatttttccttacacaatgacgtgttgctggggcctaatgttctcacataacagtagaaagccaaaatttgttgtcatttcttaaagaattgagaatagtgtgcaaaaatatcttacataaattaaaaggatgaataaatttacaggtattaatgcagacaactttcaactcctggcaagtaacagcccacggtgttctggcaggaaaacaccaggtaagaaaggaaactgggtcctaacgcttggacttctctaacctttgtagaccagcaagacagaaacaactggttcaggagctcttgccagcctttagagaaatcctggaacactgagctctgacacattaatacctgcacagatcgacagactgctggtcacacagactcaccaaaccacggacttttcttccacaatcatgttctcacctcagccactgagtgaccgagttacatgtactaagggtttaaatccaagatacatacagggtattaaacaaataccaagggaacagttaagttcaatacaaagtcaaaatcagcagcaagttttataatccagtgctggtaatcagatacaagcttctgggacaaatttcttttcaaaggcttactctagtttcatgagactagcatgaagtgttctgaattaacccatgcagcaaatgctacacatctgctcacagcctattctgctgggtgatccacatctgctggaaggtggaaagggaggccagcatggagcttctgatccacaccgagtatttgagctcagtgggggtgatgatcttgatcttcgtggtgttgggtgtccgggcagtgatctccttctatatcctgtcagtgatgcccaggtatgtgattgtgcctccagatagcactgtgtcagcatataggtccttgtgaatgtgcacaccacacttcatgacagagttgaaggtggtcccaaggatgcctcaagattccattctcaggaaaaaggaaaagcgcctctggacaccagaacctctcactgctgatggtgatgacctagccgtaaatcagcaactagctcctttccagggaggaagaggatgccatggtggccatcacctgctcaaagtctagggcagcatagcacagcttctccttgatgtcgcacactatctcccactaggcagtggtggtgaagctgtagccacactatgtgaggatcttcatgaggtccaggtgcaggatggcctagggaaaggcatagccctcaaagatggcactgtgtaagtgaccccatctccagagtccatgacaatactagtagtactaccggaggtgtacagggacagcatggccctgggtgccacatacatggcagggggtatccaaggtctcaaacatgatctgagtcaacttctctctgttggccttggggttcagaggagcctcgggcagcagcactgggtgctcctcaggaaccacatgcagctcattgcagagggtatgatgccagatcttctccatgttgtaccagttggaaataatgctgtgcttgaaggagtacttcaatgtcaggatgccatgcttgctctgggcctcttcacccatgtgggagtccttctggctcagttccagtaatatttattggaaccttatgctatctctgatgctgtcctgtgtgcttactagaaagacaagtctttactctgacagagtttatattctggtgctgggggcgcccaacaatggaggggaacatggcttgggggcgtcatccccagcaaagccggcttggcacatgtggcgccattgtcaaggacaagtgctgtgaggctcttctttcactgtgatccatggagagtgggttggcagtggcaagtgaaaaaaaaggaaggtgttacctgatgtgtgtgtgtttggtgtatttctgtatgtatagaagagaatgtgtgaccaaaacaaagttaacttatggtattacatattacttgtttttaacatcagtttgaccatttgaaaaatggaatattggttatcactttgttacttggcctgcatggatactttataactactgatttaatagtattattaaaggggagacatttccaacactgaagtggttcaaggggcataaagcttcctgcccatgataacatcacccatttagtgtagacccacgtgcactttttttcaggcatggatagctggcatggggaatcatctaacactccatgagatgtgttcccaacaaaacattatgcctcattagaaagcgtactctgtattgttttttactgtccacatacaagaagctaataatacactttgagcaatttttaaagaaattaatactcttgcgcataattaagaaccctgtggctatttaattgttgctcttctcattagaccctgccctgctccctgcagataccccatgctctcatatttgttccctcttgccaggaccttctcctggggctgcctgcctataatttaatcaagtccctcgtccatattttatattttatatatttttctgccacccctaggaagagttgcttcctgaatcattcattgaactaatatttactgtaaccttatgctgtctctgactctgtcctatgtgcttactagaaagatgagtctttgctcttatggaattctagtgtcttaatcctttggagtattcttaagttattttggtaaactaatttatactataatatcagttgcaaacattggagtaaatgatatttaccccccagataatacccaatgacaatccactaagtaaacatttattgagcgcctaacaggttgtaggaatacaaagatgaatggggttctgtcccatattctcataatctacaggaggagattgatacctacatattgaaagtgatatttaaatacaaatgtgcacttctattttgtctttttgggaagaaaaattcattttaatctatctaggcattcatctgcttagggtgagaggagggtatgatgaatttgttatgaaaaagataatgataatattgtttctgtcacacaagaataggattaaagagcacaatagtgaccatataagctaggctattttcttgagaagggatcatctaaatatttttttcttcttctttggcaaaccaacaaagaacaaataagtgtggaagagtgaacattctccactattaaaacattatacatataaaacagaggaagaaagatctaccccctttccagactctgtaatttcaaggaggaggaggaagagaagggaatgaaactgacataaggtggtcaggccaaaagagactcagaggtcgagtgtttgagacacaaacgctgagttgagatctattggcctctcatggcacctcaccctgaggctttagaactgaaaaatcccaagagaaaatcccagaaaatcccaagagattttttttctgtaaaatgaaggtaataataactactcttgttgccgttgtgagaatcatagacacgcaaaagtatgtaaagtatccaataaagtgctcggcatctagaaaacacttgagaaatgcaagttacctccatttcttttcaatttaccttctggcaggactgaatcaactaacttcttcaaggctgaaaagcccagaatgcagactggcctgacttgctgcttttatacctgcgtgacgtgcagcaaattgcttaaccttaatttcttcatctataaaaatgaggataatattagcaactacttcttaggatggttatgagtattaaaagagataacagatgtaatggcctcagctcagtgcattgcaagtggtaggagtgcaataaatatttattattgcttatgtttttgttccttttatgttgtctgatctgatgtgtctaaaaattatctttattttttttcttcattgaaaatctcctacctcaggtactattctttttttttcttacttattgttttaactgtattttctttatgctgaagagcaagatatattgctttgcatttaacattccaaaacagagcaatggcccatagagatgagaacatttttagtctgaatctagaagtgaacggtttgattaaaagagaaaactctacatttatttatcccctgtttgcctatatttgcagtcacccaattaatgatcaccagttgcttatgtaaattactctcaagagtagcttaaggaacattttatgagtcgtacaggccaggaatagatcttaaaatagcgactagagagttgaagtccgcctgtactatgctagaattaatagtgcatgacctgtcactgcaacgaggtggccccaaattttactgtagcccgctgacacgggtatagatgtgacttaaaggtcacccttaaatatagaaaagcatgtggccatggggtgttttagacactaacgtgcaaataacacaaaagtgggcttcctgcttgctacttattcctgtgtgtgagttgggactaacagcagcagagttctagaggccttcagcccatgctccaattggaggtgaggaagagaggatgcaatgggatacatatcctaggaccatttgtgaggaaagtctctgtaatcaaccctaaagagtgacgtggcctgagagatgagttctcatacaagtctctctcttctcaggcaaactcgaaatagtggaatttcagagctagaagggatcttcaatggcaaagtcttggtccaaactttcacatactttgtaggtgtctgattcagtgaacagaatttctgacatgcagactttcctcactaatttgaatatttttttttttgttagaagaagaagaaaaatatgtcatttatacatttttccatcagaggagtttgtgaatcttgggtaaaattttatagctctatcgagtttaacagtttgaatattaaccttctggatgtgaagatttaaaatattttattttcctactactttctggaatgagaccaatccttttacacattagggggattttcctggcctttctgtgtttatctaacatgtcacacacccggtccctcatggtgggctgccctttgttcttgaggtgagacatgtcagtggtggtaccactgtaaatggggcacttctctccccagctgttcaccataattcctgaaagggaaacataaaccaaaggaaataaataatgttttgcttatttctctgcagctgccccgtgaggaccctgggtacttggcaaatctgtttttgctcctgaggaagagcctaaggagaaaagaaattctatccagagagatttaggttgcacaaactgagcctgcactttcaaagaaaataatagatcacatagtcccaactcttagagttattatttttttcttttccattgactccatttttccttgctgtacaacagtttctaaagcagagtttttgagtgctttcatccagaaccaatgagtgtacttttctattcttctttttttaatatagtgtgactcagcagtgtgacaatgtcttgcacttaattccccagaagttattgtgaaccatggaataatccttacctttgtctgatgtggcactttctgctattcagaactgacatcactcccttcaggactcaatctctgtcctgcttaaaccatgccaagatttagacaattctcccaattaactacattgtgaaggcacacggtgatttttttttttttttggcaataaaagaaagttgaaaacagacttttaaaattggggaatagcaacccccttcccctcaatcccctcctccaaataagccacttttccagttttttcattgtggtccagaagttgtttttctcccagtttgttggtgacatctccaggcgtctcccttttccatgatctccatgccagtggcttagtaaatttcctttgcacacatgatttctaaatctctatctctagttgtgtcttctttccatgctattaaaatttcctttgatatctcaagatccatgtgcccaaagatcattgttttgttcttttcagaacccactttctcttctgattaatgccattgacattctccctctgacacttggactcagcatcttagatttgtctttgacttttttcttcccttacttctcaagtttaatcattttttcaggacttggagacttttcaatatcaaagcttcctggatctagcttgtctttacatacatagacaggtactcattacttttacacatgaataattgcagtggcctcctaatttgtttctttattcttcccttcttttatttcatatggaaatattcaaatgtgcgcatatatatttttaaaaagttatattctttatccttttcaaaattcaagctaagattctctgttagcgtaatcttgcctatagcatttgaaacaagatttggttaataaacttcctatctattcagagtacagtttttcaggattaaaatatttgaataagttgatgtacatgtgtatatacttaaatattaatatagctacattttactaattattcatttttatgagataaataggcagtaagttcaagttattttttcaaactctgttttcagaggttcatgtatattttattcctacaatatgttttttgagtgattcaggatagtgcacaaaacagaaagcttgactgaaaagataatgattttttttttatactgaactcttagtgacattgttaaaaaaatttttttagctgcaaggctgtgtactgagacatttagcatttgccttgtaagaaaaatgttctgtagcaaaacttgaatagagtgggggtgtggtagataattaggtttcttccatatttagatcctatgatttatgttacccccactcttactggagcaagatttttatgtgggagcaagaactagtctggatagagaatatataatttggggaattggtatcttcagcaaattttcagattcttctcagttcattttatgtataaatcttttgtagaactaaatcaccagatttaagatcttttagttttcctttcttattttatagagttttggggaggatttggtaaaagtcaataatgatttaaagtttattattattattattttttattattatactttaagttctagggtacatgtgcacaacatgcaggtttgttaaatatgtatacttaaaagtcctatataatttaaaattatattgtaaatttcgtctaaattaagattaaaatggctcaaatcatcatatttaaagtagagatcttgatctagtttacagttatgtattgcatgaattttaaaaataattttagagttcaatacctatatggatatatatatatatatttatactattttgtaaacaaattaaaatattaaaactcacagtgtccttactacagccaatggttggcaaagaaaatgcctaaatttactaaagactgaggagagatattctatcacttgatgcaagcaagcaacaatagaccacatggctgacttatttctatactgagaaaaatcctctgtttccattttcacaaacagaatgaaaggcattagcaaaaatgtcctgctgcattccttcatgagacctatttaggtaatggaaatcttagcaaatatattccttttccctttattgataatggtctagctacataatagaaacatcatgtggggagcatctaatgtacctcacaactgccaacaacggtgtgaattaggacaaaaaggattggtctatttccatttacttcaaagatccttttaatattctttgttgctgtagactaaatattgtgattaaaatttccttctctatttcttcattattatgcttttaacaacttgtaatttcacaagacatttcttaggaataagaaagtgttgtaaataaatgtggatacattcttaataccttagggagtgggggcaatagtagcatattgattcacttacagtacatacagtataatactacttattttcccaaagtgaccatctgtccagcttgccagcttgtcagctatcatcattcctctgagcttcagatcctcgcccgtaaaatagggagagatacagggttattgtaacaagtagaataaatgacacacaaatcattctaatagagtgcctggtacttcccttatatacccttccaagatcactcctcactccacccttgttccctcgatgatcttatgctttaattgtgagaggcaaaaacaaatacaaaaggaaataaaggatgaagcagtgggcggagaatgtagactagtggaaataaacttgacaggaagcctcctaaattctagtagtcctagttttgctaccaaacagctatgataccttgcttggatcacaaagtctttctatatctacatattgtccatcaaatgaaggtttaatgggggtatttattaagtgccacatttgttatatagacattaagtctcattgtaattctagcatgttagtagtccttgtgggttaaagtaagtgattagggaagatatggaagaagtgggacatgaaatgggctttagaagttcattaggatttggttagctcaagggaagacatttatttgttgttgttttttttgtcttgatcttagccaactgaaatgttttaatttttcatagaatgacataattgaccagaatgatacgttctgaagtgacactggccattaacttaattgctttaattctttagatgaattttatttgagagatttataattctaaaagataatgcctcctgtaaatagctccactatcgtacttatcaatatgtgtggaactcgtaaatggaatatatattggaaactctttccaatacagagtcctttagaaagaccaaaataatgtagccacattgtgagattgccatcaagaaatgtgctcaacatcgttctggcacactcttttaatgagtccatatttgtgattaataaatgcgtgaaatcattactttccagtaaatatatataaggtaagatttcaaagtgacatgtcaagtatgattagtatttcttcgcattaaattgataaggaacaatgtgctttaaaatcatagtcacagactgggggatttaagagccattgccacacagatgacaattgaattcctgagaacagattagattgcctagaaaggacaaatttgttataaggcaacatgcacttttgtaaactgcattgatttttgtgctaataataacaatggttattgaggttgttgataagtgtatagaactaatgaggtttgttatattttaggtcaacttggtgtccgttactttcagtcccaattttatctcagaacttctaaacctgagatgtaaaataggctacatagatatcttaaacaattgctcagctgctttcaatgtacagctgaagctcagtgaccatctgtctggtgcgctgagtattctaaatcctaaaagtgtatctcattgggtctatatatgtttatatcatatggattattcttactgttcattgttccatgggactgtagtttgggcactaatcccttacccagtttattttgtcctgggaagcagagatggtttcattggatgcccatggttcaaagtaacagctttatgcataaagagcatcttgaggcctttaccctcagaaagcaggcatagttgcaacagccatgtagtgtgtaatgaagcttcaaagtcttcattacacaagtattatctcaattatctcatccaatcctcacaacaaccctatgagaaaattatctatccccagtcttatcttttagatgaactacattttacagctaactaggttacccaaattcacaaaattagggacttaaagccatgattttctgattctaaagacatgggacttttccattatgcaatattgacttcaataaatatccctctccttttcaatttccttaatgaaagccatcattatacatgtaaatatgtatattgataattacttcaaaaatggaaatgcattgtagttgaaataacaaaaacaagaaaatatctatataagatataggtattataagtagctatcttacctatgatgtaattatttttaaatggacttctggtttagaattttgggctatataggcatacctagttatcttgaacttaaatgcaatttatgaaaaataaataatttttatctttgagagagtcttgtgaaaagaagactcctgaaaagattcctgagaaaatattcatttgttattgttagtgagaatctgggtttaaaaactgcaactatggcaataatgttctcattggaagatgaccacttcggtgaggttatgaccaaattgttatggaattttttaaaaaagttagtaagtgccaatggaagacataacacaatttccaagaaatatatgtaagatcataatatgcagttgtagaaaaaatgatggggtatcaaagaaaaatatttccctggaaaagtgcttgaaaaagaatctactaaaacaataaaacaacaggaaataaggtgaaattggacggagaaaaaattcaacagaattaggtataagacacagcatgggccaatcttatttgacaaggttcaattgacattaacaaaaactggacagaaaaaacagattttatgaagaaatgaacaaagtcataatttagctcagtgcattaagttaatcagttattaagataatcctgctgaggcacttgaatctttatttccttacccaatggttcagagccacaagaaccctagttcaaatgcttgtgcagttgatctggttaatcaactaattctaagactgatcaactttgaaggaaaatcatttgaggaagattattatgcccagttggaagtaactggactaaggaactgaaagctgtacatctttctgtctgtgtgatagaacctgcacccatgcagttgtccaaaaactatactttctagttcttttcagttaaaaaataataataaaattgatgaatggattccaacagagggcccttctctgccctaaaacatattgacacatttactcatatttctgtttgagggtttaaagcagctcaaagtttgtaacttcctgtgtttgtctgcgcccttcctcctaaatacgcaagggcctttaggaccaaaaactcctcagcctccttgtcagattctacgagaaagaaatgcttttttgttttttttttttgttttttgtttactgaagattacagaaaggagagtgttagatggtctatcttctaccttgcaggcctgaattttttttttttttttttaagacaggatcttattctgtcttgctgctcaggacagattgcagtgttgcaatcatagctcactgcagccttggtcttctgggctcaagtgatcttcctgcctcaagcttcctagagcactgggattacaggcgtgagccactacacccagcccaggccttcagacttttgtgttctcttccagctcagctctttccaaaagccagtaaccccatgcaggttggtcctcgctgtgagattctttctgagtagtctactctctgtcccttgtcatcacagtattcttgcttttgagggaataggccctaccagaccagtctgaatctcctgaaatgttggtgaataaaattttgttctgataccacagtgtaagtaaacaaacaaacaaacaaaaagcagtcatcatttccaatttttctagaagatctcaagttgtttttcatgcatatggtgagagaacaagttttttgtttttcttttatcttaaaactgtatatgcttgtgctacccagaacacggtattatgcagtttaagagattctttacatgcttggcgcggtcaaacatcaatagttctaccttgatagactttcaagtctggaaaaagcttaatgaagttaggagtctttatggcctcatttttttcttttcaactgttagtttaggttccaggggtatgtgtgcagggtttgttacatgagtaaacatgtatggggtttggtgtacagataattttgtcatccaggaatcagcataacacccgataggtagtttttcagttctccccttccttcaaacttttaccctcaaataggccctaatgtctgttgttcccttctttgtgtccatgtgtgctcaatgtttagcttccactttattttattttactttgccaaagctacagaacataagaaagtagtctgggaaacttcttatagtgaaaggatatgtatacttgtcttttgggagatacaaaaaaaaaaaagggggtgaacagggcagaatttttccaattcttgggagagggaaaactccaagagataagagtgggtggaggtaattttaaaaagagaagaaacgttgattgagatttgaaggtttgctggatggcagaaaaggatagcatgaaaccccggctttggccacagatgtgtctgaaaatgttgtaggactgtctccttagttcagccaaaaaccaggttcttgtcacaggaccaggaaaagattaggctcacagacactttgaagggtggggaggatggagtttgttgggagaaaaggaaaaaggaaaaataacacagcaaagtgagatggggtcctgctaacaggctcttcacctcacctgttgaatcccaggttaccacccaggaacaggagaggccaggctcctttccccctgcaaacagcaggaacttcccaaggtttcaccccatcctgccagtcagtgcgccggctggttggagattctctggggagcccttttttacttggctgtctccgaaccttaatacttgcctgacatgctgccagatttcttgaaagacacgctgcaaacttaagttttttatttgttgacatagggtttagaaggaagtataaaacacaaagagtgatggaggggacagaacaatggagaaccactttgaacctagacatggagttggcaaactttttctgtgaaggaccagctagtaaatatttacatgatttctgtagcaactactcaaccctacctttatagcatgaaagtagccgtagccaatacataaatgattggtccctgctgggattcaatgtaactattcacaaaagtagggagtaggcagatttgttctgagggtggcggtttttgctccgtctggactgttttcccagatttctttgcattagcgtatttactacttctcctgttagcaagtcttgactgaatcagcaaataaataacataagattcttttccagttttactctttcttttcctataatgtttacaatagaatagtgcatgaataattttgattccaccactacctccatttgcatcacactatttcatttttcttattattctcagtgtaatagaatgcatcacagaatgatcaccttgagattgtcaaggtgtcactatttctaaaaattcaaagtacgaaaggggtctttaaggaaaggcacctgggataagaggcacatagttacttaaggaacaaggggagctaataaacatcctatgtataggtaaataaagtgagtaaagtacaatattacttttacttttcaagaatcaaacagcttacttgaaataaaataaagggcaaaatgtctctaaatgtggaaaataagtatctggaaactaaataatttaattctaatttacaaaaagaaatactgtgatacagaaaagcactaaaaatacctagtgattgatagaaaaagcagaatacattaaacatcaaaataaattatgtggcagtattgtgatgattcatcagggcaaacaagtggatacaggtttctgagttttaatcaaggaattcaattttgttcaaccatatcttttgagacaacaataaagctaaagtggggcaggttcatttcagatgagaaaatatttaaatgaatcatttaagaaatgattaatattattatatatcagtgaaaattatttctgaaacttttagtaggatacatcttttgaatatgtgcatatatttgggagattctgaactgaatcaaggtaatagttttcccttttccttgattacttactctagaaataagaatactaccggaaaacatttgccctatatctaatgtaatttgccatacctcaattttagattgtatttattcttttaaaatttttactttattcttattttaaaatttattttattttattttttatttttttcaagatgggctctcactctgtcttctcggctggagtgtaatggcccaattatgactcactgtagcctctacctcctgggctcaaggggtgttaccatctcagcctcccaattggctcagactacaggtatgcactaccgtgcccagcccagctgattttccgggtttgtttgtttgtttgtttgtttgtttgtttgtttttgagacggggtcttgctctgttgcctaggttggtcttgaactcctgcactcaactgatcctcctacctcagcctcccaaagtgctgagattacaggcatgtgccaccacatccgactcatcttaaattgtatttattcttaaattattttctttttttctcaaggtagaatttttcctatatgctgagataaagtctgagtggaagttgctcttgtatttattcatatagctattactttaatactttaaaaatattttagatttatattaagtaatatattcaatttggtcaacatgttttatctctaagccttggcaatgtagcaatatgtttttaaaaatactgtttgtaaaatgtattaaagtttccaaattaagaatgaaaacatggttttataatagcctttgctggctgttggcttctagttttcttttaaaggtataatgattcaagttcatagaattccttcaatttatatgcaaagttctccttaattgcattttcttataggagtatactatttgtttattaagtaaaaattttcaattcaggaattgcaatcctttcttattgaaaatctgtactttttcagattaagaaaaaagactcacatggttgatggtactaaatgcttcttcattaactactctctgtctgctcactactccttgcctcattactgaatcatgatcatttctcccccttagataaaagcttctctgttttatcagcatatccctctgttttcttatctttgccagttcttttctacaggcccctggggccagtccaccgcatctgctatatattaatttcccctaatttgctgctgcatgtctcattctattgggaccaatctaatcttagatttaatttttttctcagacatttcttcttccttcttatatacccagtatgtaacagcatccttggcattcctttcctgttcaggctgcttctctatcaattccctgagaatcttggaactgagaggcaggctcagaatactccttgatctgcactatcctactctccttttcctcaataacttaaggacttggtttagtcttcctcaatggctttctcttgccattgtatttagagacttagtactcatattgatgaccattgatgaccctgctctctcatggtttccacctcctaaaagctgatggtggttgtctctattaagcttcagccaatctgagcttcctatcattgtgattacactctcattacttgaacatattccatatccgagaactataactcagcatactttctgtgaacacaacatcttactccaacttccataatgaacttctcatttatctcctcccccgagtccttctgtccttctcatatgccctcttacatcttattcattctggtttgcctgcttaaatgttcagcttgtactccagggacagccatttcaaaagtacatttgtaaccactttagaatctattgtccctttgatcttctaccaattttctttcatctttccattgccctagttattctcctgtgtcttttgtaatgggcaaacaaattctgttaacgtgggctatggacccaaatgagtgctgcctgactaactctatagcaaattcttgcagttttacagcacttgggatctagccacttttcccatctgtagttgactcattcactaatgtggtccaggatttttcctttcatggcacacatagaaactatttttatgcgactttttacctatgaatgaggccaaaatacttgccttgtttacactaatggacattgcaaatacttagtgagataatgtgtgttaaaatacagttttacatctataaggccctaatattataatcattccataggcacatctcatgctttaccacctctgtgtcttattcattctgatctctgcctgtgatatccctcctcaacttttaagacttagcttaaatactactttcttctgtgttacctctatccactcagcacctggcctgttcctgttggccttggtaaccagaaatctttatttttaataatcctgactatataagattctatgatcctggtatcccaggtagtacttagtccactgctctgtatctagttaggcagaataaatttatgaggcaccaaattaaattgaatgataaattttgcaaatttagaagtatactcctgatagcaaaggtttgagtgagtttatgggttattcacaggacttttatgaatttttcatcctttttatctatgcagctcatcagttcattattacacttcattataaagaatacactccttattacgacgataataaaatgattttttttgttacaatgaatagatttaaagtgtcattgattcctctcctcttcagtgatagtttttttatacactaagttttatacactaagaaccttatggttttagtagcataaaattgtcatcttgtaaaagagcttgattacatcagatagtcaagctcttgctagtaagacatgtttctgaacaagccctcagaaaggaaaatatattgatagatcactttaccatcacctgtttgaaagaataacttcaaactattcttgaatattgaaaaatatattttcaatattgcctttaaaaatcctgtactttgaaggataactggattaaatgccaaaacaattttcaaaacactctatacacatggctttgtcgtattttttttgtgagagaatttatggaaatactacccatggcttactagagccacctcaatcaccgtttctttttgctttgactatgacatattgagtgtggaaaatactttgtacgtgtatatataatatatattttatgtgtgtatatatgcttatatatttatatattatatgtttatatatatatgtatacatttttacatatttatatattatatatattttatatgtgtgtatatattatgtttgtgtatatatatattacagtagccctttactttttttcttttctcaacacagctgaaggatataaacatttactttaataataatagctttctaaagcattaatatctcattgcagtgggaaaaggccaagaatcttagaagcagaatcttagagacttggaggggaattgttggaaaaaggtacctaaggtttataaatatgtcctcctaggaagttttgcctctttccacaaatttccatggggaaccttaagttataaatttgatttcttctcaggcatttgatagaatctgacccagtaattctaagtctacatatttgccctttggataacatcggtttcaaaaatagagagctctatatttgctttcttcatatatttagaacaacagttctctcaggaattttgattataaatagtttaaatagataaatgggaagctgtaatcagccagttattggttacctaacatattaggatatttatgacatatgtagaaatgtaagttttactgatttctggaaatatatagatttctatgtatgtcagggaacattagaaggagtgtagctcccatgtagttcagttctgacatctttacaatatctctcacagattgatttttatttatgaccatcttgaactattgatgagacattatgtacttcaaagtccattattttttggggcaattcatattgttagaaaatccttccctaaatccgtaaattgacatttggccaaatagaactaatgtcaatttcatgtgaatagctgtacttaagatttgtaacttaagccattctatagtgtagttaccagaccttttgtcatcccgtctccttccctgattctcttgtcattgtcccaattacaaatgtacttcttagaagtgaactcaatcatgtagcacagagtatgagcatgaccataatgtgagcattactttatatgctataattcaggcttgaattaacatgtaggcagccagatcaagcattggcttgttgaatttttgattaattagaggcatcaatctttcataatatgtactgttttagagttagtctacctaacacaggatattttgttgtttttatgttttacataggttttcctcaaatttcttaacaagagtttggacagtgatatctttatttccaaaatccatgtattatacatatgttaggatatttgtcaaatatacttttgatttcaaacattaaactgtccatatatctgagcaccaaaataagttgataaatatattttgcaagtacatttaagtctgagatctgaaacaaagtgtaagaagttatttatgggggaaaaatctaaatatcacacatatttagtcaatcaaattgtgcaaattattttcccaaatttgaactaaccataagttagtgggcagtaaagcgattatagggaaatcagttcatttctctgggcctcagtttctttatttatataatcatatgattggacacaaaatttatatattaatgaaatacttgcaacatatatttagtcatatatatggaattctaacaaaaatgatgtttctggttgatgagccattttgaagcatgagaatgaaaggaaagaagtgggttttattgacagcaacaaaaagattggcaagaagtcacagatatagcctgagagaaaggaacagacacactgtgtttcttccaaacacagaaacacacatcaatttaaaatacaagcattagaactaaagtccatagcttggactttgggtagaagcatatggctagaaagtcctttataatctcaaggagctctaagttttagaaaaacaattatcatacaagaaagattacatcatccatttagtaatgaaaagaagactagttcattacattatcgttcatgggatatttgaacactattaaaagataaaaagaaagcagagaatatactggaaagaaatacatccattaccattatgtttagttttcttatgagtttatgaggaaaatctttaaatattagtaaagaaaattgacaaaagacatgaagagaaataattcacatatcaagaaatacaaattctcttaaggaataaaaatggtattgatttaccaaaattttaacctcatttgtaatcaaataaatgtcaataacaaaagtaaaatatttaactgccaaaatattaacaagtatctctctcatttgtaagaatataaagtgatttttatctcttatttcatattattctgaatttttaatttttaaaaacaactgcattactttatagctgaaatcgacaccaaacataatttagctccaggcttcctgaaagccaggccaatgtgaagcactcagcagtatgtataatgtaggctgaggcacctgtaacaaaagacagattaagaagggaaaaacatgctaatttatttaatataaattttacacaacaagggaggctttggaaatgaaaacacaaggaaacaagtaaacttgtgtactttcatgcttaggtttgatgaagaagtggatagttgtgaattatgattggacaaagagagtatgatctaatgataataaactggtggaatttagcaaattctgttgattcagattctcctttgtgtctctgtgtctccagagtattctgcatagtattctttgacactgtatttaaaatctatatagcttggtgttgatggtagaatactttcaatttgtttgttaatcaaataatactttccagatatttcagatgcctttaatattttgacacacaaagggagaaatgtctgatgggggactttgtacgtgattttcttggagtgtagagacgattaattcaaagataaagcattgggaaaaagctggaaaatgggaaaattctccgatttggaaaaagctaaagaaaattagagaacatcatgacttgttcactctttgttcattttttgttctttataaattattctagtaagtttattaatcaatacattgactacttgactccaaaatattacggagtctgttgaaagtcattctgcaactcagggaaattatgtaactgccctcaaggttactagttcttagacttctatcatagatagcaagagaaatctaggaaatcattcacaaatcacatatcacatccagatggcttgaaattttgtagctctagtaataatagatttaattagtaataatagatttaataatagacagtgactataaacaagacaagagccatcataggtttttttaaatgaatccacagtaagttgaggagtgaaccttattacaatattgtactatgttattgtaacattgatctctttgttactaagttattgaatctttggagtttaagaaatatggcagattgaaagtcactgaacattccagaaatttggaagtctcaagacctcctcaaggatgtgattctgtaccagggacaattttaatatcagctttagaacttctggtccagaccccagctggcttaatagctgatgtacaccagagaacatgtattttgcaagtaactggttcccttgagtgtggcagtaactactcggtgtttcctgttgcctacataattgagttcatcctttttatcctgctatttaatgtactttgatatggtgtaacaaaaatacccttccaatcccccaaagaaagaaaatgacatgaaggaaaaagaaaaaaggaataaaatagagaagtaaagaaaagaaggaaaaaggtaggagagaggaagaaatggtaggggaagaaactgagggagtagagtaagagatttattttttgtgtgtgtttagctctggcagttattactggtgtgatatttggtgaaacattaaatatccctgggcttcagtttcctcagagtaaaactggaggattctatttgataaactttaacatagctttcaggtcttttgattttgatcccatgacaatgtttgaatctcctttcccgctctattttttcatgtgttctatacttcagccagatccctttacttaacagtctctaaatcattcttcatcctgtttagattaatcgttgcacagtcttctcaaactccttatcctgcggaaattctacttaatctttatgtttgagctcagtcgtcattccatagcctccttgatttctgatgtggacttaatctttatgtttgagctcaattgtcattccgtagcctccttgatttctgatgtggaaattagtttctcttccctatgagatgctatatagtactccttgctttatatctctcttatagctcttaacattctattatcaattattatttgtatttaatatctttgaagacaggggccgtatggttatcattcttatgcctttcatagctactagcagtcatttattatattaggcagtcaataaattggttgaataaaactagactaattatgtggaatttattttgagatatttgtttctgttgtcttatggaaaattaaccatacaaaagccaccattcatgaagacagcatggaatggtagaaaaaaagtaaaaggtaaaatctggatttgcaccccatttttaaatttaattattttgtgaacctgaacaaattactaacttttctgagagcccattatttatctctgagggggggggggggtgccaaatacctcccacttttgttttttaagaaaggtgaaataatatatttaatgtgactggccagaagatgtgcctgccaaagtcagtttccttttcatcactcttttagtgaaagttagagactttattttgtgctacttattttatattatttcactttcctatggagacactttggatatccaacgttaaggtatattcacacctattcgagggtaaaacagtattcactagtactaaaactaatagccaatactttctcccaataaatggctttcttttcattatggctttaaatatttgtattaacttaaaatcatgctatgtatatatttaatacctttctattaatcaattcacaaaacatggaggacatgtttcttatgaaagtgacacaaaggctaaaatagtattttcaataacatacatagaagcagagcatatgggtatctaagagaagcatacggatctccatatgttaaacactttcttcaagaaacatggctatagtattgataatcagcatagtatggttccttgatttaattaaagattagagtcctttatgtagcaatagtaaaaaccctaataacactttaagaataacttacccagtggttctcaagcttggctgcatatgaaaatcatgggggaactttaaaagataataatgcctgaggtttcacccaaatacatcgctgtttaattgctctgtgcttgcagtgtatgaaatttttgtgtttttttttcattttttaaaaagttctccagcatgtagccaggcttgagaaatattgctctcaaaataccaaataaggcactgctttcaagttcctccagaactgcttgacactatgacattttattttcctaaaaaggtggcaatgatacatacaaagatatgtttgctcaatgcttaagtcagtcttaggcatcaaaaattgaagtgccttcaagcaaaaactaaataatgcaaagtctgtttttattggagagcaagttagggggattctatctcaatgtgtttattgctttcttgtgttttaaaaaaaacccaacaacgacagtattacatttctaaagtacaccaaaatgggttaagggagtagtgaagcattgagaatactatctgaatgttgtccatagaaatattccaccatttaatagtctcagtctctacaagtaatcaaaattcaaaccatgtgattaatggcaatacaataaaatggcagttttattttttcagtaactttgcatctttcagttactataaaaatgcagttttctgtagcatgatagttctaaaaaaaatcctttcttctaaggatattgcttgtgaaaatgatgtactgactctctacatattaaagttttcaaaatggaattccctccctacatttcagtgatctccaatagataatgttattattcaactgtatcctgctattaagatcagaataagaaatagcagcttcagatttcccatcctttttttttgtttctgttccgttcccagtagtttctttttttcattcatcttcagatttatccatccctggcaatttcaagctagaggaaacaaattaagaaaaaaattaattgactttatttgctttaatgctgccagcctatattatctgctttcttaaatgagtttggaattgccagctttgagggtattacactacattttgggttgctgccagcatatcctgaacaaatatatttatatcaaagctaagctgcttaaatattcatgttatgctcttattacggtttagagaaatgtgaaaccatttaagatttgcagacgtgttacatggccaaaaaatgtgcttgaactgtcagaaatatactttaaattgatagcgctaacctagtttaataaggaaaagtttccaccgtcttattagtagtgatacatttaaattcttaacttttttgtgatttttcagtcactagggcaatatgaatgtaaccttttcttgaaatgtcaattggaaatgaccccaggatgtaacgttatgaagtatgtagactatcagatttcatgtgctttatgtctgtaccgtgattttgtaagcacccttttatcacatatacaatatattttgttatattatttttaacgcctacttcattggcatgtttcttcaaaatgtagaattgctaaattctatataaaacatgctcttaatttccagtgacagactttgaggattcccaattgtttgaacaaagcataagatataaaaaagggaataacccagaaaagcccaacaccaataaccgttacacgaaacaaaggaagtaaagaaggagaagctgaattcacaccctttgaagaagggggacaattgagttattcctaccgtagactgaaggacgaaggccgattttcctgttgcctcctctctttcctgttttctttttcttcctccttagttttctttgattggtatcatcatcaactgaccatttggagcatctgattttgtataaaacaagtttgttctttttactttccgtcaagacaaataaactattcagaatgtttaaattccagaattccaaaagctctttgtttataatcatagattctagtgatactagaatgatctatgatttatggcatggagcattttcaaagcagtctgagcaattcaatataaatttatgagataccagtgagaattgccactgtttcactcctgcccctcccatgagtatagacaaacatgctagaccttcccgtcaggggaagaacccattaagccagttcagcggtctcaagtcacaggtgctgttttatgcccttcagttaaatgctcagatttcaacataggagattaactggttatagcaataggtccagccatgagactgcttgtcctatactgagattttttttatttctaaaactaaacctttggtcagtccaaaccattagcttttactgaattctgctctatatgttgtagtgtttgagaaaagttccaatagctttctctgtgggaaaccataaagttgttttttgcttcagtgaggcataaatcttactggggagagcctgcgaggattacatgagcattggtttcagtgctctgctaagagaaggaacttaagcttattggtataagcctggtagattttcaagattttcagacattttccatgaacatttacaaaattcacatacccaagtattcacaaattttgtatgcagcaatgtattacctttaacagtgttgtttctttaatgttttaaaaaacataatcctgaattttaccagcagtttgaaataatttttaagactcaataatttataaaatcttctacattttacctactggatttggttataacaggacgaaaactattattttggggagtctgtatgtataagggtagtgggtcatggggattagtgggcatggcaggctgaggcagggaaaggaaactgactttctggctaagtggactaatttgtttttgctacagcattttgtgcatataaaagagaagaaattaaaagtgggtaatgtgttttgaaatgttggttctatttttttcttatgagtttagcaatatgttgtatattgagtctcctctctccaagcaaaatgccataattcaaaacaatgcttcttaagtgactagagtgggaagagggaaaaattcttctaaggatattggggttgggagtgggatgataacctttttaaacttattttctagtttcctcaattctttgctgaattgttcctatcaccctgcttctagaatgccatggagcaggctacattattaatagtgttataggagccatgccttaaaatcattagacctaggttagaaatatacttcccaagttaatttaaaaaaaaaagtgactatttcggggagtccttataaattgagtgtccagtaatttttctgtatttttatttagtggtacatttacttgggtaatataggtagataacggtttgatttgggaagcatcatatgaacatgacataaaaccagattaatgttgagtctctatttaaatatgttacagatttagtaatcaggtttagtaggagagaaaataacggtatttatgactcaatgagataacttgttttatggctgaatgggatctgattgtactatagtatctccgatggtagatgtcatcagaaccagaattacatttccataagcacaagttctgcttattatataattgaattaaacagctagtagtttttccagaattgagaggtaaaaactcaaaaagctaacatggcatgtttgattcatgaacttgatctggaacacaaaaagcttctaataatgggcaggtcttgggggtcctggttacctttaagttgttggacattagcaggaattgggacagatttttttttttttttaaaaaaagagaaggatgctgaaaggcatatgtgcatgtaagaaaactctaatggaaaacttcactaacattataattttggtgacatatggccttgaaataataagaaaaaatattatgaagtcctaggacccagaaattaggtctgaaatgcttaagtgaaatgcagaattaggtactcacacattttcaatttgaggaggaatattttccttgggatgatttacattcaatgttgcttggctgaatattgtttatctaggaagctacttggaggtagggagtgaggagaggagggccatggtgtccactagtgagagttgtcctgaaaatcaaattctgaaaaggagagtagtaatttagtaaaacaaccagtaattatctgaaataaacattttctatatccattgtacctacaaaataatacatggcacataagtaaatgctcaaaaagttttgttgaaagaattaaaataacattattcaactgaacttcaaatgtgtatttggtatatgtgcaggtatgcttttgtgtgtgaatacaagcttaatttggaaaaaaaaaaccatagagtttaaaaaagaatgtaagctatgttctttagttcctattttatacatcttggattattgcattaagacttttcatttgtagctgtgtgcatttttatctaaatattaagagttttaaatattttcagacttattttagttaggcaagaaaaagtatgattttcctagatagagtcatatcaagacaagcaatactagaggacaaatctagagtacagataattatttctggattctttgggaggctgcctaaacagagtgaagttagttgctcaacttaagtatgccatagcaaaaagtcttattttgtttagttgaatcattggattgattcctaaacaattctaaaaggaacaccatggccttttgcatatatgcttatgcttaggcaaagctatgactataagtaaaaatgacatgcttgttaagctgcagatatgtaactgtcagtaatcaagccattgcataggaatttatgaacaaattcagtgtgtctgtttttccctgtgtacataattttaatatcaacatcaatattataaactaggtaattgtaagagggtatggtaaacttggtgaggaataagcatatgttgataaatttgcacctctcttgaggtcacttattgattacaaagcttgttatctttcatgtgcatttagtggtgtaattgcttttgaaaattatgacaggatgataccaaatgcaaattaatagtatggcacttgacatacctgagatttcagcaattttttttcacatccgtatgtaatctttattggccaagatagtctatccacattttgttctgatggaatatttaatttttttcatggctaaacctgctttaattatcattttgactttttcacttctaaaaataaatgttcatttttgctctctaaatataatctatagcctattgaaattatacttatttgctaaaagctgtagtgggtcctttcatcttcttttattgaatttaggattttaactacattaaaatttacagttttggtgcttcacagtttacttctttgaattttctttcaaacaaggttgacctggaattagaaattacaagtagccatgcttgattaaacagtcactccctagatgccacagaatcctgtggctactactctgaaagcaaaggtaaggatcattcaatgtgtcaggaaaatattttacagtagatttaaaaccattaaatctttccataataattttatttaaaatgataaaatattatatttagacttggaaagtaaattactttaaaaagcagaaagcaaaagcacttaagccatcatttttaaagacttgttgaaaaataagtattctcatgaaaacacactgtgcatatttgaaaaatattatgagatagatttgtgttctgtaagtagtagatagtttattattgctatgatgctggattaaaatatttttgttgcatattatatatattttttccttctgagaagggatcttttttttttaaaggacatttccagaaaaatcctcacattaaaaaagtattatccatattattattttaagaattttatgcaactgacttatttcatcacaatatgtttgtgaaaagccatgaaccaatctctttttgaccagtttgttagatatttctttgatgggaatacacattcttttaatttagtgctccaaatatttttcaaattttggtatacagaaattaatcagattcccatggcctgcttagataaactgaaggagtctggctgctggcccagggctggggctgtcccagcctcctgcagtgcagcctccaatggtgcactgattgagaggctttgatgtaactgacattcactgactcagtctgtgttctaggcactgcagatacaaaactccatctggggtcaggatcttttccatattatctgcctggcacaaaagagtgctggcaaacccagtccacctctgctagacaatcgtatctggtactaggacggcagcctcttcagcaagaagggggtacattggccaattcctatgaattgggctcctcgtgaagaactcatttatccacatggagtaggtattaccatgtcaaatttttctcaaaacataggacctctcatttcatgaggccaaagatttcttgattttaaactgacttttaatccatgagaatatggcttgtattaatttaaaaagtaaaagtgttcaaactgtgattgaatcttttttgtgattatgaccgcaaacttctgtgacttcaatattttcagaaaccacaaaaatttgatgcatccaaatttttgttttgaaaaaagttggagtaataatgggggaaaaattctctgctgctttctgcttctgtgttattcaggcgctaaagctaaggtccccagaacaccatttttttttttaatgtggttttcttgaccagaagcagaaagtgtcagctcacatgtaatgaaaactatccatgcatgatttctagcctaatttggcagattccaaaggtcctttgaaaggcagctgacatttctgatgattacctaaattgaattgaacctttgaatgttgtcattttaaaacatgttagactcagtccaaagacaaaaaagagtaatagccatatattacaatttctgatgtgaagaaaccatttagtcttccatttataaggcacaaatatatttgccatgcatcttaaggaaatccatcataatatactcttactgagattgctttcccagtctttgttagcatattcacagtatagttctagtcatagacagaagctacgcatttttttagaaggtacagcttacttggaaatggtagtggtgattcttcctagaggttgaccttaactatgcaaacaaactaacaaataaatgaacaaagaaaaaaaaccctcaactttataggaagttctaggttaacattttttcaacaatattggaccattcatggtggctaacgaatgagtaccaaaatataaaggctcactctagagtgtcctcatgcatacctcattttattgtactctgctctggaccatagaaattacacatctcttgctttttttttttttagacagagttcgactcttgttgcccaggctggagtgcaatggcactctgcctcccgggttcaagcgattctcctgcctcagcttctcaagtagctgggattacaggcgcccaccaccacgcccagctaattttttgtatttgcagtagagacagggtttcaccactttggtcaggctggtctcgaacttccaatcttaggtggtctgcccacctcggcctctcgatgtgctgggattataggcatgagccaccgtgcccggccgcacatctgttgctcttatccacaacttccaaattctgcctctgcttctcctgttactcccttttttctctccccagtgtctagttgtgccacgacagtgtcaaagccacagttgagtatcacctcccttgtgaaaccttttctggcttttccccagcttttcactcctcaaatctctcaagcagtgtgtcattgtattttctctggggccatttaggtctgtttacacaaggacaaatgttcaaaggagaaaaagtatccctctagagtaacttttataaatctaagagtcagtgtaccacattctgataaaattatatagatactaggtgttatttctgaattgggaagtttgtttcttcttaaatagatgagtagaccttaaaataaacttgtattggtaatgtaacacaagttgaaaatctaatttgtggcaacatgcattcttatcattaacaggaactgttgcaaattggctagaatagtcctttgcagtttggattacttttctattatagtaagagtgatacagcacattaacactttggcttattttgaatagatagatatttgcaacctcatcctggagaaatttgcattcaatctttgaacagtagggggttatctccatatagagaatcttcaattttcactatgcatttccttaattttctctggaaggacacctgcaagaattaaacatgggctctctaacatcaaattttgtgtccttagaagcctgagggaaagcagaggacattctcaatcagtcattttttttctttgatgaaaagtcatctgtcttttaaattttggtttaataacaaattgactccttataatgaaatttatgtaggtggtcattttgtgatgaaagttagaggtaaaatataagtattttaacagcatacttttagtatcaatgtgtctgttattatcgtagacatcaccaattagaaaggaagataacaggatgatacactgtggagataaagtgataattcttttaatattctttaattaaaacagaagagtcaactaatttcctagttgctaaatactggagatgaaaccatgtggacatttacaaatgttgcttctgggtgcacatgttagttttcttttgctgatataacaattactgcaacttaatggtttaaaacaacacaaatttatcttgctgttctgtaggtcagaagttgggtacaggtctcacaggggtaaaattaaggtataatcaggactgcattcctttgagagactcttggggagataatgttttctgcttattctagttgttagtggcattctgttcatcgtggttgtagtattgatatcctagttacttgttgtttgcagctaaaggttgttccaaggttctagatgccaccacattccttaccttatggcccacttcctctatcttcaaaaccaatagtggccagtctagttctcgcattgcatttctctgattcagccaggaaaagttcttcactcttaaggattcatttgattagatggaactgtccagataatccatgatggtttccacattttcaggcttaactcttgatcacatctgcaatattccttttattatgtaaggtaacatattcacaggttccagggattaagacgtgaacatatttgggaggccatttttctgcctaccccaggctgaaaaaactgagtttaacataagctctccattaccagcactcattagggattttcaggaaaatatcagttgggttaaattgggataaagaaaagaactgagaaaaactttgttttatacgtcctaaagcccaattcttgccacttctaatagttattctacaaaaccagcatgttggagtgttatattccctgacattcctagctattcttaagacatacgaagctgagaattgattcacaaggctgcctggttttcaatctcagttctgatttacctagtttcggatactttaatgtgatcttggggaatttatgtaacctatctgtgcttaattttgctcaagtgaaatagagacactaatatacctctttcagggtgttaaatgttaatatgttaatgtgttgtttggttagaattattagggcctaacactgtataagagttatatatgattatggtagaactatacattgctactgactgcgccggtgtccctcaatacatatttttctgatatagcaatgtgctccatctgaacatagacccaagcagtttttaaaaattgatgactgaccatggggagtgttataagaaatggttattttaaagttgacagcatgttttctgtttctcaggagaaggttgaattcacttaatagggcagaatgtccctttggttttggagaaaatgtcactgagctttttctttcagcaaaaatagagtcaagatactactctaaaaaagaccaggaagatcttgggggacacaatttctctgttttatagtataaaatgttatttttcttaaaaaaattataggtacaaggacatcttaaaaattagatttcctattagtatcattacacacactgatctgcttttatctgtgctcctgggagttaaagtcaggcctgtgcctgtgtttgtagcaaatttttagagaatgtagcccaagtaaactgcgaatgaagaaatgagagatggtgtgcagaaaagcagggctgctgtccaagggaactggtaacattcagccctgattgctcatcccacatgagataaacagataaacatcccacatggaatcctgaaactgggtcgagggtggggtttagtgaaaggagggaatggatttagatgactgctgagtaggtctgctaggaaagaatacttccatcaaattggaacatctgagttatgctgagaaaaatctttcttatgtaaggaagagatataatgttgaagattcttgtgtttaaaaagcctatatatatttttattgatgcattaaaacaccataaatcaatggttagccatcttaaagatttcagacacttatctttttgacaaatcatctatcaaagtgttttgcttgaaatttgaattaagtggagcaatatgacaaattattttaaacaatattctgctaacattatataatagcatagagacattttacaggcagtgttttagagacagtatccatagtctgcaagacacacaaaaagtatgagttaaaaaaagaaactgtagtctatacctaaatatctttgaataatatttgtttagcacaatattacttaataaatgccttatgattgcaatggttgttattatttctttagagaaatctatggtgaaaaaagtaattttggttttctaatcaagagagttattgactgtcttgatgctagacataatggttggaatgaaaggaactgaaataggaagaatataaattgtatttttattccaatgtgtattttattaacacattgcttgtctttacatcaaactagataactcagttggattgtggcaacatactgcctggtcttttggggaagttcttaaaatcaattttaataaaacgatttaaaatgccataattctttctcagtaaaccactttatgtacacctgtttcctggcagacacctccaagacgttgcctctatccaaggatgactccagggctctaatatctatcacacaggtagaatcagatcattgacacaaggcaaagagactccaacatgcatggaaagtagtatttcccaagatcaattttgaggagcactagtgaacatcgtattggtaattaaaaaaaaaaaaatttcactttgtgtgatggttaatactgagtgtcaactttattggattaaaggatgcaaagtattgttcctgggtatgtctgcgagggtggattataatatattatagatttttccttactgcaagaattccctggtccttcaatgcatagtgtgactagtaaatctccaaaagaaaaaatatataagatacataacctttcctcgaattacttgattacaataccctctatttttgctgcatattgtttttattacttgaaactcacttacatgaagtgtgtatgaataagaataaccaaagagcacatgtggaacagagcagcagcacaggtttcgaagctagcaatcaaggcaactagcaaaacgcagaatatctggaagattagatatcctacacaagctcagcctaaggagagggtccatggctttggcaatgatagcattcagttagtgatgtacagcagaggtgcatgaagcaggttgaagaaagtatgattaataaaactactttctacttcatattttaggcattttttatagtccctcctgagcaggagccaattgcagtggtggaggcataaactttgcctgtcattataagtcactgcattgtgcttcattataatttttaccttttctttttctttcttttttttttttttttttttttttttttttgagacagagtctcactctgtcgccaggctggagtgcagtggcaccatctcggctcgctgcaagctccgcctctcgggttcacgccattctcccgcctcagcctcccgaatagctgggactacaggcactcgccaccatgcctggctaattttgtttttgtatttttagtagagacagggtttcaccgtgttagccaggatggcctcaatctcctgacctcgtgatctgcccgcctcagcctcccaaagtgctgggaatacaggcgtgagccaccgtgcccggccccaaacattcttataaaaaagactttgtggtggatttttcgaggaagaacagcataggccttttaaagggcttatacctggcagagactaagtatatgggggaattgaattagattaatattctttctaagtcaatcttgataacaggactcctgagctcttccttcactattttatcatctgcaccactccctttaatagttccaaaaaatgcaatatggctaacaggataatatctgaaagcgaaggatcttgactttccttggataattttttttgcctgctgactcttaatttttatttatttttaatttatacacataacgggtacaagtatagttgtattacatgaatatatcgtgtaggagtgaagtctgagcttttagtctaaccatcacccaaataatatacattgtacccattaagtaatttctcatctcttccccctcaaaccttcccatccttccaagtctccaatttctattattccacacttgatgtccatgtatatatatcatttagctcccagttacaagtgagaatgtggtatttcaccttctgtttctgagttttttcactggagataatggcctccagtcccatccatgttgctgcaaaaaacatgttttcatttttttaaatggctgaatagtattctgttgtatgtatgttccactttcttaatccaatcacccatgatagacatttaggttaattccatatctttgttattgtggagaacttattatagaagtatgtttttagacctcagatttagagagtctcacccagtagatctgcggtgaaatccagggctctccattcttgttgagctgcctagatgatctgaagttaaaaggcccaggtaccacactgacaagactctcctaaaacctttgcagttgcaaaaatattactcttctagctgagacacatcaagcgggacaccgatgttatttatttaaatcaaggcaatccacatataatgagattccagtcaggtcaagtacttagcagcatttctgagaaagaaaattatctttaatttggagaataagattaagttaattcaagtcttatgggggttgagtgctgttttgactagagggaggcaatgtctaaaagcatgaggtaagattgtcttcccacatgagctgaaaaacaagaacaagaacaacaatcaatcaaagacagttttatttaagtcttggcctccagtcaatgttgttgtcattgacactctaggctgatatggttcacacttattcagttgtttccaaaatatttccttctgtcattgccagtgttgtggcaacgtcaaagtgtttctttctgggtcatggtctcttcaccttgaaactccttaaacttcattcttccactgaaactaaaattatgtgttaatttaattttattcacctccaagaagcacagttatagtttatgaatgcatgagatttgatataatattcattaatataattctattttattttttattatatataaataaaaagctaatatgtaatttgtgacattttcataacttgattaatattgttatattactattgtcaggaacatttcaatgagctgaacagccttacgaatgaccaacactcaataggagattccttgtagcatatatttacttcacaattagtagtcagttgctatgtaaataaaactatttttgcattagtgaaaacatatttgttagctacttcgaaatattaacaacaaagctggcactctttaaaaggctgcttttttctaaaaaaaaaaaaaagctttttctgtgttcacatttgtcatgtagcatatatcgtctttcattcattcttttttcaggatataaataactttctccagatgtcaacctttatggagaggaaaagaggcatcagcaatttcaggcaaccacaaaagctctgatgtattttgaaggagtttgtgtgctttcaagagttttagcaggaaactcctgcagatgatgaaggttgaaatctagaaatgtttgttgttgtctatataaagtatggaattataaacatttactttgtgactgatgagacttaaaggatggatgaattttaaaggtgttcatttattgcttttaaataacttgtaaaaataattttctttcttctgagatttgatctaagcacccgctaatatacatgatagtagctgtcttagatgacacaagaaaatgaaatgtctattcattcatttttggtttggccaatctcataccacaagacatattttatacccttttccagcaacagaagtatgtttttattgtataatttaaagccattttctttgtaaaattttaaaccagttggaaatttgttgaaattgaataatttctggaccagagaaagcactatgaatggggactacatataaataatttaaaagtgaataagagaaaaagccaagaattcatttgcatttttgaataaagccaaactttcatttaattatacagtagtaggctttaaaacatatatttttagtcaagtctgtaaaactgccagatgctaaagtaacatagataagccaattaggaatagtttcattaatataatcagagattttataaaagatacaaagctttcaaggtttggatctgagacaaagtttccagagcctctatgtagcctggtaaaaatgcacaatgattcaaatgcaagcttaaggtaagctaaagtctttcattcttatttttaatagcaaacccagagctcgaccttccattattcaatattgctgttactgctatagtgggaagaaaagagggcaaaaatttgtgttagaacacttacagggaaatattttttacactccgagtgattatattttaagatgtctatctactctattcccaccttcttgtattattcaagttcagcaatacagtgaaacatctacatacaaacttatgctacacttcagttcacatgatgaatacacatatagaacctctataatgaaaagcaatctagattttatttcatttataaatacccagtgtgggctgctttcatagtccttccttattttttttttttttttgaggtttcattttttgcatgcccacgatatatatttttttttaatctggcaaggatgtaggagtgtctctcagggcacgagaagagagccacttcaagtctgccagcactctacccaacagacctatccatcattaaggagatcccagaaagtaggagctatggaactgcctcaggcagagctaatgtgagatagaggaagaaatcacatccagccagatgtcttttgccaagggactgcccagtgggaaggacccacagagcctcttaggaacttgcatgtgtcccacaccagctacacagaggggatcaggtcccaggtagtggtagccaaaaaatcattaaccacccacagaaagaactataacagcaatgaggtaagtggagagggctcatcagttcagttttacttttcattctttcactaatgcttatcttcacatgaaaacattcagttttttaaagagtttatactaggggactagagcagatagaaatctaagtttcaattccagttagctggcatgtctttttatagtatgttttcactttggcatggaccaaaagctttagcagttatccataggaattacaatggaaattccaggcagattttagttaggttaaaaaaaaaaagttgaaaatgttgttctaggccaaggacttgtaaaatgtggatggttgcctcttgtagtttttagtttgcttttgaagtgcttttgaaatagttacaagaaccattcctctttgaaacgggtacgatataggtcacattttcctgtacaactggccttaatggatcctagtataacttaacaagatataggagtttttcttaagccatgataatccagtaaaccacagaatgaagtaatagtttacttaaaatctaatcaagagagaaaacttcaatatatgttataaggttcctcatgataataacaccatgtcttcctatgtactccttccttctacctgccctctcccacttgtcgtaccaacacatatcacttatattcattttgttggacaacagtgaatgcagacccaaaggttgaaaaatgagtatcccagaatactgcttcagttctagtgaagacattgggacagcatccaccagaaatattaaaaaagagtttgggtggtcatctttcagaaaggttgaagggaagattctcagcctgaatgaggagttcactatgtattctttaatatccaccaactagaaaattgtgtggttacaaacccacaatagagaaaacaaggtggtttgttcaaaaatatcagagctaatatttttagagtaactgatctggatcaatgatctaaactattttcacacgtaagatactatttattgtaaaattaaaacatgcaaatgaaaaaaaggaaaaactgttactggcatgcaagagaagacagctacctttcccacactccttaatacaagacccatgctagtgaaaggaaattatttaaaatagacaatatgatttcttttcttctttcttctagaaaatgttaacccactgggcccgtttaaattaatatactgtccaaatagaatttctgttattcctgatgatgaaatgatatcattgatatctaatatttacttgttttctaatgtttaaaatcaatgagttaaacatttgtaaaggcagtttaatttacctgtataaatttagtacatggtgggatataaaactctaactggcctcattcttctccagtcaatgttttaacccttgctgtattgagtattcccttttcttcgtttaataatatcctgaacagattctataactttacagtcactttaattcctaaaagccatccagtttaatatctcacttctattttatcctgtgccatccctgaattgcaggcctgagggaagtggggcgtgatttcatgaagtgatacagatgttggggatttaatcttcatctaaatagtcctctttctttctcttcaagacttgggtcctctctgttgtggaaaagcaagaggtgagggcaggagccctctccacttatgtcatagcttttttagttctttctgttgttggtcaatgattttttggcttctactacctgggagctgattccctctatgtatctggtgtggggcacatacaagttcttaagtggctctgtggggccttcctattggacagtcccttgacaaaagacaactggctggatgtgaaacttccttcaacctttctgaaagatgaccacccaaactcttttcaaatatttccagtgaattttgtcccagtggcttcaccggaactgaagcagtactctggactacccacgttagcagctccacaacccctagtttctgggatctccttaatggtggatagcttttggtagagttctagctgacttgagttggctttctttcactttccctgagagacactcttatattcttgccatggcaattggtgagagggcaagcttctttattgtggcctctgttgcttcagtatgacatctctttccaatttctttgctcagttatgtagtgggagaatcagtaagtttgttgccaaagcagatctccaaatgagaagcgaaatgcctgtctcctcttctgagcgaatccttcaatgtgataatttttctttcttttttcagaagccttctcactaggctgattctgaaaactctctctcttccttcctagctctctccttttatatcctggggatgggggaagagtagggtgatggttcaagccctgcaggaggatcattatactcagactttgtgagtctttgtcctcagtctgtaagctgccaccaatttcttagaaacaggaaatgccctattcactaccctctgacacattgatattataatcaatgctagaaatcatcaatgcaagaaaaatgtagagaaaacaatccatcaaatttttagctaacttttcacaacgaaatagcaaatattctacatggaatgtatacatttgaaaacatttagtggactgcatgatctatagtacaaccatgatgttataaataccagtatgcatttgaggacaagtattaagttgaatataataactcaaatataaatattcttaccttttgatattctttttgtgtcattatgcaaaataataactatggttttatcagttccacattttcacttttttctcttaatgtgtaactaacattttttatttgcatacacatcagaaagagtcctggacttgacatcagaaaatccacattcaaatctaggctcttttcagtgactgcactaataggtgactttggacaattcctttatattctctgaggtttatttagtagccctatctataacgctttggtagattaaacgatctctcatattatacctaatactaatactaatcctaaattttaagaaaatgctattgggtcaataatttagtgtgtttgatcaatgttcgtcacgtgccacctaatttcactatgcccccaatagcctattacttcactatgattggtgtctataactttcatgcagctctgttaaaggagacctttacatgtttttgagttaattattttgactactggaatctaattatttacaggaacaatgataaacatatcttacagctaaacaccagagccatgaaaatgactttaaacatttttataaatactagttaacatgaaactgagatgctttgatttctgttacaatatttatctctttaaaattaaggttgacattgatgtttcactttcatagttatcatttgagaagtccttaaaatatgatacatttatttaaaatctttagtttcttcatctattaactggatgacttaaaaatcattaaacctttaagcatgtatatgttaacaaagcataaacatgtctgtaagttggcaataatttgagagaaatcttcccctttagtatgattctttcattaatagctcaagtttagtttattatgtatatagatgaacagaaaagaggtcaatatattaagcattcaagatgagctatatgttcaataaaagtcatggtgtccataaatttttttcttcattaaagaatgatttttttttgccataccacatttgaaatcttgtatttctcaaaagaacttgggtgtttcatttgtattgctaaacatttttatggttatttaacctggattattcagttatagcatttatttgccatagagcaataatttatctaaaaaacgtgtcattacagtttatcttttatttttttcagatggcatgcttgtgattgaaggtatctgcattttttgtaaagcttctcttttgggatagctttctttttggaaatttccatgccaaaaatattgcattttcaaagatgtcctttcctttatgccttattttttgtttgaatttgttttccctgtagagatataataccgtttgggaaaaggtgctacagattaccttttgttctggtatttttcaaaatatccagagttatttattttgacctcagtatttaatgtggagtcctaagagacacatcatagatttcccatactgaatatatgcatttaaaataaatatattcaaaacatatttacagaaatacaaatgtactgtgtggttgtcttttttctttaaaatcaggaaagcctcccctcccatggcttgaaagatattacatacagcctacatactattcaaaattcatgaagtttgtgaagaccaaagtttatttttaagtgtgtgaataaacaatttccatttcaggttctttttgagtaggcacaatacataattacaattagctgatatgcagccattccttcttgtgatttaaaatcattatgcagtttgttacactgtccgctttcaaagttctttgattgctaattttaaagactgatactcatttcagaataagaaatggtatatattcagaatttggaaagcaacaaattgtatttattttcaatttttttgatttaatagaaacttcagaataatatgaagaggaaaggaaaagaggtttgaaaactaaggtcgagactatttctatatgttcatgtcttgtgtctacttggcccatttgaaggaaattctctcatttctgtatgatttcttatgttgtaagaaataatatatatattattacacctctaatagaggttcaggcagaaaaacaatgaatcctaggttttccttccttccttccttccttccttccttccttctttccttccttctttcctttcttccttccctccctcgctccttccttccttccttgtttatttttttaaagctccttgttttcaatttagaatatggtacactactttaaaaatgtggattaaatgatttattttagctttgaggtagtatttactcattgcttcttttaagaattttagtaatttttagatttttagaacaaatggtacccgagtttttcttatatgtttccctatttaccacatggattttgtaaacaattagagtgtcattctttattattgaacaatataaataatagtcatgtaaaaaattctgttggacttaatttaccaagctagtcttatatgctttctttggtttgacactgtgtattaggaaacacatattttttccagcaactaaaaataaattttaaattgaactaactattccaatgactaattcttatatattatttttcccacttctgagatagcttgtactttttgttccaggaccaaataataactgaatcagttggttttgctgccagttatgggactgtttttgcccatattttcaacgtactgggtgcccttaggtttgtaacacattttatttatctgctctgtcataaagtaaaacacattcatagctttgaggagtagatgtggtgatcgatcactaaatagaaggcacaaaaaatgaacagcagatgttgcttttttgtattttgtgctattttacacattgcaaattaaactcatgtaaaattttgtgggaatattggacagtgcatactctcactgttatatgatttttaaaaaacctgctgcctagttttttctaactcatcagccacatgtctcattacctagttctttttaagcctcctctcccatacactgacctaccaatgaatcccatattaatgctctcagaggaggtggttgtaaactgatttggagtgaagagacagaaaagcagtagcaaaactctcttctgttaggtcaatgtcttcacccaccccaaagaactttgataatttagtgctaaatcaggtgttactattattctatcatttaaaataattgaactgactgagtaaattataataaaatattattgagatgtatatatttaaaatttctttacagttagaaatgtcatattcatttggaactgaagattaaaacagccagggcattatttcttaaactgcacagagtatttaattgtagcttctttgaggaggatcaagatggccaaaatatagggaaaagctttaacacatatttcttacttagtattgtgttgttcattttaattataataaatgttctgaatatttatctgaccaattaaaatatttgacttatgagaagttcaggcttgaatattatactttgcatttttgctttagctttttctagtaatatacaataaaggcactattcctgtaaaatcttatttctatgataatcataatccaaggcccttatcctttatttagtattcatactaagcttatcactgttatatctaagtcagtgaaatgagattccacaggagaaaaatgggagagtggcaggcttttttttgttttttactttgttagctacgcaagtcatagcgtacaaattagatattagatatcttttaaaagtaatgtaattaatttgattacataccatagttcctttttaaaagaagctcacataataatactgttaatcacaatatctagaattatacacttgtagtaaaatttaaaatgtaaatctttacatcagtgattttttttcactcatgcaactgacagatttttcttcttcccatagtcccatccaaccaaacacttgagtgcttcattacatggatcatttgtgcttctgagataaccagaaggtgtaactcttgtgttgatcaattataggagacttcccttgaggccttagaaagagttcttgaaagaaattcttatctgctttccctgactctctctgatgactaataacatatttaaaggctaatatgtgttagaaactgacacacgtttagagaaggtgtattgtgccctagagatctgacacttttcttcactgactgaattctatcatcctcttgtgtctagtaaatttaaaaaagtcaacttggtgagcaagcacatcactgaatttatttttgatattgcaaatattgtatttgtcagagtccaccgaaatgatggataaaaatatatattaacattgtacatgaaatgtattggagaggatgtagtttaaaaggaattaggctaataaaaagttgtttagtacactctaattttcagccagtttaaaagttggatcaaatttaagaaatgtatcaattataaagagctattttttcactttaatgtctttctctttattgaaaacttgtttctttttttttgtgtgtgtctgttttgtttctgtatctgctagacttcagtgttgcactttttgaagagctcagtgtaaactgcaactcttttttcataatcaaaaggaagaaaaataagttattcaataatcttatgtttatatatagtactattgggtagcatacgaaatgtcttaatgacataaagtttatacagcctcagaatttaaatctaaaaaaggcgatatttgtgtggctgagtggaatgtaagaagatatatcactgatacctactaaaacatacaaaaattttataggttgtacagctcaacagtagaagagtagttgaatattagaggagcattataaaggataaatacttttagatgctaggtaaatatatacaaaagagccaaggtaataccccatttgatatgcttaatctgggaaaattttgtggaaggacaaaatggatatgagtatgtcaaaaactgaaacatttcaaattttgttttgttttagtgaggcattgacaaattttaattaagaatgttgtcccatctttttcttttatttatcaaatgcacaactaatctcaggaataccatatgatgaatttagtatataactgtaaatggattcagctactgtgtgttctctagtacaatcagattgaactatttggagaacaagcagttatctatgtggctgtattgtcttcacacatcttccctatgaaatgtttcactactagagaaatatttctttctccaccaatctattatttttacttttatttttattcatttttggaggaaaagatgtgaaaaatgcacatattctcaagataagaagccagctctttaaggagagttcattggtgggaacttttcaaacggacagctagctgagaacaagttgatagacagtgtattggagtaattaaagcaaaaggctttggagtttatgagcatcataagtgtatgattttaggtttttttcccatttataaaatgtgaataattatagtacctactgtataggattgttgggaaaaactcattaaaaagcttggcacgtagaaagatttcactgaattttacctatatgataattatatttttgtagggtaaagaaggaaagaaaatgtttaacttttgaggttcattttgatggcctattaaaaatcatatgttctgcctcactggttaacccactgagatgaccacatgttaggcatgtactattccatgcacactatgttcaaccaagtgatgtcaagctaagcactatgaattaatttcttgcaatagttcaggaagagaaagcagtgggatcttgggttagcatccaaggcgcagtagcatggccaacctaaaagaacctatactattaaaatattcgagtcttaagcaatggtttaccataccagagtagcaaactatggttaatttaaatattaattgtagagattttaaagttttgtgcatttttaaactctctatcgcctaaagtaccctaagattctacctagtttatgtttttatatatttaagaaactgtataaaataaagtaaaactagagggtctgtgaaattgtatttctttaagtgggttgcatacagtccttaagttttaaaagatacctcaagacatggaacatacacttacaggggcagttttgggtagtatgcccagaacaatgtttaagtatcactcatacctgggctctgagttaaggaaaaggggttagtatgttggtgttagggagaagagcagcaagacatcatcagaacggtaagggatattgacaggtcaatgttttatttttcagaatttgcccacaatggcccttcttgagagcttagcccaccaaacaatttgtcaaattatgtttcttatccattttgatctcccttcctctgtagctgttctttgattgggtggctacgatgaaacatgggagtcagggcagaattcaagcaagttggctacttttcagtccattctgttggcaagatgtggatcttaaccatatggtgaggcagggtacttacgttcattctagaggtttattcatatctgcctgctgcaggaaattagcactgttcacacttgtttagccttaataaaaatctttttagctgaagcacagggataaggtcaccatctgccacatagaaatgccaatatcaaatgagcaacagaagggaggtatgtttcattcttagagacttttagaaagaacttcaaatagattaagcactaattgattcccctctttactagtttagactgtaatttacatttatattgtgaattgcatcataatagcagtgaaatctgtcagtatgtcctgcttgccattcttagaaatagcactagaggtagcttttaaaaatatgaatgcctttaagctgaaacatatactgtctgtgccagacactacatgaaacttaagtttagatggctcagtgagtatctttgagtttttatgaaaaggctgatagattatggactaccaattacctttaccaaaaagtacatttttgaataagagtatataatgttaatggaatttatgattaattaatttattaacaattaggaaaagttaatgaatacaatgtttaatcctgaattttagcatgattaggtttttttgagtccttgaaaattattaggtacttcaaaaatctggttctaccaacagaattttagtttcgaaaagacaaacaaaatcttaaaataacactttattgttagatcttcgggtcctgtgtattatagtgaaggtttactttcctttgttttctatgttctacaaacaaatcataattaatgacaactagattaagaaattaaaagaatttaaaatggttataaatataaccagatgtggaaactttttataagttacattatatacaaaggaacaaacttgttcttttacttctgttttggtttttttttttttttttttttaattgagatggagtctcactcggttgcccaagctggcgtgcagtggcgcgatctcagctcactgcaacctctgcctcccgggttcatgccattctcctgactcagcctcccgagtagctgggactacaggcgcctgccaccacacctggctaatattttttttttcttttgtatttttagtaaagacggggtttcaccgtgttagccaggatggtctcgatctcctgacctcgtgatccgctcaccttggcctcccaaagtgcagtagtgttaaaaattgaggcctgagactaattttaatgaatttaacatccattttgcctcattccaccatctttacattctttggtcatatttagccttttgtatgttatttgtggcagcatacccttaattttcagacatgtattggcatttttattgaaatagattttcatgctgatggtagctacaaaaccagcagatctttttcattgagaaaatgagacacaactggcatgtggaaaacaaaccaaaaaaatgtgtagtcatgaaccagaaagttgacagcttgttctcattttattttggttttaaaaacttggttttacacaattatacaaatcagagaggaaatgtctagacatgtccaagctctcatttctgttgctacagtcactaatctcatttctttgacgtaatttttctctataacctttactttttagcagtctgtaccatttagtctaactttattagcattgatcatgagaatatcttattttaacagggctgtaagtgatatttgttagatggttatatcatttaaatattcccttctcagtgagggagaatttttttacttatattttaagattaatatgagtatggcatgttgaaaaaccagcctaatcatttattatcatggcgatttactatatatgtttataaatagtcctacataccaattaggtgataaaactttaatttgaagtctataaaacagtaatttaatttttaaaactaatattggtatttttgagttttctaaaagcttttactgattaagttattatttgtaatttcggcatggtttttcatgggctaagttcaactcttttcttgcttactggaacaataagtagattatcaatatgaatgtgcaacttatctatttaatgaattaggttttgttattggggatttgtgcataccatttgttaaaggttagtgcttacatgtctttttaacctttacctgtaaaaactgacaaatacttcactcttgcgaattaaatgtaaacatttgtcattttcaatgtttctttatcctttgaattattttattaagacaatattttaatttcctgttttaaggttttttatttgaaaagactacaaatttgataggcaaaaatcacagtatatttaatagggagaagagtgggacttgtcaactcccataaatctataaagcaactcatatatcagcagaaaattcaaataacattgttttagcctcccctaacatactgcatggtagtccaattccttccctaagatttctgcaaatttacaaaggaacatggtgagtggggaaaggttatatgctcaagttcattctatcaaagcatttctgcttattctggagaggtttctgttatggatcacttcaactcagagaggaaatcatgtctcttcatcaatgctcacaaatcgaccatttacaccagttattctcaagagcagtaaactttcctgatgatggtaggagagacaagagaggagggttatatcacatcaattcaaatgactgaaattggaagtcagtcaatcctgctattaaaatatctgtcaggatttcagttggcctaaacttcatagcattccattggcttctctccctttttcctctcttagcatcctatctttctcttttgtcaggattaaaaaaaaaatctcatttttctactacaaaggaaattttgtttttctacttcctacaaagcctcactgttgctttgttgctttggctttcacctctgccaaaatattgctttctataggttggtaaggcaatctcccagacaaagaaaatttcctccctaatggaaatccttgtgccagctgttaagtattaagatagaacttttattttagtgtgttaccaagatttttctttgtagattgccaactcaagattgtactagatgctaaaaaaagaaaaaaaactgggataaatgcaaagtgccttattcagtggctttgcctcttcttcagtcttctttttgttggtcctggaaatattaacccattaaaaaaggcagatctgttttataatgacaaatattggtaaagaaacatgggatcaattgttgagaaattgaaagcagtaaaaaaacctgatcatagagtaaccatgtaagtaagcaaaatggggagtcatgaatagagtgttgacaaatgagagtgatattggcaaacatgaaattaaaatgtactttggacaagcctatcgctaaacctgaggatacttttgatgtaaaaacaactgtggtcctgactgattttactctaaagttcatgtaaaaaaacatccttggtgacacactgacattgatttcctttagtgtaactgaggccatatactgttctgatatttttcagaaactctttttagttgggattagaagctaatagtattatttttgaaacctgtttttttgttttaaatggaatatataggctgtttttggtatatgaaattaatgcagaaggctattctacttcagccagtgcactctaagcaaatccaaaaggagccctcatattttgctataattagagtgaccattatcaattaataattaaatagttcccactctacatgtggaagtgtggagtgtatccatggaaatatagaagtaatgctctagctattgataataccatatttagaagacattacttctaagacagcattaacaaaactatgctttactatgatttattttttaaaatttcctgttcagttaaagtttgtatttatttttaccaactgaaatggtaatttcagattattttgagtattaatttcagattattttgggtattaaatacttaatactttctgataaatacaatttaattttttgaactacagtaaccaagattaacctaagaagtattttaaatatattttgccatgtagaagtgcttggtgttttatctaatcagtgagtgatatggtttggctgtgtcctcacctgaaatctcttctccaattgcaatccccgtaatccccacgtgtcaaggggaggccaggtggaggtcattgaatcatagaggcagtttcccccatgctattctgatgatagtgagtgagttctcacgagatctgatgattttctacgtgtttgatagttccttctgcgttcattctccttcctgctgccctgtgaggaagattccttgttttcccttcaccttgcaccatgaatgtaagtttcctgaggtgtccccagctatgtagaactgtgagtcaattaaacctctttcctttttaaattagccggtttctttatagcggtgtgaaaatggactaatacagtgaatgacagcagaaatacgtcattggttattatacacactagtgaagtcaaagtctaataattgtattcctctcagttaagtaactttctcacttagattcattccggcaacaaatatttatggagcacctactattgtcaggtttatgcttagcactggaaacgtaaaatgagtcatgttccctcttcttaattgatttacctgctttatcgacaggcaaaacagggattatcagtgatacatctttgatagtagtatgctgccttgagtgaaatgggttgcaaaagatggggatccacactgggcagtttggctttcccagagaaggttataccagctcggtgttaaataatacgttcttgtgggtgagacaaaaagcgacaagcatttttatgcagcgaaaacactgtgagcagaggattggagataggatgcagccctgtgttatcagagcaaatctagtgggaaaattactctggaagttatggaaatgtaaaatgtgtgtgtagagtaggaaagtttaagtagatttgaggcacagagaaaaaaagacagacatgttaagagactattagactaatatagataagaaataggaggcctgaattgaggtagtggaagtaggaaggaggaagaagtaacgaatgagatcattgactcagtatgacttaggatgtagtggaagcaacaccctcccacgcacattgaaaaacagctggtataaccttctctgggaaagccaaactgcccagtgtggatccccatcttttgcaacccatttcacagtgttaaagttcttattttaacaaattgtacaatgtgaaactaaattttattttttatttggtagtattaataaacaattatttacatccaacgtgtaattatttgtattcaatgtgtacttttatatattagctgtgcaatttaaagatgttgaaaaactttacaaatacatagcaacaactttacaaatgcattgtggcagtcttacttttttttaaatcagatatctttctaaagcagtggtcgcaatttctaaattttattttgtttcttcatagatttgaaccaatacagagcttatagtggggtattcaataacttatggaattctactctctgaaacctatcttcagaattttcactgtgacagaggaagtgcaaggcaagggacaatgccatctctcatagtgatttttactagcaaagaacattgattaaataagcaataagtttggattatttgtagtatgattagtagtgggttcaaatatgccacttctgaagctcttgagttgccaccctagatgttttctgaaccatattcttgcttatttatgtcttttaaacagaatgtgtattgttaattataatccccgttaaaacttatctaactgaaaaatttttttaactgtttcttctatttccttttgttagtttttatttcattttatttatttatgtatttatttgggatagagtcttgctctgttgcctaggctggagtgcagtggcacgatctgggctcactgcaacctctgcctccccagttcaagcaattctccctgcctcagcctcctgagtagctgggattacaggtgcccaccaccatgctcagctaattttttgtatttttagtagagatgggtttcgccatgttggccaggctggtctcctgacctcctgacctcagtccgcctcagcctcccaaagtgctgggattatgggcgtgagccaccatgcccggaccctgtgttagtttttattgattcactttccctttctcctcaacagaagagttatataaagtagggcattaatatgaatattttgccaacataagattatattgaaagatattgggcagccagttagagtgttgtatagacttttctaagcatatggaaatatgtcagcattggtttataacctgaatcttttttctctttataactttgtagtcaaccttgtcttcatttacaacagatagttttatgagtctactgattgcaaaagacaacaaagaataaaatgagaattttagtagagtagataatagtcccagttgcttggctcttttgatagcacatatgaataattcaccatccatatttaatagcatatgttatgctccttaatacatttataaccatctccttccaaagggaaaactatcctgctatttgtggtttgtttagtttttcaatgaaagctgaagagaatgttgaatatttgccccaagacctactacagcctgaatattactactttagcatattatcctccattgtattttctgaaaagatttccttggggatgctatcagagtttgtaaaaatgatttttaaaacattttaaatattgctaattgattcttacactgtatttttataacatttaaaatgtatatatgtaactacacacacacacacacacacacacacacacatatatatgggatatgctaagttggtatttatgtctgatatgaggaaatgtctaggtaggtaatgttaagataatattgaagcaaccatctcaaaggcagtgaaagcttcatgatttatcattattgtgagttattgggattttcttcaggtgtcagagaaatttgaggtaaagtacattttttaacatagaaagcctactagatttttttcaatgattcctgttttatttcaatgcttaggtagattatatattttagacaagtatgaaattataggtacagaatttataagttcaaaatgcttctattattgacaaataacttaatcactggaaacatttatcacttttattggcgtacctgacagacagcagactgctccggtcttgaaggaataaggctgcagaggcatatcataattcaattgaaacacatttctcctatcaggaaaactaaatagcatcaaatacctttgactttacaaagtacaatgacaacaaccttgactaaacacagatcatttgcttcagcaaacggaataggtctaagtattagtatactaaatcctatatcttactccaaatgatgtaaactagttatatatttagaataatatattgtgcagggaattcagcaaagaggtaactcagtttcttcactttatagatgagaatatttaagtatcatagaggttaaattattttcctcacatgaagcagctggctagtggctaagtggggctatatcacaagactgtgattccagtccagtccagcatttcttttgcattgcattataattatttttaggcataataaattaactttaatactttttctttaaccttccaagcataaatatttttctttataggaactttgtttcacttttaagaactactaaatcactaagtacaaaacatatttgtgacaattttggggaactttgtgatatttatataaaatatgttgataagcttgtatgttagtcatttgtttaagtcattaattctgaaaagtaactcttacagaatttagaaaaggatttgcaccataaatattagtagagttgattacaacggtccgggaagttttatagggataagagcaattatattgaaatatacttggatgataaaagatgaatataaaatgaaagtctttaatatgaatatttcttttacaaaaatacaattatagcaacatttctgcataataggcaaagaaaagtgatagttcttctgaactatgatacatgatccaaaggagctttatattttcaatttatgctgcagtttttctggttggtataaaacgtaattagcaggcacagttgcaccattgcgcttttttttttttttagtaaaacagctttacttttttaagggacagctggtggtatgtctataaagcattatattaaacctatgggtttctagttatgctgttttataattacatgaaattcaatcaatcaaccttttagtgatggaattggtgagtattggtgagccttagtctcatgtcaagattttcgctgggagaagaattgactgaggaataccatgccttggtgtgttcagtctcctctccctagaatatttaacaagaacaacttaagtaaaataaaagccttcaagtggtgggagaagtgatatctccaagggaaataggcagtttgagaggatttgaagggaagaagtctgtgaatcagtagtaaccgagcatttgtgaggccagctttccatgggattattgtcagatcagcatgtctgtagccgaacttgaaaagcagcaggtaaggttgcatgagggggtggggcgggggggggaagctaagtagattatagaaagtctgccaaattaaggggttttccttctgagctctttatgagaagaagccactaagacatttgagcaaggaactattgtaatgtagagcacctagaagatatatttgtgtttactttaagcattaggaccaccttaaccaattctttggtggatgaagggagaccaaattggagggggagagcccttaatgatcttttgtttattgaaactaaaagtggcttcaaaaatcaattttatcaaatctgtttccacttttcaacatcaataaatcagtggagctctctgttagatatataataatcaagaatagtttaggcttaggtaatcaacttgtaatacttgcacgtgtaagattctctgcagcaactgtgaggtattttgatttacaagtgtctctctcagtaacgaagtatatgaaatagcaccaagtcctgacaagaatgtagttatgtggaacaagattaagtctctaaataccctgtacaaatatttggttatagcatactaggctttgaaatcgggaactatggacagcactattatcaggcaatatttgtctttaactcatgcctttaccccttttcaggcagtttcatacattggggagaatttaagggaaataaaggctggtactttccctcaattcataccacacagatgactacttactgtgcctttgagtagagtcagtcttatattctgacggggtgatattttgtcccaaatgtttagtaataagtaatgctttagtatattaatcataatcatgtaacatttattgtttaataatgtttttgctagtatgagattacaatatcccaggctatttttcttatgaaccatgagttttatttccatgaaacactggtctaaaagttcaaagacactgaccattctaggacggctgcttctcaccagccttacaaatgtgtgcaaatttcttcacctcctgagcctcagtactacattttaaaactggaggtaatattagtcccatctccaccacagtgttattgtaaagataaaatgagatcatatgcatgaatggaagtcattatttttcacttttatgaggatacttgttttctattcttttgacaaagaaccttcagggccatcttttaagatatgaaaatcaccaatatgtataaaacaaactactggaaaaacacagtgcgacttgcatatacagtagtacacaaaatataatatgacttacacatagtaacacacataatgtgacttacacatggtagcccctcttgtttttatatcaattttttcactcaacaaatatttatcaatactatgtagtaattatagcttttttgttctagtgttatggatacagcattaaatttaaaaagatcaaactattggtcttcatggagcttgtctttttgtaggggaaaagcagacttagaatatatatttttaagaatcacatagaaaatcacacattaaccctgagtaaatgttattttattttattagcagaaaaaatactatccactacgggaaaaaaaatctgtatttttaccttcttttgatttttggctaaaaattatgttcagatggatgtcaactataaagttacaagtcttcatctttttacttctatttagattgtatttgaaaattgaatataaaaaagctctaagtagacatgatcaagtcttaaaatattttaggcatcattagtgcttctaataataattttatagtaacttctagtctccttataatcatcctgcctttatttaaccaaattattctgtcttgtttaactgttattaaagaatataaagaatgcttaagaaaagctttaaaagtcctctctagtagtagaagtataacttccatagtttatgactcccaaagtcaatgcaatgtcttcataggttacataggcagagaatgtgaaagaggtcatgagttgtggttttttaaaacctcttttgtttcattgtgtaggaaaatatctttatcagaagaagaaaacagtgtttataattataatgtaaacttgttaaagattttcatgtaaaaggtgaagacgaattttgtgtgaggtttatcagagagatcatcaagagaattattttcacttttgggaattgttccagttaatatattgatcgatagatggatgtcttcattggttttgcaggaacctgatttccaattttgcttttgccataaatgacttaggccacttttcctctctgggcttgtgtttcctcatctacaacaaattgctcagcccaaattgtatctaaattattttatttaggttctcatattcacaaataaacactttttttaatgcttctatttaattttcaaagttttttttgttattgcatttctgatatggatgactttgtaaaaacatagtaggtgaggttgaaaaaagaccacaggggatgaatgtacaaaaaacatgtaaataaaactattggagttttctttataattctgagggtctaaggatctcacaagttatatgcaagagaagcggcatagtgttttcagagatgattaatatttagaaaaattcaattctggttaaaatagatttagctaaagtaatgatagttgactatattttaatgggaaattttaaaatgttactcttttgaataaatgaccaccagatttaattttttaatataaacctacttctagaataccccccattctgctgtttttcaaatgtcaagtgccaaaatgtcataaatatttagggaagagggtttactctttgaacaaggagatgatacacagctttattctgtgagtaaaaattgtgatgacaatcatcccagacagatactattttccaagtgaccatggctagagaaacttgaaaagtggaaacagggcacttgatattccatgggaactctctaataagatttgaagaagtgtctgtagatcagttaattattctattgtggaaatccattcatttaaaacacagagagcacccatataggcacttttatcctccccccgcccgcccacactgattcattcatttttattcttgagaatatgctagtattttgaaacacttccatagaagctggatccatgaaagtatcattttgccaactatgataacatagtgttagaattttcttggtgaacttactgatttactgtgttttgtaatctagttgttgaagagtcaaagaaatttttttaggggctgttgaaatgactatccaggtttatccaggcaagtagtgttcctctgtaaaactctcattttctaagtatgtggtatgattttaaggactccagataagctgaaatatccagcaatacttctctgacaagcattgtggattatgaaatcccagcattagacaacatattttctaaggttaggcaaatattttcttagcagcctgaaataaaataaaggtactatatagatgtatattttatcaagtttgaaaatatgacattccttgcttctgaaagagaagcatccaggtccaacattttagtataattatcagagaaagaaaaaatgttaaagtgctagtgatatttttaaatgactatagctgttatctgaatattaataagaattaatctaattaagagtatgttcagcaatatgatagtctcataaaaagacacagaggatacagcatggtctttatttacaacaattttttactctttacagaagaatgaaacatagacatacagagatatgtaataaaaataagcactaaataattaagtatttagaacttactacatattatgcaacatactgtgctatgctaaacagctttcttgggccatctcatttagttatcaacagggtcctataagtgggaatactaatacctccagtttgcatataagaaaacaaagatatagaaaatttaagaaacttctccaaagatatggagcctacatatattagtgaaagagtcaaaccctaggcagtttgcctaccctgtgctcttaacctctttatgagtctgaacccatgaaggggtatagtgcaggcatgaattgccacaggtgttcaaaggaggcagaggtggttaagaaaggcagagtagaaggaaagggactttagcttcactcagaaatgtgtgtacaatagataagtgaagaagtacgttgggggtgttaataggaaagtattgtcttgaagagaggcattaacgtaagataaatgttgataaaaggtatcgttgtcttgttgattttaatagtttttaaattaggttactagaagtacttctccctattgatatttggcctgccctgggtttaactcttgtaacaaagaaaccaatagcacaactccagcacagtagccttaggaaagtgatgacaatgacaacaacaaaacaaaatcctcagattaatataggtattgtactaagtccttcacatgaaattctttttgaatctttattttcatttctggtaataaggcaaactggatgatggagggaataacagacatgcatgcgtgcacatacacacacaccttttccaaaacataactgatcttgtgagaaagtaagaaaagtcttcagggattagaaacggtgagaaagttggcattcagacaggtgtctaccactccttgatgacctgtagacatccatgagtcatacatgtgaaagtcaggaacagatcttgggccttagcaaggcaaaagttgaatggaatgcatcatccataaagctgtaacctcaagtggctaatatgaatgaatgaggaaaagaagaagtaaaacgcctgtctgtacaaacaagaaatcagtttgtttgtcattctagaccttgtttctggattaggagaaaaaaagaaaaaaaaaaaaaacccaaccaaacaaacaaaagaaacctcacattcatttgggattgaaatttataccgtcaatgtggatggcctgaaaaacctcaagtcagaaatatagttaggtcctcttggattgagccctagaaatttggccgaagcaaacacaaaccttcactggaaaaatgccctttaactttttcaatgtttctaatatgttttaattatcaaaaactcacacatataaatataaaaagaatattataatgaatgcctgcatacttaccacttaaattcaatgaattgtcagcactttgccaaatttgctttatatttgtctcccgtctctgtctctattttctatctcattattgaagcatttgaatgtaagttgttgacatcatgatggtttacccaaaaatatttcagcattcatctccaaaaagtactttcttacatactatactattatctttatcacaactaccataattaataataatcctttaatattatctcatgctaatctacattcagatttccctgggtgatgctaaatcatatagtcattgttttcactagctggggttctatcatagtttgcatatatatatatgtgtgtttgaatgtatatatgtgtgtatacatatatatatattacatgtatgtatgtattaggtatagcttaaactttttgtgcaaaaattgtttctgttatatacttcatattgcatctcatcgagaggtacaagaagttaggatgtagcagtattagtaaggctaaggttaatcacttagttaaggtggtaattactagatttccttgtaaataaatgtacttattattgcttttggcattatcaagtttctattagggtgatactttgtctccagttgaaagtcttatatctagattaccttttacttattagtttaaacatcctataatgatactaactgaatcaattattttattgagacttcatattcattagctgatagttaacatttattagctgatattaatctgtaatcatcaattgggaataaaccacagttcctcctaaaatgtaaatgcttattgttttccctctaattaccaacttcagagaaagttattggcataccagtcatctctagtaaggacaaatgaatgaacctctttcctcaaacccatttctctctctcaaaaatgactatggactcatttttttaaaaaaaaattctatgagttataataaattaatgttattattcttttgaaggccacattgtcctaagttgtctcctgtatctttttgatatggcttcttttgatctggaggattttctttctatatagcacaagatgttctgggataaacttgtacttttccttccccagacctggaattagacatttctccaggaagccattgagtactatactttaaagacaaataaattttatataactttactggtgacatgagttcacaataaaaacaaacaaaatcacaaaatatgtgatgtaataagtatcaccagagacagcacagaaaacaaattctggaatcagaccttcgcagactgtgactattacaattatatttagaaaaacaaatatgtttatcatattcctgagaataaaagaggatattggtggtttagcaaaggaacaagaaaaaaagactatcagaaataaaccggcaggtttgaaaaagaattaagtagaatttttgaaataaaaatatatataattttgaggttaagagcacaatagatgacttcaaaagtagatttgacacagctaacagaattagtgaacttaaagatctaaggaattatccagaatataatacagacaagaaagagaagagtttagatatacaaatagaataagaagacataatatacaattaatcaagttgtccagtgagaataaagagaagagaagagaagcaataggcaaaggagtaacagggaagatgtttctggaaatatcaaaaggcgcaaattctcaaattcagtaaatctaacaaaaaagaaattccctaaacacattacaatgaaactgcacggtatcaagaagtgacaaaaaaattttaggagcaaccagatagaaaatacagaatgcctacaaagaagcaaaatctgactgacagctaacttctggatagaaacaatggaagccagaagttagtaaaatgatatcttcagatttcttagagacaatgactgttaacatagaatcaaataataatcaaaattatttttcaaaaacttggaaaatagaaacattctcagaccacaaattttgggaaatatttactaatcaataaatcatcactaaataagcttttaataaatgtaatttaggaggaaaaaagagccttcaaacaaggtcaggaatagaggagaaagtagagtgagtctgcagggaaaagcagaagtccaatcaggtagcttcagcagtttgcagtctttgcctctataaaaacattatatattattggaatttgtgtatattttactttaattatttttcagcctacttagccccttttaccaaatataaaatgggtggtcatcaagcaacaacattatttctcaaaccatgataaaaactatttcaaagttttatttgatcagtctctaaatccttaggttattatatatattttatatataatatgtatttatatataatatatatattttatatataatttatatattatataaaaattataaaaatgtatatattatatataaaaattatatatataatttattatataaaatatatatgatatttttatacaagcaatttataaatgttatttatatacacagcagaaacagttttattagtatattacatcctaaggcaacaattttaaagggagtaacactcatttatatatgaatcttgaatttataaaaattcagttcatttcagtcacagtacataaatttacctgtcactgtcaccttaagtcttcaataaacgtgaactttgaggtctactactgctcgaactgttaaatgcccattttgaaaaattctactcaaagacccattctgaatcagtccagagtgattgtaggttacagtttcaaataaattaaatttaaaagagttataattttggctaaactactcagttatttctttactgtattacattacattattttaaaaaacatacttttaaaaagtatattagaacacttgaagtttaaaaactttaacaattattacttttactgattatattatttataaaattaataagaattagtattcattgtagacgacttggaatatattatttagctcaggataaatattatacatcttaatacatttaaaaacacaatacttcatattatgtaataccagggccaggcatggtggctcatgcctgtaatcccagcactttgggaggccaaggtgagcagatcgcctgagctcgggagttcgagaccagcctgggcaacatggtgaaaccctgtcgctactaaaaatacaaaaaaattagctaggtatggtgacatgcatctgtggttccagatactcaggagactgaggtggtaggatcctcttgagactgggaggtggaggttgtagtgagctgagattgagccaatgtctgggagacagagtgagactctatcacaaataaataaataaatgaaataaaaagtaatacctatatatgcatttatatatatatatatatatatatatatatgaaggaaaattataatctcttgattagagattgtcaatattttggtatatgctgttcagactttttccattatatcaattatgttctctatagtatataaactatttgcatatattctatattgtgtatgtatctatcatctacccacttacctatctacaaatctatttatctaaattcctaggtattaattctctcatttagcctttaagttgcagataaaggccaggcacagtggctcatgcctgtaatcccagcactttgggaggccgaggcgggtggatcacgaggttaggagatcgagaccatcctggctaacatggtgaaatcccgtctctactaaaaatacaaaacaattagccaggcgtggtggcgggcacctgtagtcccagctactcgggaggctgaggcaggagaatggcgtgaaccagggaggcagagctggcagtgagccaagatcttgccactgcactctagcctgggagatagagcaagactccgtctcaaaataagtaaataaataaataaataaataagatgcagataaaattggattggtttccatacattatgcaaagtttgttgacttccccaagatggttcttaattcttggtcacatgaatttctgattatcttcttatgacaaatatcttaatgtggaattactgaataaatgttataaatgtttttaaggcttctgattcatgtcaagttataaagtttgttatcagttcagacctcaaacagggtatattggagatgtgcattttacttaccaatgttgggttccattatacaaacacacctttttttttttaacataagatttttctaactaaatattaaactgattttattttctttcctaaatcatatactgactacaaaagcacataagaggagaaaggaaggatgtgtgctggtattttacatatctgaatttttcttttcttttttatttttagatggagtctcactctgtcgcccagtctggagtgcagtggcgctatgttggctcactacaacctctgcctcctgggttcaaacgattctcatgcctcagcttcccaagtagctgggattacaggcgcacatcaccacacctggctaattttttatatttttagtagagatggggtttcaccatgttggccaggctgatctcgaactcccgacctcaggtaatccgcttgtctcagcctcccaaagtgctggggttacaggcgtgagccaccatgcctggccctggacttttcctaaagaaaaaaaataaaataacactatgcctacatgaccaaaaattttcaacctgataataaaacattgttaggagcagtgatgtgacataatggctgtgatttactttggaagtatgcctgtaactgccattagtaataatgaaagttaatgacatgccttatgggatcagacaatggtcttcaatatttgtaactacttgctgggatagaaactattctgaactgtcagtgggtgtcagtttgtaattatagattgcacaaacactatgcatgatatatattttgtcaacaatgattaaattggcatttagaaaaatgcttcattttcagtgaccaagataaacacaatctgtacctttttaaagtaataaggttggagagtaagcacccatgaaatataacttataactttcaaacaaatcatggacaaacatgtatttttgggttttgtaatgtttaagtgattatttactaactagagttcgctttcaaattttaaaaagatctgtagttatcctgagcttgaaagtcacttatgtttcagacccaaatataactcactcaattttgctgaaaacctaaggatttaaaggctgatcaaataaacctttggaatagtttttatcatggtttgagaaataacgttgttgcttgatgacccatggttttatatttggtaaaaggggctaagtaggctgaaaaataattaaagtaaaagatatacaactttcaagagctaaatagatctaattcaccctgtctcctctaatgttctgctcactcactctgctccagtcactctggtctttccaagcatgctaaattcctttccacaccccaaggtactgtctttttcattttccaataatctgcttcattaagcaagccaatttaaggacactaccccatctagtttttttttctcctcccacctttcattttgcttccttcatagattttaccacagcattggaattctgtactcacccttccatttgcttcttcaatttgaacctcctgcattggatgatgaactccataatgtcagggataatgtctaactttccaactttctgtgtttaatacgtgccatagtactgggcacatagcatgtgctcaataaatattttgttgatttaatgcaataatgaatgaccaaatgaatgagtcagaaatatatacaagtgtagatctttagtttgatctattcactcttattgagttttgtggaaatatgacattttgcagttttgattgtcacattttaaataaggtgataacatttttgttccaccagatgggaggataaagctgaaaaaaaatgctgaacctactatacatcttgttattgcttattgtttttgtttatatacctaacatattaaagtttcatacttagtactagagagatatttcttattttaaaagcatcatatgcttaccttcataggtaatttaaagttaacttttaagttctgaattttaaagtgttatgaaatttcactttaaaataagaaatataaatttatggctaaaatgttttaaataggcttattgaatattccaaattaatgttaagcattcactgttttacaaccttatttattattattattattattatactttaagttttagggaacatatgcacaatgtgcaggttagttacatatgtacacatgtgccatgctggtgtgctgcacccattaactcatcatttagcattaggtatatctcctaatactatccctcccccctccccccaccccacaacagtccccagagtgtgatgttccccttcctgtgcccatgtgttctcattgttcaatttccacctatgagtgagaacatgtggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctcttgtgaatagtgacgcaataaacatacgtgtgcatgtgtctttatagcagcatgatttatagtcctttgggtatattcccagtaatgagatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgacttttgaatgcttgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttatcagatgagtagattgcaaaaattgtctcccattttgtaggttgcctgttcactctgatggtagtttcttttgctgtgcagaagctctttagtttaattagatctcatttgtcaattttggcttttgttgccattgcttttggtgttttagacctgaagtccttgcccatgcctatgtcctgaatggtaatgcctaggttttcttctagggtttttatggttttaggtctaatgtttcaagcaatggggaaaggattccctatttaataaatggtgctgggaaaactggctagccatatgtagaaagctgaaactggatcccttccttacaccttatacaaaaattaattcaagatggattaaagacttaaacgttagacaaccttattttttattaatactgttataaatactgtaagataggtgtgttcacaaaagactttgatatgtgatgatgaagtctgatttaggaaaagttgataatatttaaaatagcattgctattttcttacgcttaccgaataaaaatgctttggtgaatctaaaatatgctattgaaagaaaaagtactcttttctccagggaactttatatttttttattgatatgttagtacattttatagctgtcataacataaggctttatttgttttagaacattgaattacttctgcagcaaataaagcttaggactatattggtttataaaagtggcaatgatatttaagtactttttaatgtgctttgattttatgattcttaaatttcctaccttatctttttattttatcctattttgtttccttttggagaaagttaagtttccagaaatcattgctaatttgtaatagttaacatttaactttttttctgatttctgccattaaatttgttgttttcaaattggagtatattatttgtgttagatttaagtcatagtatatactatgcctaatatagtataacttatatactatgttaggtttattagcttagtgtaagcatatacgcgttgtaagatccattagggtggggaccatgctggaaagcttacaacagtgcttggcaatcagttggtttccagtgaatatttgtttactttcttaatcagttaatgggtgatagggcaaaagtgaactgatattttaagcagcagaaagggccagattggctatccttgtttttttatgatattataggtgtcatttatgttataggtagtataacatttatataatgtgtactttctggctcttggatttgctgtaattttaacatcacatatggatataagaacttgaaacactgtaaagtgaaatgctttgacacaggagttaatttacataatggtaaattctggattaaaggccttaaagtaagttctatcttatatcaaaatgtcagtattgattatgtatacatagaaaggttgtgtttttttcccaaagaaaaccaattgttgtggttaaatttttaaaaaccaaatgagtttagggattcaagattctcagctaagtataggtctataatcataatgataagttagaatttatgattcacagatatgtgggatttatgtgaataagatatttttttaaatattgctgagacttagagtaatctataggttttctagataactatgctgttcttttatagaactaaatttaatggagcagagagttaactaacttttaagttaacgtgactttgcagataactacttttggtgaatgattttcaacatgatcatgatgaattttaatatactcaaagttttcggtctctaattattaataaacttaaaataggtcaactagagcttagaagaaaaagcgtgaacttgttttttcttggtagtacccttgtcttctataattgacggaaggaaagtacatactataaaagcaactatataagactaaaattattgtttggaaattattatccttcaaagacttgtatttatgtttattgacttcatgttattaatatttcacaaccagggtttagattccaactcagctctatgacctgatcagattgaatatatttgtaaattcagtttaccaatatttaccttgcaaggttttagtataaatgaatataagttattccaaatgtttagttcactgactgtgcttgatgctatttattattataattagtcttattaatattaacagtacttcaaaaattctgataactttcttcaaattgttcttttctcaaaaatggggattaccacatatcttgagataattataatgctgaattacttttgaatattaatgacagtgatttttttctcagcttgagaaccaaatcccttgacaagcatataagaaccatctacaacaaaataagtatctgaggaaacctgtcagctacttcaatctgtatttcagcattaatgtgtgattctatgcaaacaaatttgggagaggattttaaaaattccactaaatagggagaacttttctaaacatctcattttagacaattttcaaaactaccaagggatcttgaggactgaaaccagtttcatttttctatactatgttattaataaaaattcaaagatcagttaatataatgcatattgtatgaactttgaaatcattatagtaaacatttttttgtcaaattacttataccagttatcttgcttgtgactgcagattgcataattgctgcacagatacttaaatggcaacatatgtcacatttatccactcaatggccacacttcattgtgtatagatgtattctgatgggctttacattcaaattgacaagtgaggcaattaccagtcaacatgtcctacaggttctgcatctggcttatccatttgtacttttttgttttgttttaaagtaacaggatctgtagaaagaactatagtaacctgatttgaaacctggctctaatgctgattagctatgtgaccatgggaaagttccttagcatgtttttgttttgttttgttttgttttccaagacagggtctcactttatcacttaggctggagtgccctggcttgatctctgctcactgcaacctccgtctcctgggttcaagcgatcctcccacctcagcctcctgagtagctgggactacagatgtgtgccaccatgccctgctaattttgtgtttttagtagagatgaggtttcagaatattggtttcacctcaagtgatctgctcaccttggcctcccaaagtgctgggattacaggcaagagccactgtgctggccagttccttagcatctttgaattttagttttctcatctgtaatattgtgataataactgatacaataaggaaatattacacgcttgtaattttgcaaaattaatgaaattgatatagggaagcaggtactctcctacactgttggtaaaaatattcattattaaaacatatctatgaagcaatttggtaccacctaatacatattgaaaggtacattcccattgagtcagcaatatcatttctgggaacatatgctacagaaatgcattggtacaaaaagatatatatatacacacatacacaaagatgttcatttgagcattatttataatagttaactttagacacatttaaatatccatcattagcgagaagttaaatgaatcttggtgtatgtagtcatgcaatgtgaatgtgaatgcactgaaataaaaagatttccgagacatagaaaataaaaaatgaaaataaatgatttagacaagatattgaaagtattacattatgtaaaagtataagaatatatatgtaattgcattatatattcattaatgcattttataattcctgtgtgttatcataattactttgaagaacagtaaagtgatactcaattattaaaagtgattccttttgggaagagattgataggatatctagctgtcaggtattggtgaatgggttccaattcagtgtgcgaattgaaacactaaagaccaaataaacaattacagtttttcaatggcaaaaaacttactttctactattattaatccccttgccatcattctagttcagggttttcattatctcactcaaagtggaagattgcaggatactctagagtataaataaattctatggaggacttcaggactttttcaagctgcatttgccatctccctccccagctcctattctcattctcttccccgacacaggatggctgctctattgaggaataacagatggaggtgggggttatgtgctgtaggtgatgagaagcaaggagttaaccaaataggggaaaaccaggagactactgtggcattattggtgcctgggaaagacaaagtttaagaagaaagggagtggtcagtcatgtcaaactctgcagagaagtcaaataccttaagtgttttttttgttttgtttttaatgagcatttgttttgtttagcatagagataaatacttactgatcttgctgataacagttacaatggagttgtgaggaaaaggtataaataaattgatgagcaggaggtgagagcacagatagtgtagactactccttttcaagacatttggctatgaatagaaaggaggaagaaggggggaaagaggcactgtcctacaatttgttgcatcttattgatttttaaagacaattttaaataatatgtcatcctatccaaagtcatcatttttggtagacatcccagcttcaagtgattaaccgaaaaaagcaaatcaattccattccttaggcatacattttatatttagtttttcctgacaggcttccaaaaaagctatgttgctctagttttgacattcttctggatgttttgctgagatttatgatggtcaaaaggggtaactttgtaaattttgcagtttacatttattacattcatgatttatgtaaattttagagtgtttctgtcttctctttctatggcttgaacaaaattcctcatgttcttttaacacttttccctgtttcttaattagtaataagtttgaccttgcttaggacctttttgccaaccaaactctatgccttcttccatgctagaacactaggatagattgtagaagcaaacaagatggtgcagcaggaggttgtgggaagacaaggtaggcttatctagaaatactatgtagagactatctggaaggttcaaactatggagaaagtgacttgtagcatcattgtttaattcagagacttatcctataatttatacaaaatcgacaaccagatatttctaaatactacatttattttatagatgagtaaactaacactacatatcaatataatatgtataaagtggaaaatgggtcatattctaaattgcatatttatctttggtcctacttaagttattgcactgatccatgaaacaactgaaatattgcactgtgtttagcatactttcctgagacatacacaacacatatttaaaatcgtatgtttaaacagggatactaagtctggcataaattattacactcaagtatcaggatatgaatcatgttgccaggttggtgaactacatttctatatttttttctgatttattatatgactatagcaaaatttgccacaataggaaagtcagaaaaatgcattatatcataatttagattttaacaccataggattttttggtaatttttttcagattgtattttttaatctgaaataccttttaaactgaaaagaaaatttcctattcaatgtttgtcatgtatttaagaaaaagaacaacaatataaattatactagggtggctactatatataaaatatgtaatacattatatatattacatatatagagagatataaactgaatcagtagttgacacactggatttagtaatggaacctttagttaaacatattacataaaatactctgtttattatatgttgccttcattaacaaagcctttgtggaggttatgagataacatataaaaaaataaggtaactttttttctctagcaagaagttgcccagaatttatgtagcctaggatcctcctggtgtaaactgtgcatttcatacataccatcagaaatatgtatgaaaatgatgtgtccctagacacaatcctggtgagttgcagagaggaataagaagtgattattttttgtaagtcagatataaaacttgttgttaagtcagtactttttgaaataggtagactaagcatcattttatatttgttttcagggaacaagttcatttgataaagtgcatttgagctacttgtcattaagttttttttgtttttttttttgtcgtttttttacttgtcattaagtttaaaaattactatgtttagtatttggtcaatttgatatcttaaattgttgaggattgcattttttaaatcactcacattgttcaattatcatacatttctgtttcattttctttaccagttttcagttattctgctttcatgtcttctagtacctggcacgttttgtgccaagagaaattcgtttgttgctgcctttgaaaatgttgctcaaacttatgtcagttgcaaatgacttgccgaagctttcctcagttaagcagctggcagtctaatattttcttagggaagcctgaagagtgttttcacatattgactcagcttgccaactctttctccttcaatgtttcaggtgtcagtggctcctgtagttattagcaatggcactaaactaaaaatatgattggtcctattataccagacatggaaaactgaaataacgagccagagcaatactatccataattgcatagacatttccttactgaatacacactagttctctcaaattattggtctagtttgacaaagtcccaaaggtgtaagtagctaatgtacccagttaaagtgaagagaaattggggacgagagaatgattgtcaaaacacttctctgatagaaccttgaagaatataagacttagagtcacttgtatagacagaaactgcttgaagaaattagaaaaaaaaaaaaaaaactagaaatcagaagacattttgtttttcatctgaaaaatggagcaaaagtagtggcgatctctaatcattcccataagaaacgtttttttaaaaagctaaatacattaaaagtcaatcttaaaacatgcaaaaaggctttaaatttggatcgaatatattgttaataggcatagattaacaaattgcaagtaagtaatcaaaatataaatctttttgagtactcattatgagctgacattgttatacgtactttgaaataaattaaccaatttaatccttgctttcattcaatgaaatatgtagaataattattctcattttacagatgaggtctaagctcatttgcaaagctggggtctaagcccagggagtctggctttaacatccactagctgaactccttcactggctgctcttaagttaaaaacactgttcatgtgttttaggactaggttcaactagtgggactttttttcttccaagtaaaagaagttggactaaatattttctttttgaaaaatcttaatctcatattaaaattcaaaaatccatatcctcctcattgccttaatcctttaatataatattgaaccctatagaatatttgttcttgcctaaatggtgccaaacatatttaatttaaatggtttttaaaatggtaaaagtatggatatttctaaatatatgatttcaggacagaatttttaaacttctactcatggatttgactttatgtatagcagatgaatatacgtgttgtccatgatcagagttccatgaaaatgaaattaaaatggtcacttataggtgtttttactttcatttcttaactgcgtagactaatgacatatacatcagtcgaactttgctttctaattttaaaggcagatgttaatactgttagctcatgaagtattttaaataatagttttatgtattcagctatgcataaacctatatgcatattttgtgggatctgtgaattgggtaaagatttgagggaaagtttgcagaaatgagtatgatacaaagtgaattttagggttttatatcaacttaaccattgtgcaaatttgagttttatctaaatcaagctagaatgattcactgaaaactctgtttttagtatcattaaagcaatgttcacttgcgttattcagaccactctctggagaaagtagaaaggagagcctatgacatcccatgaagtttggaggcagttaagaccactatgtttacctgaactctttcctatgtttaattaaacatagagtcagatgtttccttttccatggactttggaaaaatttataactgatttgactattttaggaatcttgaaatcatacactcctcatagaacctccttcagaaaattacatatatcattgctattagtttggaaaatctgttagttaaaaatgtttttatattaaccaaaaatatagctactttaatttagagcacttgattttaatagatgtgctaatcaatggagcagaagagttaactgagttcagagacatagtttgggtattgccttagagatatatctatttgttgtatgtatgcttaaaaatacccatgatattattttattcatacattagaaatatttcctactatcgatttttctcagaatttttctacagggattcaggctacgtttcttttgaaatgtcaatgattgagaacttaggtttaaaaaaaattacctaaatctttaaagttaaaaaagatgaacatatagtttattcatacaatgaaacattatttggtggacatacatttgaatagattgtagctaaaataaagatgaattacaggattataacatggagagaaaaatgcaagttgtagaagacagcatagagtatggttccatttttgtaaagctcaaatagaataaaaactaagctatgttttatttagcaatatacaaataggttgtaaagctgcttttaaagagcaggcaagaagaatggtaaacacaaaatcaggatcatgcccccagaagggaggcaaggggctgatgttggggagaaagtaggtaatggcaatattctaggattcaaattggatcacaagagttagtgttatcattatatttcatagcttacataaacatttattttggatgcatcaaatactatataatagaaaaaagtagaagacaataattttctgcctgtttgtcattgtatatgctttaaaagaaagtaatgaagtaggaaatttagacaattagatggttgttatgtctacatgagaccaaataatagccttactgattattattatttttttttttggaaggactaagtaatcctgttttaaagattcatgttttaagtttcactacttaatttttatttcagtgacaggaccaattcagaccaggttaaagtttataagagaaaaataaatataacaaatgtttattgacttcccacactacctgtcaggtagtatattgggtgttgctaaggtatcacagtaaatgagataagtttctgctctttgagacctttaagttcagtgaaaacaagaggataaatgtgtctattaatccaattagtacaaattctgaaagcacaaaatgttaaataaattaaggacgttcctgagactaagtcatccctcaatattattagaaaatgtgataaagcaaagcttaatataacagattatatagaaaatattgatttttttgttaattttgtctaatttctctttgctttatttcataagcttatatattatcctacccttaggagttttcttgtcaagatactaagatgttaaggcaaatgcatcaattccatgaagtaactgttacatagcttattacagagaaatctttatgcttatgcagagatccttggcctggataacattataattatttttatttaatccttctccttcctaggaaatcagtttgatatgttgaaaagagtgtcatattttagagaaactttgaattccatttctgatatgtttcattccatctttaggactttaggtaaattagttaactttgccaagtgtgaattttccatctataaaatggtgttgtaggctgggcgtggtggctcacgcctgtaatctcagcacttcgggaggccgaggtgggtggatcatgagggcaggagatcgagaccatcctggctaacacggtgaaaccccgtctctactaagaaaatacaaaaaaataagctgggcatgggggcgggcacctgtagtcacagctactcgggaggctgagtcaggagaatggcgtcaaccagggaggcggagcttgcagtgagccgagatcatgccactgcactccagtctgggtgacagagcgagactctgtctcaaaaaaaaaaaaaaaaaaaatggagctaataatattgtccagatagagctgtgaggattaaattttataatgtacacagacaccttaccaacttgaccacagtggttattatgtgtctaaatccaggatagtgctaagtaggatttaaggccacttaaagataaggccttcagtgtatgcaaattggatttgttttactgagcgattaatttcctagtcctagaacattgtgtgtgctgagttactgaatttttaaatgaattaactattaaaacctgaaggtcgaaagtgtttcaagacagctctccaattcaactcatagaaaatatcttttgaaacaaaatgtgctgccatcttcttatcctgaattgaaagcttaggaagaaattgtggagacactcagaagtctgccttgtttctctagtctgggatggaatttctgcctggaaattttccaggtagaagatgaagaatctggaaaattttccatatgtgtctgagttagatattaatgttggctttgttatttagttcagagtcttgcttgtaaattccaaaacatcaagggtattcataatcaaatagaaagcaacacatggattccaaatgatatttggattattcacaaattggtattttctgctctcttactttgctttcttagtatgaatcatgggagttgactgtagaaatgtcactattgtatgcagaacacatttcagtctcttcctctcatctattctgttcaaaatttttcaaaaaagaaccaaatattcataaagtattttaaatttatgtagtttgattttttgctacttgtttaagaaataaatgtgaatttctgtgaaatatgcatttatttaattaactggctaaatttttctgtcatttaaagtatacttctaaatttttttaaattccacttaaaataagatttcaatttttaaagagatataggtaaacatttcaatgacattaaagtgcttatttcttaagcaaaggattggaatgttttggttctattgggcaaacatgtccataaaaagtggcttttgtttttggtaggagagtgagggcttccacaggtttacagaagaagtgttgtcaagggttcagctatggaaagagatgggaggcttatcatgcaaggatgcactagagtgggtatgatggcgattttctcaggcttctggtggtcatggttgaaatgttgctgtagcacttccaatcccatcatcttaaggttttctgaaactgcctttgttcccacattctcagcaaaagtgtaattgtgttgtattggctcacaatcattttgtttggctatgtcagatcatgatcccagttggggagttttttttttttttttttttttttttttttgagattgagtctcacactgtaggctgggctggagtgcagtggcatgatctcggctcaatgcaacctcttcctcctgggttcaagtgattctcctgcctcagcctcccgagtagctgggattacaggcacctgccaccatgcccagctaattttttgtacttttagtagagacggggattcaccatgttggccaggctggtcttgaactcctggcctcctgattcacctgcctcagcctcccaaagtgctgggattacaggcatgagccaccatgtctggccaggaggagatctttaaacaaaaaaatagggctgctattactaaaaaaaaggatagtggataccaggcaggcaataaataatatccaatagactacgatatataaaaaagaacaaaatgatcggccaaaagatgagatgttatgcttttttataacacaaagcatggggagactttatcaaatcacatgttgcattaagtggtaacattacaggaaacttgtaggactttttacaaacatccagttatctgggctttagggaagttgctctagcaccaggtaaatatcttttggaactgggaattctgatgttaagtagcttacaacaaaataaatactttaggaatttatccttggaaattctctatcccaataacaaatcattacactttaatttgaccatagatctcatccatgtatgcagtttaattggaaagtactggataagatttacatgactcggcttcttgacatttaactaccaagtttcttggtcttggcttccttgttccttaagtgaggctgtcagtgaagatctttaagatgccttacagttctgtaaaatattataattagattgctctgagtggcacaaataaaattaaggtttagcacagtaaaatctgttatagagagaggtgaagtttatttaatctttatttaaaatgtatgtatacatctcatataactcaatatattaagcattttggacacccaaatgtataaaatatatgaataataaatttatattattagaaaaacaaatataaaaagattattgtcttaacatttctttgtaaggaaataacgaaactcaaatagaaaatggtagttttatcgcttctcagcctattggctaagatcaagtgaaaatggtagttctgatttctaagatcattttaaattatagttatatgataaaacaacattcaagataatttagataatcatatatgatttgtttttatgttggttaaaatgattagcttggaaaatggttcagattagtgtggaattttttatgaactcacctatgatcaatgactgaatttgaattgagtttatagaacaattattggtattttcaactaagtattgttgtacagtaaagcagagctagtgagatacccaatggaaacagcatctaaaaagttggtctccagaagtatcatttatacaaatattcttctaaaagctttatcactgaatacctctatttgtaaaaaaagatacatacatatatatatatatatatacacacatacatgaatacttaaaatatctttaaggatactgccattatattcatttattaattatatacctgttctatattatatgcattataaaatatgtaaggtataaaattaaaagaataagataaagattaaataataaacttagtttcattcatggtatgtttatatggtatggtatatgtatatacagtatggtatttttgttttggctaaaacagaaataggtaatgcaattgagtatgaaccattattttttaaaaatttgttaaacattttgaattgtagaagatctgattctatagtttgatttattgattttaatggctgtatgactgaaaaatgcttcctcacaaaaatatatagatctaagtggaaaataaattgttggctaaaaattatgccaacatttttaatgaaattcaactgatgcatttccatctcacttgaagttaatcagttattcttgtaaagtagccacatgatgctaaacttaaacatttctggcaaatgtgttcaaaatgctgtcaaatatgtcaataattaaaatatttctaaacatccacttttacgacattctcttcatagtattaactttttttcaatcaacaactttttttttctttttgccataaaataatcagcaaagctctgtgtggcataaatggcgtttatgatcacctacatctcaatactaagtattataaagaatcattatattttaaatgtcgttttcaagaaattcactcctttaataacattgtcacacttaagaaaatttctagcttcaagttttgtcacaatatctttcctatgattactgtaaataatgattttcatgtgtgtagtactactactattttcttgctttgctgtttttttcttgtctgacaccctctcacttgttacagtctttccattaaatattattattttatttttattttaatatttcaagagatttattctaagccaaatatgagtgaccatggcccatgacgcagcctccaggaagtcttgagaacatgtacccaaagtggttggggtgcagcttggttttatacacttcagagaggcatgagacatcaatcaaatacatttaagaaatacattggtttggtccagaaaggcggaacaactcaaaggggtgtgagaggttccaggctatggtgaatttaaatattttctgtttgacaattggttgagtttttctaaagacccaggattgataaaaaggtaatgttcagcttaaaaataaagattgtgcagcacaaagttcttttgaagtcttatagtggctgtccttagagacaataggatgacagatgtttcctgtttagattttaggtaatctctttaggattgggagtgtctggaagaaaaagatctagctatgttaatacagattcttcatagatgcaaatttttccccacaaagaacagctttgcaggggcatttcaaaatatggctaagaagcatgtttttgagtaaaatattttgatgttcttctttatcttgtaatattatgccagagtcaggttggaaagtaaataatgatatatagggttaaataaaacccaacctgtctgatgcgaatttgtgatttgtaggccatgactccccagacaccttagataggagtaagtccttaccagaatttgtgagatatgattaaagtagtgctgtgagagaaatgtttatccttaataacttatattagcaataaaactatgatcattggtcagataagtatttatcttaaaacattatattaattgaacaggagagtaaatccaatgaattaaaaaggaagagataatacaaatgaaagtgaaagttagtacaatagggaaaaaatgataaggtagagatcaacaaatcaaaaaatttgttctttggaaacaaatcaacaaaatagacaaattgcttgcaagaccgatcaagagaagaaaagagatcacagaaataaacaattttatgaatgaaaagttgagcacagccctaagtagagattacaagataaccaaaggtaattataagatgcataggtagttcaattggggaaggataatcttttcaacaaatagtgctgaaacaactgaatatctgtattttttaaaaagaaaactttgattcttatatcataccctgcataaaaattaactccagatgaatcatagacacaagtgatatggctccaacgattggaggaacaccagggttcttggtcctcatgccagtttagataaaacgacacggacacacatggagtggttttaaggagcagatagtttaatagccaagaaggaagaagaaagcagaaggaagaggctcccccatatggagacagggaagggagagggggatccagagccgaaagaggaggtcccccttaaatattattttttaaagaactcatttaatgttaaacttataatttctctaatatagttttccttttagggttaatagtaaaaagcaaaatatcatatatttccttatttaaaaattgaatatcccaatctaaactatatagaaacactggtgttttgagctagctgtgtagcaattctaccatttatgaaagagtgaaagtggaatagaacaagatcataatgttaaattaccccttcaacaaagatatgcactgtggaaatgtataaagtgatgataacatgtctctttaagtttttttgagaataaagtaaggtcgctgttttatgtagactcatagaaatattgaaattctaaaacgacatggtataatttttgaagaaatcttcagttcctgaaagagggtagaacagaggatgttttctttttattttatttttccagaggttattggggtacgggaggtacttggttacatgagtaagttttttattggtgatttgcaagattttagtgcacccatcacccaaacagtatacactgcatcatatttatagtcttttatcctttgcctccctcccactcttcccgccaagtccccagagtccactgtatcattgttatgcctttgcatcctcatagcttagcttccacatattagtgagaacatacaatgtttggtttttcctttcctgacttacatcacttagaataatagtctccaatctcatccagctcactgtaaatgctgttaattcattcctttttatggctgtataggattccatcaaatatttatacacacacacatacacacaccacagtttctttatccactggctgattgatgggcatttgggttggttccacaattttgcagttgtgaattgtgctgctataaacatgtatgtacaagtattttttaagaataatgatgtcttttcctctgggtagatacccagtagtgggattgctggattaaacagtagttctacttttagttctttaaggaagctccacacggttttctatagtggctgtactagtttacattcccaccagcagtgtagaagtgttccctgtttaccacatccacgccaacatgtactgtttattgatttttgattatggccattcttgcaggaataaggtggtatcccattgtggctttaacttacatttccctgattattaatgatgttgagcattttttcatatgtttgttggccatttgtacatcttcttttgagaattgtctattcatatccttaacccactttttgatgggattgtttgtttttatcttaccgatttgtttgagtttgttgtagattatggatattagtcctttatcagaggtacagattgtgaagattttctcccactctgtgggttgtctgtttactctgctgactgttccttttgccatgcaaaagctctttagtttaattaggtcccagctatttatctttgttttcactgcatttgcttttggattcttgaccatgaaatccttgcctaagccaatgtctgcaagggttttttcaatgttatcttctagaacttttatagtttcaagtcttaggtttaagtccttaatccatcttgagttgagatgatataaacaaatggaaacacatcccatgctcatggagggatagaatcaatattgtgaaaatgaccatactgccaaaagcaatctacacattcaatgcaatccccatcagaatgccaccatcattcttcacagaattagaaaaaacaattctaaaatttatatgggacctaaaaagaagccgcatagccaaagcaagactaagcaaaaagaacaaatctggagacatcacactaccagatttcaaactattctataaggccatagtcaccaaaagagtgtgatactggtataaaaatgggcacatagaccaatggaacagaacagagaaccagaaagaaagccaagtacttaacagccaactgatctttgacaaagcaaacaaaaacataaagtggggaaagggcaccctttttaacaaatgatactgggataattggctaaccacatgtaggagaatgaaactggatcctcatctctcaccttatacaaaaatcaactcaaaatatggattaaggacttaaacctaagacctgagaatgttttcttaatggtacagtaatcctttacagtttaaataaactaaaaggaaactgcctataatttatacactgttcatttatatgcatgtagctataataaaatatagactttcatagattcagttagaaatttggctgccttcccagcaaaaggcaagtatataaaaactgaatatcctcatctgtttaacaagttggccttgtcaacccttaatatatatatatgttcagtgataacacatctttttactatgttggaaaaattcatatgctgaaacacagtctatgttttgacactgataattaacagtatgtatttttgtattcccagctagacttctttcatggagcaaattgggcaaattctcaggtcactacataggcaatagtctattgccttattttctggatatgttttctgttctctgctctaattgaatacattaaattaaggtacttatcttcatcacttttaattttttatttaacaaatcttcatatttaataggaaacattataatgctaaatggcagactttgtgggagggcataaaaatgtgaaggacagccagcatgttgtagaggaagaaaaaagacaggcttaaaaccaggccacctctgaacctgaaacccagacttgtcacttacttgctgtaaaactttaagaaagtcacttatcttgcataagtctctgttttcacactgagaaaggaggttaagtgttaagcgaattatattgtttgaaatggggtgctcctgcaccctttgatagctcagctggtagagcgaaggaccgtagactatagagacatctgtgaaatgcggtggtcctcacagtagacgatcaagaatttttacctgtatcttacagaagaagaacatttgagataattaatttttttttagcttttactaaaataataaatatagtatttatcttgtgtaggaaatttaagcattgcacaaaaggtccccaactagagatatactgtactttaaaacaagcagcataatgtgcttccatcaggcaatagacaagtaggcaaaaacatatttgacttttaggcctctgctttgattactgaaaatgtgttgccttctaagcagatatttagtaatatttgtttcttctacagtggtgtgcaacaacagttgtgatttgactcattgcctttcagttcctcaagcaatatttggctatgtaataaagaagcttattaggctaacggtattttaaaagatgtttagggaaagagtcaatgttggtcttggtagtcatagcacatactaaccctatggtcttttacagctctcatacttatgaattgaattgactccttggtgtctgttaaccaccataccattatgtgaataatttcattgcagcctttccaacttaaagctaatcttttttaaacatgaaaaataacttttatctctcacaaataagctattatgaatgttttgagaccccaagtgtttttgagttattaaaattgtaagatggagcatttattggaatgcgttttgtttaagactaatatgttggcaataaagttaaaaaaaagtgctatggcaagtgtttgcttaattttagttagagagaaaaacagtcactgttaatgtattatagcatttaatgacacttcggtgtgtgataaaagcaaaaagtactttccttagttaaaaagatgaaaatggctgactttcttatgtactctgaacttcttgcatatataattttctttttttaaaggtgtaatctgtcagctaatcagcaaagatttattgtacaccttttctgcagtgtatactgtgctagttgttacgcagaataagtaagacaaggtaagtggcttcccatcatattggagaggcaatcaattttctatgtgaaacagatagtaatattagctgatgtatgagtaagtgacaaaattaaaggtaccaaatagcatgtcccagtgtattctatgaaacattatttctttgaaatgatctgggaaaaagattctacagccaaatgtgtttgagaaacgtggcccactatatagctcttttaaagatttacagcatactctagcatattaaggggtctgaggaggcctgcaataaagatgcctataaaagttacttgactaagcaattttccaagcttatttggtcgatgtcctgaatatctcctacaggaacccactttaggaagtgctccttgatttagaatctgacccaacagagtgtccccttaaagggtggaaaaagcttgctttttaagactaaatgctgatttttaaacaagtgttacatttatagatgcattattgattccagtcgagactgttagaactttcaggaggaaaacttggcaagacatgtaagagtataaaatataaatgctctttagcttaggaattacacttctagaatttactcttgttcaaaagattttaatggctaagccttgcctctgaactaagaataatctcgtcagcctgccatttaatatcttccacaacatttccttactacaatttcgggtatactagcatgcacaaatatgtgctatataaatgaagagtagagacatatttacagaggctagaaagtttggaaaaagattcatggagagggtggaacataaagcagccctaatggcgcattgcggagttaaacgtgtgtgtgtgtgtgtgtgtgtgtgtgtgtgtgtgtgtgtgtgtgtttgcgctggtgatactactctatctcaggcagggttctaagtactttattacattatttcatttcacaaaaccaacccatgatatgaatactactatttttcttttttattgacatgaagagacagatttcacagtgttccttgagtcacactgccagtgaaagtttgagattggtaaacccattttagagcctgaaatttagctacgttgttttattgtgaccagaatattttctaattaagtcccagaatacaaaatatcttataaatcttgagagaaagtgggattttttttccccattgtactgaaatttacattatttgattgagtttttgatggatataaaaataggagaaattatgaaccattgccggtacttaaattgtaactgtacatatgcatacaaaaaaatcagactatgtaaattctgaacttctcttggttggaggtggaaccagttaaactgagtatctgcaccttcacatttgactctgttaaataattttatggtttccaacatgggtaggatacatacagagaagttttgatgacttgcctatttgttttcttttaccatataatcagtaagaattgagattaaggcatggtttgtgaagcaagctaatctatccactctccacagaaggatacatgagaaggacatctatcttaagacattgactggaagacatagattgtctcaaaatcacaaagaccctaagggcattccaaaattattttttcacatttttagtccattcttattaataaactgtaaataatgatagtgtatggaataatcaattacatgataaatcttctttttattataaatggaagagaaatatttttcattgcacaaaattctaaaggatttttttcaaactttttcttaaatgtattagttaactgctattatcttaggaaaatttcttccttaattttgaatgtctttattatttgttttttctttcatgcattaggctaatacctgaagtattacattatatattacaatatatattacattatatattacattatatattatttcagtaagcctcagaaataatatgtaatatataaagaggacagagtagctattaataaacagccattatgcattcaatattttaggtgttggatatccaaatgagaagaggaagtaaaagacatataaggaatagagaacaatcaaaacattggttgttttatgtttttaaagctctcaaatctcattgaatgcagtaaactgaccaagaacttcttgtttatctggtatccagtttcatttggcattgtgcggcgacttctttctgagaaaatagcagaaaatctgaagaattttaaaactacaaacaaaagccaagtgatgacatagatttagtagaacataacacaacctcctaacctcctaaatattctctataatacaatgctatgcaatggcacatgacatgattgcagtgccatgatgcagagcaatgtcttgcggtctcagagaaaaaagtcaattttatgtatgattgttttcatggaaaatatattcaactcaaagttttcaaaattgctaatttatatatgcatttgtatattatattttttatacataggaagttgaatatccaggttaaaaaaacatttaaaagaaaattagttggtcgagcaaaagaagcaaatgtgtaatatttgaccatgccagtttttcgttatttacctaattatgtatatgagttttcaaaaattagaacttccagattaaaaagtttgtaaccattttctatagtttctctaaagaaatgaaagcataaaaattacagtttcaaagataaatgtcaatcttaatttctagtacctggaatttccacatttatttttgcgggaaaaagaaaactattgtatatagtaaaccttaatgtgctttaatagactttgtattgtgttttaatagcaggtctatttattgagatttattgaaaataaaactattaagacaattaactttataagctaatccatacttacaatattttttctatgtttcaaaaagtattatttttgaaattatttgtttcagaaattaaccatttaaagcatgttcatgcatatcttcatttgtggtcttttgttatgtctgttctcaaatcttgtactatattaattggcaacattaatctgtttccacaataattatagttttaaaatttcttttgttcaagatttaaaaatttgtaaaacattgctagtgtttatcagaatttgaatagcgtaaaatttttttaataataatatgaaataaagtaaaataagatactttttactttaaaacaattatgcagaggataattgttgtctagttttcttaatagtaaattagatttatttttaattaagttgtggttgtacattggtgtaaaatgtctgttccttcccccttatatttttctggtttatgcactcagaagataggaaataaccaaatagaaaaagttcagctttattttatttatgtataaaataagaatgtttaatcttccagaaaaatgcattgtttggatttagtttattatctaaacagtaaagcaagatatttaatgtaagcaagtttttctatttaaagaaattagtaattatttcaggcatttgtttttaatgaatattttgaaggtattatggagatactttctccttaagttgcataactgtacattcaatatataccttgcatctctttagcagttatcaaaattttagggctaaaagaccactttgaacaaaatttctagaaactcgttacttacatgctttagcagaaatttaaatcatgaagttaaatctactcagtttctcaaaagcacctgttatctctgacccaaggcctttgtcacagttgattcttttgcttaacacagcagctcttctcccctttcctgctcttttcatttagctaatcactgtttctccttttgagtctctgtgtattaatccagataggttatgttatgatgcattaaaacaaaaagactaaatcttagtgacttggcataacaagctttttattctcattcacacaagcctatcgtggattgacatgtctgtctgtcatgaactgctgtcattaatgtgtcgctttccagttgttccatcttgtgatacttccatcttaacatgtaacccttcaatagctgcacagagaaagacagcatgaaaaatcatgcaacacttttaaagtacttatttctggaagtataatttgcccaagtattcaagaagaagaaggttggtgggcattagtcatgtccactaaaccttgcataaatgaaacattttcttgtctttttttgatctctgttctgccctcagccttctccagatgctctcataaccacgtgttctttctttttcatagtcattattataatgaattgtttgtctaacttttccccttctacattgtaagctccatggctccatgacttctgtgactacatctgctttttctctccactttgtccacattaactggcaaacagtaaccagccaaatatatttattatatattaaatatatatgtgttatatatttaatctatttattaaattaatgaactaatgagtttctatggcttgcaatcttccagttagagtgctaaatgcttaagttggatttatgttgatttcttttggatctcccatggtttcatgtatgattttcacatggtatgcaacaaataaattattaatgtatgaatcaagtatatatttagaacatcttatatgcttgacctattttgaggaaatccatcttagggaattattatctctcagtataagtaagagaaaacttcgacttttggcagccagaaataatttttccatgatatttttgtcaacctcctccctcacccaattaacaaaacccttattatagacctaccatggtaaagacgatgctaggaatttgctggaggaaaaatgggagaagacaattcaaaggaatgaggcatgatctctgtcctcaaagagatgaccatctctatctgttagggataagatgtacatataactgttgaaggaagaagtagaagtacagcataagggatacacactgggactatgaattctggatcatgaactgtatcttaaagctaggaatatccaggaaaattttatgaatgaagtaacatttgatctgggccgtaaatgcttgggcacattgaaaagggcagaagaccattccaaactgatgaaagtataaagatcttctactatatctacattgattaagtaggtgtagaaacataaatagtgcccatcagcattctaagttctctttccttgactacaaaaatagaacataatgactcctaagtctttttttttttttttttttgatggagtctcactctgtcgcctaggctagaatgcagtggcattatctgggctcactgcaacctccatctcctgggttcaagcgattccactgcctcagcctcccaaatagctgggattacaggtgctcaccagcacgtgtggctaatttttatagttttttagtggagatggggtttcaccatattggtcgggctggcctcgaacccctgacctcaagcgatccacccgccttggcctcccacagtgctgggattacaggcgtgagccaccacacccagctgattcctaggtctttttatgctaggtagggtcatgtgactaattcagatcaatgagctctgtttgataatggtgtttattgtttctgggacaaattatgaaagaagcttgaattttatacttgatttttccataattccttctcacatcttcaataaatttgaagctttatgttgagaaagggtgtcataacatgatagggaatccatcaacatagatccttgccaatatgaatcagaagtgttgcagcatgagtaagaaataaaccacttttgcctaaaaccactggtttttgggttttattgttaccatagcatattcgagtctatcctgaccaacagtagaaatatagtcaatgccccattttatatatatatatatatatcaatcacagatatataatttctaagggagttggtgttagaaaattaagatacaactcaagtttattcactataggtgtgtctgacacattgtgcttctagttcactctctgtctttctcctttaaatctaagactatgagatttaatagatatgtagaagaaacccaaggcccacatagtgtgatgcccaaatagtagacagtaagtagactgctaattgtttggctaacatttgatcaccttgctccacaatattttacaaattgattcctcctcacattagtcagaaagaaacttaagacttgcatgttcgttttttttttttttttcttcttttttctttgaggtggagtttcgctcttgttgcccaggctggagtgcaatggcgtgatcttggctcactgcaacttccgcctcctgggttcaaacgattctccaacctcagacttccgagtagctgggattacaggcacctgacactacgcctggctaattttttgtatttttagtagagatggggtttccccatgttggccaagctggtctcgaactcctgacttcaggcgatctacccacctcggcctcccaaagtgctgagattacaggtgtgagccaccacactgagcccccacttgcgtgttcttgaaagcagtatgaaacattcaactcaccagtctaattggagtttttgtctatatgataccaaattattgataggcttttaagaactgaagtgatatagtttgatataaagcagatgagaagttacattaaagaagcttatgcaaacatacatttaaatgttagtctaagaagaacacactttaactgctctttctcacatattcaattacacaaaaatgatagtttatgtttaggagggatctatattatcagtaggatgaatactcatcttggaggctaatatttgtggtcagctgtatgggttaagacagctatgtgagttacggaatctaaggtttcagtattctgatgattatggtggtgtgtgagttcttggtaatggaaacaaattataaccttttaaccttttggaaaattgagtcctatgatatcagatgtgtaggaaacagtaaaaataggggaaaacacatccagtgcaacatataggatcttagttaacaattctctccttattttcaaacacctgatacatttaaaggacccattcttgaattttaggtaagaacaaactgctgaaatcattcatatagttttatacttgggttttaatttccttatgcgttaggatgagtcaaacttccttgtttcacagcccccactttataaaaaataagttcgctgtgaatttcaaacatgacctgagtgaacaactttatgaaaataatgtgcatgtgtaattacatgctgtcaattctgttacatgagggaggattatccagtttgcatattaatcacgctcacaatttcctactttctcttctgagtacaatgctgttgtaaggactgtatactgtgatgaataaaatggaaggaaacagacactacctgtgctgtagaaggtgtgacagggtgaagaataaaatgggagtaaagtatagcaacatatatcaggatcatagagatcagcgtggataaaccagaagatgcgactgaaatgatgtctggaaagagcagcagagcagaattgattcctagatgtatactgagaccaactgctctatctgtccgacctcagtgcagatggctcactgtgtgttatccttcacaatcacccttgacttcaattcagaaaagaaaaaaccttaatcactgtgatcattattaatattattaatagggtattgatttgcttctgtttttgctcttgtaacacaattcatgatttggcaactctaggacttttaaaacctgatactaattgatagaatttttaaaaatagaaattggatgggagagttaggctagaattgctaataattagagtatatttagaaaactatatgcatttgcttattttttaatgttaaactagaaaaaataaacataaattagttttaatacctttgctgagataacttgttgggtaatcaaaaatcacaaaatgtagctggtttattatattctctcaccttaaatgtggcagattaattaagggctgatatattggttagcactaattttctaacttcagttgtgtagctgatgaagtttcattttcctctaaatgggtgatgctataaggaagggtggtagagcttaatgctgcctgtcacttcttaccatacagagggaaagaaaggatatgatcaccagtcaaaaaaggaagctacaggttgtagttctcatctctgtacacaggttgtagcataaactgatacaaagaagtaagtggaatcacccccttagcccatgggccccatagaaagcggaatactctcccggggttcggaggaggcaacacttctaccaggttccaacagatgcacaccatgggtcctgtagaaagctgaatcctctccgggggttcagaggaggcaacacttctcctagcaggttccaacgggtgtacatcagtgtcacagacatggcctgtctcccatacccttaggctattccagaatgaatgttttcatgtccttttattgttgcttccagcaaagtctggccctaccctttcagagagtggacagattataaacactaggcatctgatcatattaaaggttgcagggagatctgagtctcaaaccctgctgccccactgcaggaaaaacaatctgctcatccttttagaaaagttaactctagatcagtcacatgtttaaacacagtactgtcatccaaatgaaaactgctatgttattattcttttttcctaaagtgcttgctaaaacacagaaaactgctgtatcataatcaaattccaccaatcaattttcagattagaggcccatagcctttacttccttcagaaacaaaagaaaggaggtctcataacaatgattaggaggtttcaggatcccccaaagctcaccaaaaaaggacagtctgagatacctcttatcaaggcagatatattatgatcatgagatatttggaactaaaattaaagtgtcaattttcagttaaaaacggaagtgatgtagtttgaaattgtttttatttccgaacatgtcaaccacttctcgactttgtgattttgataaatgtcagcctcacctgtttgtttccttggctttgtgggttgtagcaagctgtgcacagtggtttttctggtgtttttcagatctcatcagaagatgccagaagtggtcatcttaagagcttgttcaagggctatactttagaggtacagtctagtatgcacaacccagtagaattatctggaaaataataggaaaataggtgttcttttcttatctatccactctttttctctaagaaaattttggcaagagagagaactggtggatgattttgttttttatttttccttgtagaccaaggaaaatagttaattcttgagtggttaattattccaaaggacagatgtgttccaacaaatcatggaggggtggcatggatttgtagggtctgtgggctatggcataggactgctgggttcatatcccagctttaccacttagtgtgctgtgtgagttgctgaacctactttaactcaatttcttcaactgtaagatgtgtataatcatagagttcttgcaaagaagaattaaatcttgagttagctaattaatacagagtgcttagactggtgctggcactaagcaagcatctagtaaatattagctattatcattacaggtccacagtcactcatgtaaaacatgtggggccagatgagttttggagttaagaatattttagattttagaagttatgtatactctatattatataacacccactataggatttggggtagaaactcttaaacactttaatatttccacagccaagtctgtaaaatagttacattatgtgggaagaataaaaactataattagctcaggtcaattaaggttaggttttgctatgaaatgagctagcaatttttttttgttcagactttttaggttttcaaatttcaggtaaggaactgtgaaactctattatattttctgatgttcctgagccaaacctgactctaccatagaatgacaagcatccataaggatgggaacaaacacacctctgcagttttcaaagtgttactggctcaggctcactttcgggcaagccggcttatatcagggtcctagtgttcaattagaactgaacagagatcacacataaaacaataaggtttagttaaatggttgacttgaaattctaaagaagaaaataccaaatctgcttcctaattatgatatgtccagaaaccataactcattttgtccttttcctccattccctatatgcagtacatgatgatactacagactcatagcattcttttggttaagaaatttaagatgaggaagggattttctgtacaatgcaactggcaatgagaaaagacaacttgctaaaatatgaggttgagtgatcttatggcttagcctatgaatatcttctcttaaaggcaaaatccatgcctttcactctgtctgataagtggtccagatggagtattaagctgaatttctttctcattaacaaaaagtaggagtgcctaggaaccccatgcctgcagaaattgaacttgagttattattcacttcttatatctctttaaatttcaaaattattttgggatctactgaccatggcaaaactcaaaatatagtttacacaattcagtttatgtgtctccagtttttcagctttcctacagcagagcatcatcagtgaatgaactttgtagaattttgcttggcatttagaggaatgatagctaaatgaatgtattctcacccgataattccattatagtctccaaggctcaccactcattaattgcttctctaattgctttatgagaaattgctatttgataggtttttctccttattctttctaatgtcgttgagagttgctaatttacttactagataatttaggataagttacataatttatttgagcatttacaaataatttcaacatgctgaatgctgaattgcccttgtgatatagtgtgctctgttgatctattttttgatattcattaattcaaccatttattctacaaacaagttttgaatgtttataatgtgcgaggcatcgatccaacaactgtggaatctataaagagggttggtgtcctaaaggagcttatattctattagggaaagaagactgaaataattagaatccaaggttgaaagtgatgaatgcagaggcctggacaaagtcctatgggaattcagaagaaggatggagattatttctagctggggaatttgaaaatggtttaacagaagaaattgtcttagcagtatatcaaaggataaatacaattcatttttattaacaattgattaaagtattgccttttgttgtccatcaagggaagactgcttaggtaaataatggcacttctaaaattagagagacattaaaaaatatgtaacagccagtataatgtatacactgacaattcagagtagatgtttgactttttaggatggacagatgccagcctgtatcctcttctggtacatgctgactacatattgagtctatatacagtggaatatgtggaagtaaaatgatgattcaaataacattttttaaacctggataactgcaacatgctggtgcattaaagagagcaagataagcaacaaaagttataaagtatgaattatttgtatataattgtttgcatatatttaaatctagagaattgtcttagtttgaattgtaaaatttcaaatgagttttacctattctttgcatttttctgtttgagtcatttacagcgactatgaatcaattttataaaagaaacaaagtattttaaaagccatgtcaaaaaacattctgaacaatatttaaacagatacattagtgaaaaacataacaattagaaggaaattatagctatgtataggttatgtattcacgaaaataatctagttggtggaagcagaaatgagataaaaataaggtggatacatatggatgaaataaagttggaaactagttgttggcagatcctggaaaaccttgaagaatacaaatttggctttatctaataggcaagtatggatgggggcagttgcagtttttgaatgagtaatgattactgagaagcccttatttagaagtttttctggaaacaacctttagaagaaatttttggtgactgacactggaattatggatgacatttaagaggttactgcaataatctacagaggcaaacatgacatggaatttgacagtagcatcaggaatgaaagtgcagcagagacaccataagtttttttggagggagaatgaacagaacttacagactgaaagggtaaggaaggcaaaggggaggaaagagccattgacgaatactggtagcattagcttaaataaagcaatttcaaaagagctacacattagtgataaaggttcagagaatcggaatgtgagatctgaaagtgatcatttttattcctcttatttcattgtatgtaggaaaacaaaactgaggttaagcaatttatcaaaagttatacagttaaagcttcagttggttttagacttatcagtttgaagtgccatagagtatcccaggatatctgataaacccattagaaatacggatcaagagctctgtcaagtcccatcttttcctttagtcaaaattgaagactcctccatagtcccatataattatacatacttctaatatagaatttacaaaattttatttgcttttattgttttcctccaaaagaaaaggaccaggtctcatcgtatatacgtatacataggcatacatatatatggctatgtatatataactggtactgattataggcgctcaaaattgtttaaatgaataaatgaaaaagaaaagtgacaagtaacatatatttgagagtctttctagaagttgttatagaagataaggtagttgaagtcctcaaaggagactgtataattacaatagaacctccttctcctgcttgagatatccacctatgtggatataggtatataggtttataacctattaccagagacttccaaatgaaagggcagtctcttttttgtattacagataagccaaatggcattatgaatagttcccttaaatcaaggattatgacactgaatgcatcatgcctctccacatgcagtctgtttctcctccctaagccctatcttggttaatagcaccattatccaggctatcagaaatctgaatgttgagctatcctcgtgtcctaaatctgatccttgttctatcagatttacttcctgaacatctcacaagtggatacctcattctgcccccatgatctcctactgctactcgttgattccaggtctcataattgctcttggaacattgcaataacttaccaagttgtcttcttggctccagttttatctatatcccaaagcccattagaaaacaaaattgtctttataaaacctaagtattgtttttatttttctctttaacaaatgctgcaaagactctcaatttctcaggttacaaatcatactcttttctgtggtggggtgccgtttgtgttttggtctatctatctaatttcaatgctcttccacttactgctccaactacattcacctaatcacagctcctcaaacactccatgctgttttgaagctggttacttcctttctctataatgctctttcttctattctgaagaattcccattcatctttagaacaagctcagttaacattcttatctgagtaacattttctaacatcacctgataggtctgatcactcctcttatgtaccttttgccatgtgttgtttccattatacattattgcatgtacatgcctgtggaacagaaaattatactataaattccgatagaatagagacttagttatttttagtcctgcaccaggtgcagatagcaaacatataataaatatttatcaccttttgcataaaagaatgatgtctggggagaccttttttttttttaaagttttatttgtgtccttaatataacacttttaggaaagagctgggaatagggacagatttcgaagtttaatgaataagatactaaagagtcagttttagtaaatgtggtaaaatatatgttatgatggaatacatacacacacacatacatatatgtatatatatataatggaatcttaaaaagaatctcagagtcctaaagagatcttagaagacctaaagaagtatatggaaaatcggaaataaaccaatgcaaaaatgcagacttgagtttaaagaagtgagaagacaacaaagaattaagatgaaaacagaaaggactttgtcttacacatttttatatctttagtgctgtgcagatagaatcattcaatatatttacatagaggaaagggatatgaggaaaagaaaggatgaaaaagacacagaagggaggctaaaataaataagttgaggaaatttatatttaaaacaaaatgaacaattaggttcaacttatctccaacttttccatgacattatcaacataggttctattcatccttagcttttagcatgcttatcatctataatcagactgtgaaactactttgaggccagtttatagaggtttttaaataccatgataagcactttgacttttagatctcttgtgcaggggatgctcttcctatttccttaaaataaatgccctttgggaagtgatgctttagttggattaagtttacctgactacaagaagtgagaaagtctccaagaagtgcaattaagaaggggtaatacaagtgtacaagcataaataacagtatagggattaatgtatcaattagaacaaaaaaaagcattgatgtatatcagagaaaaaaatagaaatttaaaatcagttaacttgtgggctgcaaaagaggcatgagtcaagtttgggagaaagattttttttcacactttgttgtaccctccctctgatgtcctttgtaaggtatcatagtgcctatgagaggatttttaatctacaaaactattcagagaaggcaagcctgttcagaaattttaaatggtcttttgatgtagctgagatgtcatgggaggctatcacaccttccatgctgacaatgccttaggccagtcatgctgatagggcagtgcagagacaatgtgaatcgtgctctgggtttgaatgtaagtgcctaggtacaagagttcagtgattttactatgcgacagccattgaaccacttattttcattatgaaggaaattaaacatctgccttcagaataaaataccatccatgactatccaggtatgctgttactggaattgattgaatatagctttataacatttcatatttattttgcatttgtctttttctagctgtgaatttctgattttgagtatcatacaccctctttcctttcataccttcatgcctcattgacattaaggggaaaaaatacagatttgagaagcaatacttacaaaagcatcgcaagcaggccaagataatacagatattttcctcaatcactaaagttatggattaagttaatcagaagcagcatttgtgatacacatagttttattttttttttttgaaatatacattttagtggtatttctagccttagtctgctttcagtagacagatccttgcaactatgcatctcctattatgaatgactggcatgagatttgtttgacattgctgactagacactggtattaaaaaacagtattcaatgttttcattttatgctttaatacagaaaagcttcagccaatttgtggtgtttagatttttgaggaagtaaataactttttaagttatgctgtttctaaatacactatttttgttttcttacccacagaatattatgtctacatctgattattgtgataagtggtttcaaagtcagcccaaatgatctaaaggaacctggttgttttgctagtcttttatgtgagatgcattcctaatgcaatctgtggaaactcttgtgaacattggcacagattgatgactatatgtacaaaattccacttagtggttttagttataagggctatttttaacaaagtttgaggaagacagtctatgtataattcctttgaagcatattatcctataaaccctcaaaaatggtagcatatctttgagctacgaaatgaatcattctaattgcactaaaacaacaaaactcaccaactaaaacgccatcaacaaaatcttagtatttttctctgacagagaataaaagttcaccatcataatgactttttttttcaaagcttttgatttttctttcctctttttttttcttactctaaaccagtaggtttataagccgtgtacttgaacagcaaagccatttgccatttggtagaactggctgacatttcattttttctgggcagattgcagattagtttgacattattttgctgagctctgtgctacatcattaacgtattgcttatgactaaaagcaaagtagtttcattttgtggcataataccctacactctctacaagtagcaaaaagtatgatttttctttgaaaatgactaggtattgcttcagtcttgtgaaaaaaaacagaattctattaatgtaacaaaatgtatcactaaaatggtgtgtcagaggggaacgaaaacctctataaaggcatgatgtgtttactgttgatatctctaaatcttggctagaaatgagaaacattcatgaaatattggacttaaactgagattacatcagtatggtagcaatatcgtacttgtcaactaacagaatataactgcttggttgtaccacatgaaaatgaaaattcactttttgatctaaggcataattcttttcctgtccatgttagataactttttgttttcaatgtaaataaagtagaggctagggaactgtatcacaggttggctttgtttgggaaatcgggaataacaaatggctgatcattttttaattaaagtggtaatcaaacaattaccaatgctcttatttcagttgttaatatatctgctcacatcctctttccccccactgaattaactctagtatgaaaaatttaaaaagccacattgtacaattgttgatttctttcctacttaaggagcaattgttgtattataattatatatgatatggatgagttatgttgaacaattcacttgctgtgatttttccctttttttcattatgttgacatattttatgaagacagaacatctcgttgctgcaaaatgctgcttttaatgacagtaagcacctaaacgaagtattgtgcaaatgttttggtcacacacaccttaatgtttaaacaaaacatcaaaccaattagcaagccatgcttcagagatactgtatatagcctgatagcaggttctaacgttttttaaaatctcattaaattgatgaacttaattcttcctacttttatggtagcagataggaaatcttgagggacaaacaataatttcacagtcatctgagattattacactgattaccttttattaattcaatttcccatttgtttctttgacattttgaaaggataaaaaagtttttttgtgtatgtgtgtgaacttgcttttgaagccccactatttctaataataaaaagcgttcagggatgatgtacattgcttcaacatactctattcatgttgtacgtcagagatgacttggtttctacagcgtcttagatagaaggctattaaaccagaaaaaaagtatgcaattttcaagaatgatttaaggcgtatctcttttttttgttccagcatgcttatcttctaattcaccctatatgttaggttttatctgaaggaaatctacacattcagttttctccagacacaaaatctaagagttggggtataaggggtaggaccacacaaaaagcaaaagacttagaaaagacattaacaaggattacatttctttgattataattatcttattgctattaggtttgttctgctttattttacgttttaagacttatagtaaaaattatacccaggctaaagtttcaaaaacttagatagagagatacacaataaaatataaaagtagtatttgaaaaaaatgtgattttacttctggttgcaaaattgccttttatatttttagataaatatttaccaacttattttggattataatcagattattgatatggttatcaaaattttccttcagtgaggttgttcatacacattcagctagattcttccaatggataataattcttagtcaaaaggtcaaatttattctagttttaatcaatgtcccattattgcaatccaaatgagcttaatattacccataaatattgtgtttataatttttatcttcattaggaataaaagataaaaattctaaatgtatggcttttgaaccaagtggtatggtgttggtttcttgtagaaatggtcaaaatactttgaggtatgctagctgttttagttttctggagtaatgtttagtatattattctaatagacctagaagcaatatccaaacaggccggagaagttaaagtgctcctgaaactgatctatttattcccgtggaggactcttggatctccttgttggttccttgttattggaaaatcatatcaaatatgaattcatattaaatattattctttcaataaacactgaaaaggaaattgtatttttcccatattgttgacaaatcaactgaaacaactttattttgcttaatgagtattggttccagccagatgggctcattgttatttcctcaaaagccagtagatggaaaactaatcaacattttaataagttgttttatgtacccaaaataagagtagaatgtgtgtgtgtttgtgtgtgtgtgtttgtgtgtgtgtgcgtgtgtgtgtgtgtgtgtgtgtttaagcaaatcagggagattatatgttggggggagacagaggctaaagcaatggcttttttaagttatttatctatgttccagtgtttgtggccagatgggcatctgtgctacaaagagaaggtaatattattggcaagatgaaatgatgtgagaggatttcaaattgtcctatgaacttatgagaactatcaatagtttctctagttttctatttaattgaagaaacatgactagagtcattagatgacctctacaaatcattaatgatgcagctggagaggaattctaagactcctattttcgagtggactgttttacatatgccactgccatcaaacaaagcaattcaataaagctagaggtaataccttgctgtgagcagatatttattagcacatgcctatcatactaaaattttcctaaaaccatctgcatagtattgtttgcaagaagtattccgaaatatgatggagatgaactattcagtttcagaatgactgcaataaaagctacaataaagggaactacttattgccatagaaacaagaatgtatgcacaacaataacatttgaaaccaacaagactgttcataatagcatatcataacctagaatcttttgcttacagtatgattttggtttgtgttattactgtaaagtacaccagtggcttatatttgcaggactagaactgtctcaagatgctatgatgctcaattgcatcatccagaatttagaatcagttaatctaattttagtgatggcaactgaatttccaggcacacatataaatttgacagtaaagtgtagttctgaaaaactatcctgatctctgtgtttgtatgtggcattgtgcattatttgataatactagagaacacattattttctcatccgaatttttcttataattaaaattaccattttaagtattggtaaatttttttacaaataagtaaagttttaattgcttattataaagttttatgatagacattatattcttgactttcttatacatagtaggttaaacataattaaaatttatcttgacagcctgagctcataattaagactatcaatgataatattttgtgagtcagtaatattgacacacaaatgccctcagtatctttttttttttaaattcaaccctgcttgtatttgctctaaaggatccttgtctgctatagtgtgtccttcctgtcaactgtggcttcactggggttagtactgcttctttgttttattcatttaattaccatttgtgaatatgtgactgtgttagaaatgtctgtagaacaaggacaaatgggttccgaataaatatctgagatttttctgataattaaaatgttgttgccttgatgaatgttttgtgaaatttatccagagacctcctttgtcagcttagaattccaaccaaattttatgtggtagtgaatgctagattgctaacttgttgataaatgtgttattattataatttgaacgtgtcagatatagtaccacacaaaggaaaaatctggcatgttgaaaaaaaaagagaatttcagggttcatctagcaaatcaaagaatattgaatcaatcaacaaataatcattacttagaggcaaagaaattgaactgtcacttcataccattagttagataatgattaacacagactcttaaaataaaaataaaagcttctgaaggccagttcacttctgttgtagatagcaaattttacctttcagttttatttagttctttgaaaacttataactaccagattgtaatagcaaccatacatagcagaaacataaatatttggtgaaaagacatccccgataggaatatccaacaaatataaagtactgtaatctaaactccaaattccaaaatgttaataaagccatcatggaaatggaagaaaggaagtaatctgaatacttgaaggcttttattttaaagttttacatgatgaaatcagaaaattgagtatttatatcaactataaagtgtcatctcagattaattgcctaaagttttaaagttaacagtttggatatttgcaataaagtcatctgcctaggagggatagtagtagtaagtaacagacaatctacattatctacatttcttcatgtaggtttctagtgggccttcttttatcttttattttctttgctaacatgacatctctaagtacattattttttgtgtttcatactttggattctacatggctgagtcataaacacaattctcaaggtcctaagtcatgttcgtacatgaaaaaaattttgttttggctgtaggatttttttttaattttaacataccagaaattttaccttcgagctctgaattttcaaaaagtggcagcaactttatttagaagtttcttctcatgcctcagttttgtcgcagcaagttgatagggctttagctacattatctcataagttctttaagattcatcgattcatattaaaaattggagaataagtgtgcatccattgatatttggcctttgaatttgttccacctgccaataaagtaatatttcttggcagcttgccatgaaaggtcagcacttcttggcatttttttcacctgatttttagatattcattcagaaatagttatttttctctgtggtcaaagctgtggtttatgaagatatacattcttttgcaactccatcttatagaattttgagtttattctgacaatttactttggtgcatataaaaagactgcttgatagtgccagtgtcagtttaagtttagatctttgtaggacatggcaaagaacataattttcattgaaaagctacataaacattataagacctagtacttgatggcacaatagggtgcccatagtcaatgataatttatacttttaaaaataactaaaattgtgtatttggactgtttgtaacacaaagcataaatgattgaggaaatggatatcccattctccatgatgtgattatttcacctcacatgcctgaatcaaaacatctcatgtactgcatttatacacctactgtgtatccacaaaaatgaaaaattaaaaaaaggaaagttagataaaaatgtatgaggaagcaaactttaaatgtcaggtctttctgataactagaagcatacaaatatgaaactacagtcttgtgcagtttgaattgctcactagtgggtatattcaagcagttctagttataagatgttttctaaaactgtgaataagagactggatgaccttgcctgaaagttctttctaatttaaatttccttgatttacagatataatgtaattatattgaccttggatttttgcttaagtaaggtttccataaagaattaggctcagaacatctgtttttctgggctaatgcatgggagtagtcttgatactttacatgatatattagagccattaatacaccagaattttaagaccaatttaagtagtgcaagcaagaataatagatctggggggaggatatctgtagtttgcaaaatttaatgaaaaatggaaatcaagtcttgaggaaagatgggaatcatggcagccctgaatctcagtagtagaatttgcagactatttgtagatgtctcagttttaaaacacttctattgctacatgtctgtgttcagtattcaaatttccatggaaaaccaattgatttaaattaagtcataacacttctgtggccaaagcagtgaattagaaaggaagttggtaggagaggagaaccaagcactatgacttccagacccaccagaaccaaggttcagtaagaatattggctgagagtgttatatcgaagatgggatgggctaggaattagaagtcgcccaaaggaccgggtaacagatgttacaccccagcgcacacaaccacacacacacacacacacacacacacacacacacacacacatacacacacactacacccttatacaaacccaaccaaacaaacaaactgggatgaaggtgagaaaggatgctgggcagataaaacagttagtaattttccaatctatttctgtctccccagtgatctctaagatccttgaagtcaaaattatgtcttgttcgctattaagtttccagcctctcccacatcctatggcacatagcattttgtgtagtacatattttgttaaaaaacaaatgaataaatgagtgaatgtacttaagtaaaacagtttagaagcttatggaaccccctttcatagatacgagggatgcaatttagcaagctgctgactctctgatcttccaaagctattaaaacacatgccagccactggatagtgatggagatgcaaacttcatctttttcttattccctctttccttttgtgtcctttcctttcttttattctcccactctccctcacttcatcttctcttttgttcctttcctgctttccttaatatgtactatttcgttacagatcataaagacaatataaattatttttacttattagcaaaatgtaattatacacaatgatatttaaatgatagttattctgtttgtattctcataatagttgaacacagcagatggactgtaaaatactgccaaaaagtcttggattctaaggtgtttttactgtttcccgtgtttctagggaaactgtaataatcaggtttttcatctgaatcctttaaagcttttatgaaatccagttcaaaagtagaactaatcatagtttataatgagctttgagagatttttcttgtaaattcaaagaaaaaaaaagaaccataagagaatttcaaatgctgttaatgaggctgaaatttttataaaaatcagaaaataactatcttaaaaacaaattgcatatatattattatgtatgttcactgtatccatatttgaataactatcaccagcaattcagggctctttgcattttatggtcacctaatctctaaagattcttctttatcaataacaggcgtatttaaagaatggtcactgtagcaagaaggtgttttgatgcacagtatttagaagaaattgtagcatcttcctttaaaacacattctaaaaattgcatcagcaaatatgcataaaagatcatattatagtttgtagtatttaaaatattatgcattagttcaaaacattaccgagttagcaatttttagacgctacttacaaatagctgttttggaagaacatgagccatttggagctttttggaagagttttattattatataactatgagcgtgtaagtgatgtcacagctcaagcagaaaattaactaaattttgaaaaattaatgtctccatatgaaatgaaaattcagtgatatcaagaatgctacaccaataattatgccctttttttgttttgaatgtcatcaaaggctatttaaagattgtaatgtgtttagatttcaagccgattgtgtcaaggagggtaagaaagtaccctagatgtactagaatgataccttctcttaatggataatgacatatatgttaagcaacacaaggaaaaaattttgttgtatagaaaattggattctttcctgtgtgtgcttttgtaatatatgcttaggaacacataagcttaatgccatttaaaaaacaagcaaacaaaaaaaggacaaacccagaaaatgatggatgtcctgcttacctggaatagatcaattttgtaagcacctggaagaacatctaatgcagacaaaaatcaatgtgactccatgaagaacacttcttgttggattaatcttattttcttctgtgccagaatgacaaacttagtagatccatcagaagtcaaagccccagtgtaacttcacttagtgaggcttttcttttattctaaaccatatcccagttaacaacctggaaaatgtaaacctttctacaaataagcaaaaggtgggcaatagttttggccaatggggacatttcaaataaaccctaccagtaccaaatatattcatacatgatctgaacaataccatcacaaaaacataaagaatatctaacatttgtttatgccttcccatatgctggatattattccatgatatttatatgtgttaacccacttaatcctatttgaagggtgacatatggtactgtataaaggcctggcctcccgagcctgtgtttatactccagctctgccatgtggctgtgtggccttaggcaagttattcagtctctctgtgactgggtgtattctcatgtaacatggggataatagttcttagcccttagagttaggaagattaaatgagatattatttttaaagtgcttaaacagtgaatggcccaaagccaatgctacatacattttgctaaataaatgaaaatataatccaaacaataaattgtcaattacagagaaatgcttagtaaggggatggccaaaatattgcttttagtgaagagctccaaacaatgcccagtgatagaaaatgattgagtaagcagagtataatatagcagaagaagtgctgtgatctcagtgggacgctggttgagcatatgtcaagaacacagggctgtaattacttaaaataaacagacactaggttttcttgatggaagagtgtcaaaacaatactaaccctgattctggtactttcatccctttttactacattgtaaccaatatagttttttctcctttttatatcccctccatccccttttccctttcttccattcaccttttatttttaataacaatttggagaaaaagatcacccagtggcaatatttttatcattgaaaactatgctggagaaaattaatagagcttgaactgatagatcatctgtataagatattgtgcattctaaacataagtttaaggcattcttgtcacatgtcatcatttaatacaaagctgaatgaaactccatgagaattatatttccctatcgaactaggccttctgtgtaccccgggggaatgaaaaccaggttttggtcctgccctggaagtgtgtgagtgactcaatttgttgcttctcgaagactttttaacattgttgtggatccagtatgaatcaccactgaagcgcttcacttcattgcctcttctctcaattattattttattttggctctgtacctgtagtataccttcttctttatgctatgtctaagtttttgttcaaattcgtctaacctttgagtgcctcctctatgctatgctctatgctcttacgcattttaaatcacttaatcttcacaatagccctttgatattgttattattctgctcactatgcagtttgggaaactgagatttagaaaagttaattaatttgttcaaggtcatccaataaggcagtggtagaggtgaaattaaaactctggtcttctcaatgttacaatctgccaatttcttctaaaccttttgttgagctgtgctcatgaaataaatatacagtagtgcttttaaatataaaggagttattctgctcttttgtaaaataataaagaccgccctaggatggatcgccacatatattttctatttctctaagtagtatgttcaaagctgaacatttgtttcttcatctttgccattctttccttcttttcccctgaagtttctcctctcttgaacatttaaggacacctcctcaaattgtttcttaattttagatgatgttcataattttacaatatttttctaggaatatttagttatgccactggggagatgcttatggagaatatgccttttttctgactgcttaagtagatgagtgcttctgttatctacctccgaggtgtatagaaagctgtagtgcaccatcttgttaatgttttctctcacaaaacaaagccagtgcttcttaaactttgtcttctaagattttctaaaagcctgtaggccgtgtacatatttccagtttgagtcatctaaagtagcttattttaagagaaaattttttgggagtctgttttctcttttaagttgtatgcatatttttcattttactgcataatacagagagtttttttgaaagataaaagtaaaatgttactcaaatcttcaaggaaatgtgcctagctagatttgtgtaaatctttatcttgcggtgtttcatagacacttggcttgattttacagaatatggaaatatactgtgaatttgttaagtgataatagtgcaaacatatatactattatttcatacaagcaactttttactaggcaaagattttaattttgactcaacttgaaagactagaactaaagtcatattacacaatccttaggtcacaaaccttaaagtctttctcatagcgattttctaatgatatatttgaatcttataattagctttccctttcataattagctgtattatacatctgatttttgatttcttactttaactcctttctcctatttccaagaggttagaattcttgcttatctgtgctgccatttagttctcaacattttttttttttctgagctgatccctctagcttttttcattctcctgcatccagtgccccattcatctcttccatgcagctgaatttagttaaatgtctaccttacttacttaaatgtattgcatgaacttttcatggttattcacttttagatttcgactcaaaagtgcctggattatttctgcctatcattctactctataggcaagagtgatgctgagctggaataacaataaacacaagaaaattcttttctggactaaacatctttattattaaagtgagaatataagatgttgcggttatctcaaaaatgatttcagaaaaggtgataaatatttctgtcttgggacagaatctactcattttaagcactgcttaataatcacccctaatgattaacctgatacctttatgttggccttttatttgagaattttctatatctccacccataatttgtctgaacttttaagtgttaaagatctcaaaaaggtattttatttcatatattgagggcattgtagcaaagcagttaagagcacagattagagacaaactgaaggtattaaatcccggtttcacacttatcacctaagagaccttgaacaaattaatctttctatgccctagtttcagaggataacaatagttcttaccacacaagagtgttgcatggattaaattagtaatgtctcttaaagaatatagaacaatgcctgacatattccaagtgctacctatgtattagttaatattgttctataatattatctccttaattaaattgataattccatagttgcagtgcctcttaaaagagccagttttatacactggcctgttttcctccaactctcatgtttttgtttcttttttttttttttttttttttttttttggagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaatttttttgtatttttagtagagacggggtttcaccgttttagccgggatggtctcgatctcttgacctcgtgatccgcccgcctcggcctcccaaagtgctgggattacaggcgtgagccaccgcgcccggccgtttttgtttctttagctcatgcctcattctgatataaactcctgccatctacattatagtatttcccctctttctcctacaacatgtgaaatcatgaaaacaaaggatgagcgtaatatttgaattatcctacgcaaattgcgaacctataatagtctgtgcattttttattagcagtttcttttttttggattttttttattatactttaagttttagggtacatatgcacaacgtgcaggtttgttacatatgtatacatgtgccatgttggtgtgctgcacccattaactcgtcatttaacattagatatatctcctaatgctatccttccccactccccctaccccacaacaggacccagtctgtgatgttccccttcctgtgtccatgtgttctcattgttcaatttccacctatgagtgagaacatgcggtgtttggatttttgtccttgcaaaaatttgctgagaatgatggtttaaagcttcatctatgtccctacaaaggacatgaactcatcatttttcatggctgcatagtattccatggtgtatatgtgccacattttcttaatccagtctatcattgttggacatttgggttggttccaagtctttgctcttgtgaatagtgccgcaataaacatacatgtgcatgtgtctttatagcagcatgatttataatcctttgggtatatacccagtaatgagatggctgggtcaaatggtatttccagttctagatccctgaggaattgccacactgactcccacaatggttgaactagtttacagtcccaccaacagtgtaaaagtgttcctgtttctccacatcctctccagcacctgttttttcctgacttttgaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttctttgtagattctggatattagccctttatcagatgagtagattgcaaaaattgtctcccattttgtaggttgcctgttcactctgatggtagtttcttttgctctgcagaagctccttagttgaattagatcccatttgtcaattttggcttttgttgccattgcttttggtgttttagacctgaagtccttgcccatgcctatgtcctgaatggtaatgcctaggttttcttctagagtttttatggttttaggtctaacgtttaagtctttaatccatcttgaattaatttttgtataaggtgtaaggaaggggtccagtttcagctttctacatatggctagccagttttcccagcaccatttattaaatagggaatcctttcctcgtttctcgtttttgtcaggtttgccaaagatcagatagttgtagatatgtggcattatttctgagggctgcagtttcttttatcatcattgtcatcatcatcactgtatcatgatcatgatcatcctctcatcatgtatagcatttgttgagtgcttaggatctgccaggaactagtcaaagcactttacatttattgaatcatttaataagtacaaaaatcgtatgaagtaggtagtattactatcctcagttataggtatggatatgtagaagtatattctctcctcatgcttttttcttacctctgtatggcctcagagaacacttatagtttgaacatctccttatagatagtccatgttcccttccttattttgatctcttggaagaggccagatggttattgagtgtatgatgctatgtttatcatttatatcatcaaagttttgagttcctgaccatctctcaggatatgaacaaaacttgaggattaatttaggggatattaaaagtgtccaattctcaaacacatggatcatcatgattctttttgtcaggcactgaattagaagaagaaacacatacagcatacattgtggcatgaaagagaatgggtttctgtgtgggatatcacataatgcctcattggatgatcaaataaaggagggttagtagtgatgaactgaaaaaaaaaaaaaagattgtatgtagtatttctctgtggtagatggggccagcctggtagggtgggaggagaaggcttggcatttcacggagacagatgcttgaatggattttgcaggtggttttatgttagttcatggtgggctcattggcagatctttctttggctcttttagttcaatcctggctcaagatgacattgtgtgtctctgctggcaatatatatacaatgaccttactcaccttcccaatatttttccagtatacattataatatatttttatttaattttatctgattttaatgcagcaatttttttcttttagtttaagtttttagagaaccactttatggataaaatttccttgatgctgtatgaatcagccatcaaaatgctagggtaagaagagaaacttaggtatctgctcttttttgacttaagttaaaacatcatatgcagtaccaaagtaataaaaactaacacttgtttgagtggtcgtggaatgtcagtgtcttgagtgctttacatagtttggtgccttttaattctcacaacaatccagtgaagtgagaactataattatccccattttgccaatgaagataagaagatatggagttgtcaaataacttttctgaagctactcacaaagtagccaagtaggatttgcacccaagcctctgtctccaggacccatgctcttaaccatcacaccacctccttttgtacagttttctctaggctggatgcttcattgcacaaatcattttctattagctatcaagcacaaactgagccaaaagctctattgctaagatgcacaaaattataacttgaaattgtttttctgcattctccattttttactagcaggagaataggagaccttaatttttatttcaattagtaacattgaaatacattaaacagaatctgtggtggcagctgtgtattctcactttgacttgaaaactacattcattgatatctttttagtctttggaaagaaatttattgtccattatagctgctactgctctgaacccttttgataattgtccatgcaagagcctgttctctttcctttgagaaaataacaatggcatactgtacttcacaggtgcaaaaatgaaatgatttgctccatcatttagtttgcttaatttacagctttttatgtttaattatgtctattgttcatagattggatattgaggatccaacaaagatgatatttgaaacagctttgtaatgtcattgagtaggtcctacactgcaggatacttaaatcttttctccaattgtgacagtttggatatcctcaggggttccgagctgtcttcaattatgccagctgtcttaacgtggaatgtaaaactactattacagtggggaattaaatattatttggcccaattttacctttctagtcaacagtgaatagcatgtgcctgcatatacactgaaagcagactgtagcgcgatgtgttaatgtgctgtggatacagttttcctttataagcatttatgattccaagagaatacccatctgccactaataagttgagtaaccttgagtatgcttctttatctctctgatttctacttcttcacctataaaatgaaagcattactaaataatttggaagccatttggcatagaatcatgtaagtcttattatttggagaattttattgttctcttctctgctccctgctctgatgacctaatggagcctcagcctcacctaaggctcacctcatgactacagtttctgcaaagattggcagctatagcaagatcactgtgatctcaaacttctccctactctgttatcctcagagatgcatgtttcctgagagcttttttagaaaccagtcagaatgaaatttgcaagaatatcagattttttctttttggaactggtgtgcagcaagatttcagctgactgtttaaggtatagttctcatttgggagagcttcgtatagcacttgcaaacagaaattttaggtgatatcctggttctaaaggatggggggtggtggtggtgacttaagcccataaatccttctaagttatatttgaatgccattctaggtatgcataatttattatactattcattttatcactatccacagacatgggagaactagaaattgagggtgggataaaattttagaggagtaagaagacactgcaggacatttatggtctaaaagcctaaatatttttctagttagtcattggacatggccatatccgggcctggatgaatctcaattattttcattgatttatttaataaacaagaatttgttgtggactcagcatgtgtcccgcactgttctggactcttggaacatagaagcgaacaaggaagacaaagcctctgcccctataagacttatactaccaaaaagagttcagcactgagacgtgagcttacttcctcccgagcattatctttatgcctatatatgttaattctctccttcacttcgctcgttttcattcttggaattctatcttgtcacaaaagccaaacagatagtgcaaagttttagtatactagacaaaacattattatgttatggcttcttgcttcctgatatggtggcaataattatgattggggaagattagtgtaaagcttctgcaccaagcatagtgctgacctaaggcagtaaggtaataagtaagttaataaatgaaaaatattggatgaacctgaatttggtctgtcttcaggcttggttgtggtgtagagtaattgggaatgggtggatgcatgtgtagtttttttcagtatcatgactagagggtaatagaagaatatctacttgtactttagaaaagaggagaccttggaagtgggagtaaattcaagatacagcacaaatcaactcagaaattcctatcatttggcagttgagaaaatttgagctgaaagttttcaaatgatttgtcagaattatacagaaattccctgggcagtttttggtgctggagggctgaagtggtggtatttagcttcctcaaatttctagttttaagaaggcagtcctaaactttaacccaaaggatctctgttccttgcttttttccagctggtagtatcttatgggactcttgtggcatattttcctgcttttgctttggctgggtttctttagggtaaatcccagggagcccctcctaaccctgcattatttctagagggaaaataataaaagggttagagatgataatcactggaaattctcaaaggataatcctccccattcaatatttggccttgctccttcatggcattatatatgggtgggaaatatcagtgtgtgcatttagctttgttggtctttgagatgcttcactgcacataatgtggcactaatcatgatgctctgcccagacagatgtgtctaacctgctatctgtgcacctgagaattggcaaggtgatgtactcagcattctattataagcttatttctctaggcacttcaaaagccactaatgaaaaagtctcttctgccacctgaggcatccttttactgtttcattggtttttaaagatgatcaataggaaatactctaaaaaacactctatgtctgaagttcaaactactagattttcataagtttaggcagctctgcacaattgtaatgctctttaacttccacttgtaatcatattgaaaatgtacatgaccatattacttatgcctcaaagttaccccagtgaatattttatcctcattcatttaacagtcaaggccagttctctgtcaaacattggaaggaaacataaaatgtctttaagaagctcacatttttagaaaggaggcagaaaaagaaaacaattgagtacaatgtcataaacactacaatagatttatatactgaatattataggtttaatatggcacggcaattaatgtgcatagtgattgtcctatttcattagaaagctattaaatattttcagcattctcaattaaaaggttagggtgtatcaatgtattatagaaagagttactttaaaatgtgttaattaaagggatatgtttgagttcctggaactgtcatatttcaaatattttcttttgtatacatttctgattcgtgaagaattattttgtttatactctgctataacctaacttaagaatttacattttctggtagctagtatatgttcagtagatatctaatgaatgattgaatagttctttatatgaaaaaaataccaccatcaaaagtttaattataaagttatagcataaatgatcacagggagtttaaacccaactgtaatttggttactagatagaggcattgacttaggtgatctatgcacagaactaataaggccaaggtcaaagtttccttctttgtatgagcaagttaaatttgtgttatgaaaggcagtggggcaaagatgtttgaggatttagctaaaacaatctgattctgcaagccataggtaaaattttagaaaattggaaagagtcagaatttaaaagttaaagtaataagaacaaaggctaaaacaggaaaaagcagaatgtacctttatccttatcaggagacgccttgaatcacagtactcactttgtacttgcctgcccataccgccttccagaggaactatctactgacagacgcagtcacctcagtggacgggtgttgtttgggccacttccctgtccatagttgactgctagatttgggtggaatcttgacccaagaacagctaacacatgcttctatatgtgacctggcaccagaatttgagctgtgtatatctatgtaaacgtagagagtgaaaccataagcagtaggaacagaattagcaaagttatggctgaaattacaaagaaggagaaatcacaagaaaaagagcccggttctgcaggaagaatagagacccaatgtgagaccaaccaggccctgagagacacaaagggacagagctgccaaagctcctgaagttcgtgttagtgtctgtgtccttcagattgtgaccaccccaacatgcattcagagacacaagatttttattattgttagaggtgactaaagtgactttttgttctttgcaacacacccaaagagccaattaaaatatttacaaatgctaatttgttgctgtgaggatactaggtggaattattttaaaagatatgtgtgttagagtgtcactaccaggatatataaagaaataaaaaaatcactcaaatcccttctcctaattgccctctgcctttatatctactcctggctaggttaggtgacctctgagaactgtccatcaaactctggatatatcactatcatggcaatcaatacagctttgaaattctctgttaatgggactttatgacactattctccactagattgtaggcttttaggggtaaggttgtggattatttattcttcctgttttagtacctatagtaccaccaaaatacctagttctgagtatgttcttgaagcaggcttgctgaaaaaaattgtacctgcgcataagaaggatgctttgttattaaataaactgatttaaatacttttttttttcccccaaaatcaaccataggtatatgtgaccactcaaaactgaatagataatatgtgatggagctgtggtataactcagtgatcttacagctacatagaaaagattttaaaatagtgaattgcaagtaaatttaatttccacataattcctgattaacttttatattgacagttgggaaacattagagaaaaacgttagtaaagttgaaggaaatatgctgttcagactccttttaccattaacaaagtagtttttaggtttccttctccaccagaggttgatatttggattttactgcttctgttatggtaaccccttttacttttatgctagtgcctcaaaagaaaagtcctgttagtcttcagagtaaatgagcttttcacacagtaactgggctatgcagaggtgtgctgtgccgggaagtatagctagtgccaagccacttctctgttgtaattatagggtcgttgggaaggttagtggaccttatccccttatggcaagcagcacacatgtgaagcctctcttgattttcagaaaacatctggctcagtagttcttggctcttcctttcaatgtcaagtttgacatatttgcatatgaaacatgtagatatttcagactaactcctatatccagaggaatagggacttcaatgatactcaggaaaaaggcacatatagaatttaaaaatttcatctaaaattttatgtaatagtctttctattgggtacattatttccctctaaaaagagaatttataaagcatatttacttaattcagaattataatgtttgtagaaattttaaatatgaattgtttcattaaatgttactttttcaattacattttcatgagtcaatctataaagtggaaaaacattatgcatttgatctttttgattgcattactcaatttttttatctgtttctattgaggtaaatgcaaataaaaacataggttatgagtggagaattttgacaaaaatgtcttatgatggggtaataaattcctaactaaccacaaggacactgtgtattaatataagaaagaaaaccaaaataaattacttagtaatgaaggagaaagaagacaataagaccaatgttatgaatggaacttagacactgaagttttcagtaatttattacaatctttaatgttaacattttgtcagtaggctctcttgaattactacatttttatttttagtgattatatatatcacagatgcgtctctaaatgcaaatatctttatatctccataaatgctcataaagacatgacattttgaaaattatccgaaggtatctttttctataaaattttaaaataatgaacatgtaatcttattgagttttcgtagggttattagcagatttcactaatattatacatatttttaagttgatttgtcaagaaatacaacaattgcactatgtaatatattggtaatttttttttttttttttttttttttttttttgagaccgagtctcgctctgtcgcccaggctggagtgcagtggcgcgatctcggctcactgcaagctccgccttccaggttcacgccattctcctgcctcagcctcccgagatatattggtaatttttaaaaaattgtttcacaaaatgaacagctgttcatttgtattttatttttttaaatgttcaattatagaagaaacatgccaaaggaaaattattgaactataagaagttattattgataatagctgccatttattaagagcttaccctatgctacatttcttattaatgttttacacacagcagattgttttatcctcataacaaacctgtgagattgctgctgttattcgcattgcacaaaagaggtaacaggtgtgggatatggtaagcacctggccaagatcacttagcttgtaaatagtgaattgagtattcaaacaggtcggtttaatgccaaacctcaggctcttaaccattctgctgtatttcagagacttcttaatggtgatatttttaaaaagataaataatttggtgaatttgtggtactttacaatggattagagtaagtaaaaatatttatgtcattgaagtttgaataaatatttctatacagtacctaaattatttttacttcacatcactgttttttaaagctgtttaaaaaaaaactctcttttaggtgtttcattctctatatatttaacccacatttttctacaaaaggtagttttaaatgcttagaaagttggctttggaatgaatatagtctaatatttgaaaataataaaaactgattataataaacatgttcataacatgcactgttaattattctttccagatttctactgactttaaattttttggcttttattgttagaccattcaagtaccacgaaaataacaggtgataaatttgactctcaatcagcgtaagatcctgaagttttgtttattgcaaagataaagtgaagatttatatggttttgttgttaagggcaatttttaaaaaatatctctgggttattaaactagttcatggtttatacagctctctattaactgagatgttttgttaactaaacacctattatgcacaaaagagatgtgaggcttattattttgctacttaaccacagaactttcaaatacttgtgttacagtttaataaagtggggttttcttttatttctagataatacaatcatgtagccttcttttcttgtccatcccatttttaaatatttgcttttctaactcctactcatgttcagcaacatacgcaccccttattcacagaagccgctctataagaatagaagtctcttagtttttcccatctatgacagaaaatttctactgagatactttctttctttttactaacttctcatctgagaaggaattgttcctgttttccttcagctacctgttcatttagcaccaatgccttctttatctctccctaacattacacaatcatgcctattatttcactgcttatgtatattctctcagcttataaatttgatcaagatttccctgttttaaaattccttcccttattcattggctgaactgcaggaaacttttggttttcttaaagttactctctcatacctcaactgcccttcggtagcaaattgtagacacagtgatcttcagtttttcttctctaattaccacccacttcttcctgagtcctttattatctggcttctacccacagcactaaagtgcaattgtttttctaaaggtcatttcttccttctaaatagccaaatctagcttcttaatctctgctctcattctactcaaccatgcagaaggctgtatcattactgtccacttgagctttccacattcaataaacattctttaggtgttgactaggtggtaggccttcgggtttagaagatggctaaggcccgcatatgccaacctggagtttccatttaaatggaggagacatacacaaaaccaactaccatacagggagctgagtgctctaacacaactgtgtgacaagtaagacaatgtggggcaaagagtggagaaactttcacagaggaagtggtatttgaaagaattagcggagagtgagaactctaggtatattaagttcccttgtactatacaagggaacacagaattgggaacaagtacagcgtgttttggaaatagtgtggttataacacctgggaatgtggtaggggtgggtgtatggtgggaatttggaaatagtttagggttgaattgtccagatttaaaacttctttccattggctttgttcctcccctttgcttcttttttttttttctatgttgactgctagttttcagacaattttcttcaaaaacatttcttctttcatgtgaagtcattctatgttctgtcccaagtgatattgtctactttgtgtcttcaaccattatattttgcacattgcagttgtctaaaatcttcctgtccctgatgacctctcttttgagtgccaaatgtgattttttttctttttctgtatgtcaattcacctcaaaccagatatggtaaaaataaaacagatcaccgtatatttatgactctttgctatttctgtattctttatctcgttcattatctccaccttccttttggttaccaagaggaggtattatactaatttttacttcctctgtctagatgacccctaacatccagtcagtcattctcttaaaatacttgctgtgtcttctgatccctattttcatactcatttagtttatgccatcacatttttgtcagaattagtatttaagtattttaatgattatttcactacctgcagcctcttctccagtttttttttataccagagttaaaatatagtttaagtaaatatagctaagtgtatttaataagttatagtctaagttattttttcaaaatcttccatattattcagttatctacagaataaaatccaactttgacacggtccaggactgaagctctctataatcttgtaacaacctatgtttccagtcctaaaattccccacataagtattcctactctatatgccttcaattcattgaatgattaattgcaacctctcatttaaattttaatgctccttaggttgaccataggtatttaagttatttggagattacaattatatgtgacagatttatttaactgtaagtatctaaaagacagggacttcactatatttacaatcagctactcccaagaaggttgggaacataatgcttttcaaatatttattatttaatacctccatccttaactgccttataattttaatagcaatgaaagagaaattccttctttgtaaattacacatatttgtgatttccttgagtctctttcccttttccaccaaataatcaatctgatttagctgtcacacacacccccacacatccatatgctttgaatacaactgctggttttacttacttcatagttcagtgtgaaaggctctgcagtagatagataaatacaaatacaagttgtggggtgatatgatgatagaagaaagtccacagtttttgagatcctatagcagagtcagctaaatcagattgataatttggtaatgggcaaagggtatatggacaaagcacaaattctagaagatttttccaacttgatgaagcttcatagcagaggaataggtcagctgattcgatgtgatattaaacaaatggttaggaattagtttttagagtagaactgtagtccttagaacccaatacccctctccagtattgccaacaataaacaatttgtggaagagcatcactcgcctccatcagacgagtgtcaagagactgtggtagattgttctaatattctaagtttattttcctttactagtctgcagtggattttatcttgaaaatattttttataattttataacatatgataagaattggattttataaattaaccaattaatgggcaattttgtagttacttttatttgtagtaaaaatatattttaggtttttagggttagtgatctgtgagtggctcttaagtatattcagtcttaaaaaagttaaagatcgtgtattattgtttccaatgccagtatagcattttcaccatcttgacaatatttattccagtcttgccatcttacaacttggtttggttatcatttggaagcacattgtagataattagaaactggacatttaaaaaaaattgataattaaacaacaatatatactgttaaaactgcacactgattattggcaaatatttcagaagacataatttaagtaattcagctgctctaaattctttaaggtaacttgatgccctttgtatcagtaaattttttttcctttcaaagcaaagaaaaaaaacaaaatcataaatggaaaaaatacctcatgaaatctcactatttgtcaacttcattttaaatcacattattgctaacagttccaaacttgccatttctattcatttctcatcatcactgtgctagcaaaaatcctaccacagttaatgttttgaagaatatagacttgggaaaataaatgtaaaaggctaatgtctatgctagagagaatgagagataaattaggcttggttatacatgcctttattggttattcattgaggacctcagctatgggccaggcactggcctaagtaatgagacaaaagatagcaaacatagaccccagcagcagattttttcatatgaagtttcaatatatttagtgtattcttttgttaaagaatataaaaaaagtctcttaggaagctatgtgtttgatgtttgagataacttgtccaaagatgaaggtcaaggaagttcatttaagaaaggtgacattcagctggtcttagagcatgtatagagtttgtaatgggcttaaaaggattccagtccaagaaaaatcatgaggaaatttacagaattgggagctaaaaaagtagatctcatggaggcagagaatgtaatagtggttaccaaagactgggaggggaagagagaagggggggatgaaaagaagttggttaagggatataaaaatacaattagatagaaggaataagttccagtatttgattgtatagtagggaagttataattaacaataatttattatagatttcaaaatagctagaaaagaagaattatgagatgatggatatcccaattactatgatttggtcattacacattgtgtatgcatatcaaaatattacatgcactcccagaatgtgggcaactattatatatcaataaaaatacagaaaaaaaagaggatacactggaggaaaaatctgctgaacttgaggactagaagggaaatcattaggcatgcaagagggagtaattggacttgggtgtttggaatttgggaaggggttatagaaatatttcacaatataaggaattcaagacaaaaatattttggacaaagattagagtttaatttttgggtcatgtagtttccagcatgcctggggcaccgagtgaaggtgtccagtgggtagatagatattaaaaatcagagaacattagatttatctgagctagaaaaaatatgtgggggtcatccttataaaaggatggtttaaattagttgtagtatagatagtggtcaagaaacattaccttgaattagtggttattatccccactaacctgacagaactgcagaaaacaatggcaaagctttatgcctgtccttattttaattttggctcagtgcatgtctgtgaaaaggggggaaatctattgtattctctcatgccccttccaagttagctctcagaaatagtcagaaaataaaataatttagatctgctatcattccctaaaaaaaaaactttaggggagcttttatcctgatttttacttgactcatggtggcttattctccaggatgacagatgacagttctgtcataatggacacggcatcacacagtttgagtttttgtttgtttgttttctgagacggagtctcactctgttgcccaagctggaatgcagtggcctgatcttagctcactgcaacctctgcctcctgaattcaagtgattctcctgcttgagcctcctgagtagctgggattacaggcatgcaccaccaggcctggctaatttttgtagttttttttagtagatatggggtttcttcatgttggccaggctggtcttgaatttctgatctcaagtgatccgcctgcctcggcctcccaaagtgctggcattacaggtgtgagccaccgtgcccggccagtttgagattttagcagctgtttgggtgcaagtttcttctctgagcccataattcccattatatctatccttgaatgttcttctgatgattaaatgatgtaatatatgtaaaacatcaagttgagtgccatatactcaacaatgatatttcccatctctttttcaagacaacacttttagtagcactttaataatttacttttcacatacttgaattagaatatctatctgtggtctctgtaattttcattttggttctgtgtaatgatactttttaaacaaaactagtagatatgaggaaaggggcagtgaagctttataagctgctatgcttgcaatggggctgtaccttctctcactaagacatcaaattcactaaaaaatatgtttgatagggcagctgctcctaccagctttttgagaattccatcagttttcatccttgattattttgcctgctcctgatgaaataatattccttttttcacctgctaatatgcgacacatgtttttaagcacaatgaactagacaagtgaaaactgaggcatgaaggataagacagtgaaccatcaggcagggcttctttctttaattgtgctttttggttctattaagtatcttataatgataaattattgagaattgtaaaagatcaaaacacatgttctgagagcagaaaatatatattttttcactgaaaacatagttttaatcataaatgaaaggaagcaaatatttccaaaaaacatcttaataattcgattcagatttgttgaaacattgtgttgtcctatattgtaccatgtagagcattcattttaataatttaacttcagctggatgctttccaatgatgtacttaggtacttacataattagaaaaatcagtgatttttgcaaatgcttttacccctttatcccacacaatttttccatttaaaaatatttttaaaggctgaatatctgaattttaagtgagatttgataaattataaatgtcacaggaaaaatataaggcatcatactttacatttttgtgtaaaacattttaaaattggaatttggaataataggactatctaatatttgtatgatgttttaaagtgtaaagtaccttttcatctacattatctaaacactcttcctgtaaaccctatgaagttgacttggagagccattatccttgtctttctgattttagcacattttagtcttccattattttcttttatgggaaaaacaaaaaaaaataagctttaatactttaaaaaatgcaacaaacaatacaaaaatttaatagaagagatgtaatattcaatatttctattttaccatactatttatgaatattacagtaaactacttcagtatttgcttaatatgtgcatcttggatccacccgccaaggctgaatacaaaatacaacacacctatttttttacattcaaattatcattaggctaattgctagaagtcatgtctcctcaagtcacgtttaagctggttttaagaggtttctagtgttctgcttcatgtgtgttaaaacaagcatttacatttctttcttattttgttacaatactgcgtccactaacaatgacccccagaagaacgctattctcttgtgcacagctgtggcatggggatggaatgagtgaggctctctctttgaacacttctgtaaaaacttgggacactttcctacttcttcacagcaaaattaagatcaggtcacagacagaagtgagactgtatcaaagcctttttgaaaatataagaaagaataactgagtgtaacatcaactgaaatggcaaaggttcatctcaagagccagatgcccaacctgaattcaagttgctcactgtgcctgtatgtctagcaaagacaccaggcaggagtcggctttctccctaatgtaagtatttcaaatgtctacttgccttggagagttgaccaaactgtcatctcattttctaccagacactgggaagaagttaaggtgcctccttgcgctatataaaccccactgcacttctccaccagattaacttcttcatcatattattcctttcaggggaatttcctacctcacagctccttcagcatatgatctggtaccatggatccaatgtgatcctcttggtgcaaagtaacatttcccaaactcttgatttgttcagattaaaggaacatgtgtatgggacaatagcactccgatgtatgttacactctgccaatacaacactgttcattccattcattctgtagggtgagggaatggagcctcatgattatactctctctccctcctgcaatagtctcatccatattccccaaaatgttacaaaaaaatatgtctcaggaatgaggctacttaaatctagacttttaagatttaggaggaatatatttaacataatgtacaggggctggattgtcctgaaagatgtgccaattacattaccaaacagaacacattccatttcggtctgaaacatctgcacttgatttacctcatggtattcagaccttccccaaaagaagtatatatagagctctaagagaaaaataggcccttctaaagtggttcctcgaacaacaagggattagttggttaccagtataattctgccaatctttatcctagaagcagaaaatattgatgactcttaaaacacacttttcccaacctttgtaaagaaagtgtttggttcagtctttaccagtcagcacaatatatttatttttaaattctctaatttttctactttgaagagtttctaaatgaatataattctaaagataaagtgcatttttatatgttctttgaattattcagttcacctgagtgtaaaatatgacaatggtgatgtaaatgtattcactccacttccttttttagtgtgcaaattatttaacaaagaagattgcattgaatgtataaacagtgaggaaagaaactactaaaagaaatttcatgtcaataaataaatatttactactttattttagggattagatttaatcaaattctacctgtgtcagaaatccatatgcagttgacccttgaacaatgcaggggataggggtgctgacccccacacagttgaaaattcatgtataacttttgactcctctaaaatgtaactactatttacctattgttgaccagaagacttaacaataacatgaacagtagattaacacatattttgtgtattatatgttaccaatataattctgccaatctttatctttatatacctattttatatatatatatatatgtgtatatatatatatatatatatataagcaaactagagaaaagaaactgttattaaaattataagaaagagaaaatatatttactatttaagtagatagtggatcattgtaaaggttctcatccttgtcatcttcatactgagtaagctgaaaaggaggaggaagaggaggggttggtcttgctgtctcaggggtgacagaggtgaaagaaagtctacatgtaagaggatctgtgcaggtgcaaacccatgttgttcaagagccaactgtacaagtgttctgtcttcttaaatgaagccaattttggtaagtgtgatcataatacatatgaaaacatgtagtgtatattttgaaatcttaagtttgatctgttggcagaatgtgactagattaaacttcaaatgtattgaagaaaatactttctgagggaatactatgtggaaagatatcactacagctacttacttgtgttcacataaaaacatctagctgtatgcagactttctcctttaaaaaattttctcctttaacaaatttttaaatttctaaatatttaaaaaagagtcttgccttaaaatttttagtataacaattttgaatttcaagaaattagaatctgaattgttaataaaagtcaaactaagaaacaacaactttactaatgtatctttccatagtatattcatccagtctaaaaatgaaaaaatttcaaatatcattagtataaccaaaaggtcttatgttactttatcagttattagccatttcaaaatcaatcagtgaattaagtaaaacaagaaaatttttttattctctatataaatttttatataatagacatatgtatgcctattatatataatataaatgtctattatatatgatagactttatataataggcatatacatataatagacattttatgatagacatatatacatatattcagatatgtatacatatatacatgtctattaaatacatacattttctataatagacaaatataaatgtaatagacatttatatatgtatatatgactatcatataaaatatatatctattaaataaaaatttctttgggagacattttaaaaattacagagcgaggaagctagaaagctctgtaatttttagtgtatcatcaatataaaggtcagaaactgttttacctacaaacatatatttcattgtattttctgagtgccctgtccactgtagtaggcaccttaaatattttttgatggcattcatgatgggaaatgttatatttattttgcgattttcttatagtttgattcttgttcattcacattctttctatcttatttcaagattccatgatctctcttgtcatattgtagtactttctaaatcattttatatctcaaaaagtcttttgtttccaatgcatcttacaagataaatgccatattaacttcacaaatgcaaatctgtcatgtcactgacttctttaaagactccaagcattcttcattttttttctaaatttacatcaaatctcaaaactgatattatcttttattgcttaggtgttacctgtttttcctctatagcacatattttctttatcaacttcacattctgggcaaatggaataacatcctgtttcataaacttactctcaagaatcattctaagtccagctataatgctgccagcttcagaaattctttagaaacagagttggtgtttgagttgcctacctgtttggaatctaaaccttaatcaataaagttacacttctgtttcttagagaggtaaccagggttattttgtggaagagcatggtaggttcatcccatatgtcaacttattgaatactaccatcctgaatccattattaactcatcttctgaatttgcttatacaagtatcattttgttctttactgtctaaaataattatttaccatcataagataatttttataaaacaaataggagaaaactaattttaccttttaaaataatatgccacttgtagatgtagaatacaaaggcaaatatttagatgtaaagcataatttaatattcttgtttctaaccagtatgaactttattgatcttattaactttgtaaaaataatcttgggagaattgtatagaatatatgttgtttatcttagtaaatgacaaaaagaagtacttttgtgtttaagtagcttttttgtcaaattaataatactaaacataagtgttaatcttttcttttccaaactatttcacatcattttttcatttgattttctcagctctctgtactgtactataaggcatgtttctgctcaacattctacattgagcataaacaaggactaatgccaaggtaacctaaatcctttgtgcttctttgggcacttgacatgctcacaaccatgggtaccatttctattaaatgcaattatctaattggaaaagttgcaaataatctgatgagtgagaaatgcagattcaatcaagtctcagcttactaccactgattataatataaatcctggtttgagcctaacccttttacatgactatcccttcttctgtttatctactttactaaacaatgtcctctagcatatagactgtacttgtatcctaaagaaatcttagaattgcatctggttataagaggatgaataataaatgtaatttgaagatgtaaatgatgctactaaggattttaaactcttggtaatcttactgtgcaatgcaaatgtcaaccataaaatttatttttatagccttgtgaccatttctaactatcttaaaagttattaaaatttgccttcaacacatttttatttaggtgattttttggttatttaaaaattattttaaaactttttggttttttaaaaattctgataacgagtctatccagtcacatatgaaagtctacagaaaatagtgcagcatgcaactacattattctacagcaatggaagctgtcatataactatgttccttttcacatgaaaataaacttgcctggagtcctgtgtttcaacagaccattacagagctggagtaggaggcaattacaaagacaaggaccctccatgaaaaagtcttgctttgagagccataatattcacgtttgtccctagctgtgagtataaaccaatggaggagagacttctgaaattgcaaagacacatacattctgtacaaaatcatagctttgttattctgagtcctttgtaacaaatataggttacatgaactttagcctcccagatagttttaattttaattcaaaaaaaccctactttttagtattgaaaagtataaacgataaacatttaatcacataaattatataagggaaaaataaaattaagcaaaaatgctaacagtctcaaaaggtatttttaaaattataatattataaataaagcttttaaaagtaattaagtagatgttaaactttatgatccaaacggaactacattcccaatagaagttcttttatggctgataccttgaaatctacacaggaagtaaataatctgcttagtaaatttataaatataaatattataaagctgagtggcttaactttattgctgaattattccaaatatatttagtgtgtttgtaaacacatgtatatctagtgatatacatgtacgaggatctaatttttatacatttttactatacctcatatatgttacccaaataatagtccagggaattctttatgtttatgttgatatttctatccaaagaataaccaaatattaatttaaacaaaaacgctaattgcttatgaaaaatagatattaattagagtacatctttagcctcctaaatcctttcggaaggaatgattgtaataaggtgagtaaattcctagataactaaaggttaacctcctctgcctggatatatttattttaaatactattgctggaaatctttttgaattactttctttcttgccttcttaaataaatagtacattgagtttaacacaaacatttcttattgaatcagagtaatctttgaactttgtttattgtgaagcactaaagcttcagctacttgtagtaatatagatagaatggaaaatgcaatcaaatggctatgatgcttgaaacatgcaaaaactgcttaagactgtcttcctcagtagttgatattagtgcagtgggtgagagagcagcctttgaaaacatataggctcaagtttgaatctcagtcctcccacttccatgatctctatacagtttgggaaagatcattttaccgctacaaaatttacttttctatctggtaaacttggggtaatattaatcttgtagggtaagtataaggaatgaatatgataatctatgtaaatcacttgagccttctggcatttaataaatgctcaagaaatggtgatgatattctacaagcagcagatagtgagagcagtgtgaaaactagagaaggacaaatcaggataaataaagatagagtttcattctcctttgtcactcctcctatctttcttcctttcttttctgcccagcctcccccttctccccctgccagctccctctctgaagggacaatatggtctccagtgagggatgtcccaaatgcaggacacatctttgagtaccttattgaaaaattaaatggcagttcacctaagaagttcttccatgtacctaaacttggaggatcatcgatagaaccactaatttgagttactcttccttgctggacatgatttgccctgacttgaatgccaacactttagcagatatttgcacatgtctgatcaaggtcaaacctttccctgtggtctcagaagagtgaacttggctgacctccagggccttggatgggagtcttgactttattgacagttgagtaactttctcaggccaatggagggaagacttgtttggaaggatgattaatccttattaacttttccgtgaaaatgacatgaaaaggtaaattaaatgccaagtctactgtggtctgttgtgaagggagcttttgtttaatcttgttttcttcttctagcattatttaatttaattgaaaggatagttcttgtgatttttctgtagagtttgattaaatattctaggctgctatgtgcagtattttgtgtatgtgagatttagatattttggagtatcttagaaaactgtcatcttagaattaggttgctatttaaaaataaacagtttgcaaaaatgaaagcaatatcctttaacttgcatgtttagtcacagtgatcagtattgatatgtttgttaaaaacagttggtttacacgtgccatgatggtttgctgcacccatcaccccaacatctacattaggtatatctcctactgctatcacagaatataaagtactataataataataaaaataataaaaactgattagtaacataaaaaaagattggtcattttcttagtgccatgttttcaattcacatttattttatcttttcactgatgagtttgcattaattttgcaaaaattttgccatgtgtttttaattcatatttagtttatcttttcactgatgagtttgcattaattttgcaaagggaacaactaaattgattctgtgcaagaaaggtattttatttccctttacttctccaaaatatctagtgattctggcctggaaatgctttaacccaaattttatagcttaataaattaaaagagcatatatgatgatgatgtttttaaaattgagtataaatactttctgcagataatttgtagaactgtgcctacttgaagatggcctatatttcctaaattcaggaaatcagtagggaactaccaaaatcaattgtaaatggtattaaaagggaataattaataatataaaagttaaattatctctgatagaaaataaactgtcatggacatctatacataaccatgcagaacatatctgtatataacaaaatctcatgcaataatatgataactgtaaatataaatgcttacaaaacagaaaaaaggtggaagattacacaaagtatttgaaagtctatcatcttcaaaccagtgttcttattgtctgctgccagagtatatactgttacaggccaatctttatttttgtgattctcaacactgttgatcttgattactattctgtatcttttttaatgattttttgttactttctagctttgtcatttaaaaaaagttgcttttttattttaataaaaaattcttacacagatattagcagccacagaggtacttctttttagcaaacaaattatcacaatatttggtagcaaattctttctaatgcctttttatgttctccttggtgcttaacgggtacttttatttttcttatttttaactctgaaacagtatatttctaccacttcctcataccaccgctctttctcccatcataattatttctgagtttgcaatcattgtgataacactagtttttgttgttaatgttttactgtaagtgtgcgtaatacaatatgctataagcattttaaatacttgtgctaaactgaagccaaattcaatttatgattaaaaagaggggaacaaataaaagtagaataggaaatgctttgccatcacaaggccaaggttagttgttttgatttcttgcttaaagataaaaatgtattgtagatgtgtgttccttttagagtgactcaagcataaggggaagtagagactttctatgctgtagttcaaaacgtaccctgagttattgtgtttctcaaggcatctgtactattttctaccatagaaattattttcttgtacttggcctcagtttctttttttttttttttttttagaatcactttaaggtgttttgttgttgttgttattgttgtttattatttatttatttatttatttatttatttatttatttattttctgagacagagtctgtctccgtcatccaggcccaggctgcactgcagtgacacgaccttggctccctgcaacctctgcctcccaggttcaagaggttcttgcctcagcctcctgagtagctgggattacaggtgcctgccaccattcccggcttatttttgtatttttactagagatgggtttcactgtgttggccaggccggtctcaaactcctgacctcaagtgatccaccttcctcggcctcccaaagtgctggaattacaggggtgagccaccacacccagacactttaagtttgataattcacgtgtggtgatggttgtgatgtctggtggtgcttagtgaaggtgttgcctactacaagtttttggcataaaggaagacctcaaactttgctcgaatcatcttttattgtctatgtttgtcttttgtagtttactcagacatgcttggggttggttagactactggtcatagattgctcaggagcagatttcaccttgagcaaccaggaggcagcatgttgatggggacaaaagcagtctgaagaaacaaagctaattgttgaaagaagccacaggccttgagatacacattcctctttaattattttgcagagaatcagctctaatactcacgttgtttcataatccagttcttttccttctggaggatttctatcattttcactcatctgtaaacaaattccaaaattagttttattcatttctaaatctctggggctcagcaaagtgttggatacattgtgacaaaatatttgtgatagatctatttctgctgaatctgactccttcattttatatacttatttttttccagggtgttcatttttacagaccacttgaattctttcattggacaccacaggggctcatgtaacctgtaaatacaaataagccttcagtatttaaccaatataaattgagaattccctaattctctacaacaaaagtgacaacaaaagtgggggtgtttttcttcttttatggtagaatttaaaagcttgttctagagaaattttcctttaatttataaaaatcttttgtcagtaatattaaactctaactagacttgatgttttttctccctaagaaatcatgtaacttgcacgcagttaccatcatgtcactctttttacttctctttaatgcactcaaaattttaatttatactgagaatagaattttaggtcttgattgtattttctattgagattatatataaaaatatttcatgatacataaaatggaaggaaatgttttgaaggataaattataggtgtttatatatactgtttattaaaaatacaaggataatacaaagcaactgaaaattttaaaacagcaaatgtgagcttgaattttagttgaggtaactgttgtataaataagctgttaaagtgtatatatatacactgtatatatttatatatttaatatattatgaatatatgataaataaaaatatataattatatatacttatatataaatatataaagtgtatatatacactttagcagcttatttatacaacagttatgtatgtatatatatttctaaagagcactaatgtaagattttaacccttttttttaagaaggaaaaacaaacatgtaaatgaagagttctatacccaatttttagacaataaaatataccatggcaaaaaaattgacgaattgtaatgcccagtttgcactttaagttattaataattctcatctctgtgttttcggactacctactaccagcatgtacagggcttgcttttgtaaagacaaatacaaagcagaatgctactctaagtattataaaacctgtttactcggatattttaatagaaaagaatgtgaatctagaatggcaaatttaaggctaaatttaagatttaagtctaaggtgtaaaataacagatattatgtggtaacctatttttaataaattcaactattaagttagctatcattaggctttcagatatataatttagaataatatatttaatacaaaatttttatgtttattgaaaatgctgttcttatatgctggggaaattctattgaaataaatacctctaacaatattatcaagagttacttctttcaaatgcaaatatgttgcacctactaaaagtgtttggcataatattgtcatatgatttaatatttatttaatattgtcatatgatttattcatattttagaataattttattgcctcttacctgtaatatatgccactttattttcattattttcaaagataagggataggtacaacgaaattctccccaactctcaaaaaattaagttcctctatgatagatggtaacattgtactaagatagtagtaagtaatattacattaattcagtgcatacaatttatagatataatactattcaaataaattacaaatgtaatagttttctaatttttttgtagcagaccaagtttttaattaacatgggcagaaaaattagacattactttctgaaaaaaaggtttatttaaataaaatctaataagtatatgtaggaaatagcataaagtctgtaacatttatattgtctccattcagcagtttttgagacatttctgtggagtaaccattctacattagtaaatataactgttttgttgttaatctgaaactaaacatatctgaatatggctttcttgcatattgggtggttttgttgaatcatgatttcacctagaaaatatagatagtgttctgttgcttaattctattagttgaatatatttctgggactctctcaaagacatggtaattttgtttttatttttatgaaaaccattaagccttagctttataatctttacaccgtaaaccataagattaatttctgagctttgcggctggtctaactttgcattaattgtcttaaattaacatctgcagcctggtctgcatgttctgtcatcattatttctgtttccattcatgcccacacctggcatttaaaggttccttttttgtgtaacctatgtaagaattgatttttccacctcatcaccccatgttctttcaatttagagatttttctggaaagcctagttagtaaataattgtcagacagctaaacaaccaagatgtttgagtctagaatttgtgtatttaatagggcatatgatataataaacatgtttgaaattatattatcatattatgatatatgatattatgataggatattatatcacattaaacatgtatattggggtgtttcttttagtatatcaaatttccacacattttctacaggatgctcagctaccactgataaggaaggaaaaacatgtctctaagcactttcaatatcagcaggtattggcagtgggtacaaggaagtcactatttccaagggacatttcaaaccaggactcttgctctaaatttttgagcctgaaagaattttggaaatctgcatgaaagtctcagtcaatgctattatcatggtggcatttatgatgtttatgaggtgataattgttaagacatcaaaacctaatattcctctgggatgaatacaagttataaaattaataaaatcaatattcttttttttccttttgcccagaggaaattactatttatattatgtaagtatgatccaccctggcatttgtatgcaggaaactgatgtgtttaccaagatttttaagaaaatatctaaggtgatacacatggcaaatatctgtcacattatgcatagaaatgaatttttatattggttttcaaatgctaagttaagctcttttgttatttttctaccagaatcaaacatatttaggtatctatttaagaaaaatggcatatatgtattacttttctgtgtaaatgaggagaattgctgacaaacataaggcacctgaacataaaaaatttttgctgcctgcttgctgattttctaaatgtacacttttatctaagtgttttgttgtggcaagtactagagagacacaaacaagatccatttcaggaaaaaaaaaatgtccttgtagtacatagcggaggccacattgaataaacatataatgaacacatcatgtttttatatctcgtaatctaatcagattgtctttagaagcaaatgataaggatttcaaccttgcttaagaaaggtctttatagtggtgcttagggaataaatgtttgatttcttaaagatgtcattagatatcaagtaatagactaatgattagattttgtttgctttctttgatatctgggttacagttagttgcatatggatacaaaaaaaaaacaacaacatcaggctaaatgtaactttgcatctgacatagggagttcttaaagaaaactaattacttgaccctttttgcactataaggaattttaattaaagtgactttttttatttgttaggtcagcaatatgtcataaaaagctatatgaatggtagtaaataacataataacagcattcattgaatgcttttaaatgacacaatatttttatgagaacattctctaaatcatgaaaattaattaaaaaaatatttagagtaatttttgtattctcagaaaccatattttttcttctaaataagaaaataatctgtcaacctcaaattagaacacctataattctatgagccttcaatccaaatattaaagttttaatataaagtcaagtattttacaaaaatagtcaataaaacaagagtgttggctatttagagtacacatagtggatctgtttatcttaaacagtgttatgaatcaacataggtcaacagaatgaaccagaagaatgcatgactttaaaagtttattttccttgagaagatgataaagtacttactaaaatattacccaggtctctccttacattgcgtgaatcttaggaaaatataagttaacacaatgtatattcatttcctttattcaagcagccttgagagagaagggaccaaaggaaagatgccattaatctaatgaatgaagagctcctgtgttcctggggaatggggaatggatgggaacaacgtagaaggtgaggtgggaatgcctacgaaaggttgaagtctagatcacaaacttggctcccagcatgcactggcagctcatccatgcagtgtgatggatgacactccaaacccgattcttcacctcacgttctcccttagaaaggaatgagacttgcgtcttgatccaggaaagaacatctgtaccctagaagccattggctatatttattttcaacagtgcatttcattacagccagggatgcacaggtttatttattcataacactaaatgctctccattccctcttttcctggctaatataaaagtgtgcccaatttagaagaaatgaacaagagagtactgaaatatgccctctgtgtattactgaagggatcccaggaacacttcagcagtaccaggttaaatctgaactctgcctatgtattttctataatgttgaaaattggaagaacaaaatagtcttggcattgaactgacatttcattttgtttgagtctcagttccactttataaaagagcaccacaagccggaaagcaaccagcttagattggtatgtgtgctggtgccaagagagctaatcagagtctagcatatggggcatttgaacaaggaaatggatgttaactatctggttgtgcatttggactgcttcagaatcatttgggttttgcttggtaatctgagaggtagccaggaggggatagaacagctgtggccactctacctgtaagtgccttaattacaccctttggccttcccaccttccccacctgaatattcctctttggcttcatggggtgcttttctaaactgcctaagaactatttgatgaaggctcatttctagattcaggaataaaattgttgttgatgtcctacattcaaattcagtgaacatttattgaatatctactatacatccagcaacatataaattccatccattgagatgcaaaataaaacagttttcaaaagcaattctgaagcctgatcatactggtttgaatcacaactcctaccattttctgaggtgtgactgcaggcatttaacttctttagatgtgtttcattttcctaatctgtaaaatgtaacagaagttagcaaaatattgttaaataaataaagtaaatgtaggttatatgtgtgtacttagaccaacactaggcacattaaaagcacatagtaaatgcctgatgtcacacacacacacacactcccttgatcagtataatatctcttgttatacatatagtgttattctccttttgctgataagagaactgagagtcaaagaaatgaagtatatattcccatggtcatgaacttagaaagcagcagttaagattcaaaatgaaggttgtatatttcatgattcattttcttttcataataccataataactttaaggtatttccatctctagtcaggaagattgcttccaaaatgctctgcagacagtttcatcatgctctcttttcttttctctttgtctctttatctttctttatcttttatttcttttttttctttctttctttcgctttctctcttttttctttttctttctctttctttctttttctttttcttctctgcaatggctgtcctcacttagtctatctttctaacagtttaaaagatacatttgggccgggcatggtggatcatgcctgtaatcccagcactttgggaggccaaggcgggtggatcacaaggtcaagagatcaaggccatccttgccaacatggcgaaaccccatctctactaaaaatacaaaaattagttgggtgtggtggtgtgcacctgttgtcccagctactcaggaggctgaggcaggagaatcacttgaacccaggaggcggaggttgcagtgagccgagatcatgccactgaactccaacctggcaacagagcgagactgtgtcttaaaaaaaaaaaaaaaaaaagaaatgcatttgataccctttcttctggaaacattgtcttctctgggcttctacagtcccattcttttttaaattcctttccaactttatgactacttcttctcatcctcctttgggagtcttccttaatttatcactacattttggaaagccccaaggcttgaagtccttggacttcttcacatcttattctacaactttttttctcaaatgattgtatctaattctcgtaactttaaatactgccacaatctgatgacttcctaattagtatctcatctctggctaatgccctataatatagattcttacagccaactttctctatgacatctcaaactgaactctttattttattcccagccaacctggagattttgtttggctggttggttcttttgttggttggtttttttggaatcttccctgatttaacaaatggctacccaacctcccaactgtacaggccagaaacatttgaagtcatttttaaattgtctctttcccctataccccatgtgtgatctgttagtcaaatctgtcagctctaccttacagttatgtccagaatctgaccatttttcaccacctcttccactaccttcctactctaagccactattatttcacatctccattattacaggagcctcccattagttcacctgcatctatccattgtttcttttgaacacaatattcaaagtgattcttttaaagtgtgaatggcactatagcattcttctggaaaaagtcaaaatcccaacaagcacctctaaggccctaactaacccccacttcccacccgaacctctctgccctaagttcctaccatctttctcttcctttctcagcctctgtgacctccttgccctttcttggaaatgccaggcatgctcctgcctctgggagtttacactttgctgttccttttaccaggaatgcacttccttcagttatctgcatagttccctctcaattcccctcatctatgcctattctccaatgctaccttctcagtgatgatttgcatgatcattctattaaaattactgcccaactcctagcactcctaatttttcttctgtgctttatttttctccataacaataattaccctctctcatcctctatattttacttatttttcccctgatagaatgtaagtttcaagagagtagggatttttgccttttttcagtcactactgtatctctagactctacaatagtgcccagcacacattaggcatgtgttacgtttctccagagggacagaattaataggagatatatatacatatatatatatatacacacacacacatatatatacgcatatatatacattcacacacactcacacacatatatgtgtatatatacacatatatctacacgtgtatacatgtatacacacgtgtgtgtgtgtgtgtatatacatatgtatatgtatatataattaaggagtattgactcacaggatcacaagttgaggtcccacaataggccgtttgcaagctgaggagcaaggaatccagtccaagtcccaaagctgaagaacttggtgtccagtgtttgaggacaggaaacatccagcatgggagaaagatgtagtctgggagactaagtcagtctagtctttttattgcatccttcaatccaattaatattacccaccacagggcactcaatgaatgtttgttgaatggttgaattaatatattctgtgagaatttactgagcattaactatacaacactagtgtaagtgctgcttaagatagagatgaaataagaatactccatgccttccagaaaattaaaatctggtttaggagatgaaacacacaaatatctgtctgtagtataagatagaatattaatggcataaactcttagaagtaaaatactaaataaaatgttagaagtaaaatactaaggggaaataagattggtgtctttgagaaactgacacctaaaaatgggccctgaatgtgtggttggatttcagacaaaaaagatggtgacatggcttggttctgcctcacaacccaaatctcaccttgaattataataatccccacatgtcaagggtaggaccaggtggagataattgaatcatggggatgcttttcccccatactgtccttgtgatagtgagttctcatgagatctgatgggtttttttttcattgtttttatttttattttttattatactttcagttctgggatacatgtgcagaacgtacaggtttgttacataggtatacatgtgccatggtggtttgctgcacccatcaatccatcatctacatcaggtatttctcctaatgctatccctctcctagccccctactccccaacaggccaacaggccccggtatgttcccctccttgtgtccacgtgttctcattgttcagctcccacttaggagtgagaacatgtggtgtttggttttctgtttttgtgctagtttgctgagaatgatggtttcccaacccaaatgcccatcaatgatagactggataaagagatttgatgattttataagggatttcccccttcgcttggctctcattctctctcctgctgccctgtgaagaggtgccttctgccatgattgtaagtttcctgaggtctcctcagccttgcagaactgtgagtcagttagatgtcttttctttataaattatgcagcctcaggcatttcttcaaagcagcatgagaatggactaatacagatgggaattgaaagatttataagacaaaaagtacaacataaggaaatctacatggaaatgaaaacacgttggtaatgtacagaggatagtctacatttcaatttgtgaagagcatgaaatacacacataaagggagtaaggatttcagttatgtataatggaactgtatagttcacatacaattcctgacaaatggaagcttctgtgtacctattccttgagcagaggaaaccatgtggttttcatgttatttgcccacttttctaacctctttcttgtccatagccactacaatctgcagtgggcagagtcctgtgaatagcctgttgtggaaagccctgttctctcaaacagtacagattactcagatgaatgaggttttgtctcctggaaaattgaacaatgaaataaggagacaatcaggcaaggccaagggaggcataacagagaaaggccaggaggcagagaaaggccatgagggagcagtggaagcagaagttacagctattttcaagtatagagaagctgtgattaagcaaatgtttagtggatgtttgagaaaagactgattgaggtgagaagataatacagccaataaaggggagtcggctggtggagggataattagtcaaaaaagacactgagagaagctgacacttaatggatacctaagccacgttaatgaaggtgtcataaagtcaggaagatgcaccaactccagctcttagggcttttggagcaaaaagttgagaaagagctgtgtggatcctgaacaatgtaaaacttctcttctttgattcctatgagaatgtttttctgccttattgccatgtgtagctacattataaatccccattatttaagactgcctgagtgaactgctgatgcttgcaattcaaagagccttgtacaatttgccctctagtccttagcttcctcaactatgatgcatcagatagtggacttgctacatgttttctaaggccctatatagtgatgaaaaaaacctatgatttttttgttggatgattacttgcatattttccacatagaaaagtattattgcaaagtagcccattgttatattttgacagctggggacagaaaaaaacttgtttagtgataactaatgcaactggctttttttgtcctttcatttcatttggtgcttttgtttgatgttgtatgtcttgtccatgaaagatgctaccatcctggaaagatgggaatttaattgctctcatcaaacatattgcctaataaattgcttactctggcagagaaaattaaaagcagctttgatgtgaacaaaagcttttttaatatggcagattttatatgatatatatgtatataactagatttctttatatcatataccatctgtcattgagtattggcatgatggctgcagttgatgtcatgtgcataaatacaaaggtaaatggatcttgttttgtgtgtatgtactattttaatatttttctgttaaagaaaaaatatgattataacattttgaaatgaatttgtatttataagatagagaaatcttgtaattccacttcatttgtaatactcagttttactttcctagatttagtgatgcaaagcaggtcacttaagagcaatattaaaataaggcaaactttctcctctcagttgtgcccatctactcaaacacaattcaaattattttatgcattagtagaatttgtttctttcactctagaggaagatttttcttcaagaaaatcaattctcaggttttcaaataaaaatggtctagtttaatgcaatttcacagaacttattttttttctcataataagactaaaaaagtctgctttgtacatcaggaaatatttccttagcattaggagacagtagcaaaactaacatttttaatgctgtaagaaatatgaatataggactatttgaggaacaaaatctagaagaacaaagtcaaaagaatgaatcatttcttctgtgaagtaaataagcatcaaagttgttactagctccttctgtactgtacaattgtttcaatttgtacatctttagagaatataacagatcttctaaatcagcataactacccaaagttataatatacctagaaaactcaaagagaaagagaaggaactggcattatggataagtgcaatgaggcattcgcaactagctacagttgtgatttatttacaactatgtacacacatacacatcaaaaatgcaaaaatgcaagattacagaacctgacttttagttacataatcctcttttatgtagttacatcaccacttactgaaatgttgagatttcagtaagtggagatgtaactacatataagagaattctcgttagtaaaccagcatttctcatttcctaagctctgagtaagtaccttttcatttgaaaagtgaagtagaaaaatccaactcaaatacttatttctcagctatatgaataattgagcaagtttataataatctccttataacccttaggcatgattataatgtaaagaattgagatttccccaaaataatcaacattaataaattagtaagatagacgtttggtcaaaagttatcgaattttcaaaatcatttgttgctatgtgtttttggtaaactttagaacagttttttaaaatagatattaaaatgtctgaaattgtatatgtgtgtttatatacgtatgtgagtatgagtatgtgtatattcagtgtacaagaatgttagtccactggtccactatgataaaacatattcatgtctttattcaatcattcagtcattcaacaaatagtggctacagagtcaaatgtactatgccatcttgtagtaatgagtaatttacataccctaatctcaagcaattcatatcctcaagaggatacaatacaaataaaaaggtagcacaacataatgaggtaaatgtgatacagggtattcatagaattgtttccacttaaagaacacatgcaattgatgtttcatattaagggccttgtgaatatggtgctctaggcaaagagtataagtgaccatggattaacttctaaatgcactgcaagaaattggaaccaggtggaaaaaggtgacacattatgagcaatgatgaacaaagaattggcaaacaaataggcaaatataaataatagatgattcagaaaataagtttgaggcagctacagtgaagacaaaagtaaaatacaaaacaggaataacagtatcattagaggtaagagctgtacaatcatgtggtggagcaagctaacataaaatttttcctcctggaaacaaaaaatgattaacttttgaacaagggaggaagtatatttttaaattactattattaaaatataaaattagaggaaagaaaagagggagattaaagccaactcattcacattgcaagttactgtaacaatgcaatgctgggttttagggttgaggtttgggagtttagtcctgaagctgggcgcctacacctagccatgtgtgcttctattctcacccaggaataagaagcaataggtcagtgtagggcataaatttggaactgaaacgcctgcataaagccaaaacctgaaatagatgagtcttccatggaacagagactaaaaaataactcagagaaagaaaagtttgactctacccaagagtatgaatcgaaaaaaaaaattctttaagaaataaaaattcaaagtttgtttttacacagcatataatgtatacattttactctcctcatggtacagagatctccaagtagacattgtaacataaaaagtgatcttgaggcaatgaaacaccttggacatctggaagggccaaatccaaaactgctctgaaggaacatttccaagctacctggaagtagagacccatagggaaaaaattccctctcaggatgagtccaactccctctccaccctgcaccatgacaaaagtcattgacactgagagttagaaatcataagtagatgcctgtaatccagcactttgaggggctgaggcaggtggattgcctgtgctcagaagtttgagacgagcctggccaatatggcaaaaccccatctctactaaaaataaaattaaaaaaaaaacaaattaaaaaattagccaggtgtggtggcacatacctgtagtcccagctacttgggaggctgaggcatgagaattgcttgaacccaggaggcagagtttgcagtgagccgagatcctgctactgcactatagtctgggcaaaagagcaagtctctgtcttaacaaaaaaaaaaaaaaaaaaaaagagagatatcaaaaacagaagagtcagcaaccatgtctgagaacctgaaataatgggacaatctgggaaagaacatgaaatatggatttaaactcaatggcagcaagaatctttttgtccattttattcacagggttgaggataattctagaatttgttgaatggattgatatgtataaaaactaagaaatgtaaataaaaatagggttttaaaaatgaatatgaaagaaaaaatgaacaggcaaagttgaaaaagaacaaaatagaactgctggaaatgaaaactatagatattaaaatttagaaatataagagatggtttaaagggacaattggacagaactatgcccaagaaacaaaacttggggaaaattccccaaatgtgacacaagtgaaaaagaggtagaaagtatgaaaggataattaagacatacggagaattaaatgacagaatctatcaatctatctgtctgtccgtctgtctgtccctccgtccatccatccattcatccatccatccttcctacctacttacctacctacctacccacctatctgaaataggatttccagaaggagctgagagaaagaatgaggaagcagttatatttaaggagctaatgatagataaattttcagtattaataaaatatatgaattttcagattggaaaccacagttaattctgagcagattatgtaaaagcaaatttaagtattgatgttatgaacaaataagttataattagttgaacaacaggtattagaaagcaacattggaggctagaaaaccatagaatggtatcttcaaactgctgagaagagtaattttcaaactagaactctaaatcagaattgctaaattggtgatgaaaattgaggctaaagtacagttattttcaagccaacgaagactgcagaggtttctatgcacagacactctctgaactactaaaaaatgcacttcaggaagaagaaattgaaactaggtggaaaaggtgacacatgagcaagggtgaacaaagaattgctaaacaaataggcaaatttaaataattaatggctcaaaaataactttggggcagctaaaataaagaggaaaatataatacaagaggaataagagggtatcatgggtaagatcagtacaagcattctcagctctttgtgttagggggcaaaatagacatttccattagtcttttattttgttagtgtaaaatatgaatataacctaaaatgtaaagatcatcagaatgtaaatagatgcaactatgaagctaatagagtggaggaattaaacaattgatcaggctatcgataagaaaaatagaaaaaagcataaactaaaaacaaccaaatccaaggaaagatgtatatgtaaaagcttgaaagccagaaagagcagtcacatgtgagagctgcaaatagttcaaaatgactggagaagaggcaggttgaggtgtgcaggggcggggaggatcagggtacaattcaggataaatgtagaaaggttatcaagagccataaatatctttatgttcatatcaaaaagccacagaattgttctaagataaggttggagtagcaaggcctggtggcacatacctctagtcccagctagttggaaggctctggcaggaggatcacttgagcccaggagtttgaagctgtagtgcacaatgattgcacctgtgaatagccactgcactccaggctgggcaacacagggaaactgcatgacacacacgcacacgcacacacacacacacagaaaagaaagaaagaagaaaagaaaaaaagtgaagcagcccatatttgggtgcattgaaagatcattctaaacatggcacatacatacatatgtaacaaacctgcacattatgcacatgtacacaagaacttaaagtataataaaaatatgtatatatttaaaaaaagatcattctagcttaagtgaacaatacgtggaaaagacatactgaaggcaagaataccagtgagcccagggaaacacaaaaatggcacaatgtaaggtggtagcagtgggaataaaggcaagtgacagattagggaaaaacaaagcttaagaattaatataatgattatgtcatttataattaataaagagtgattgggtggtgaatgggcagaagaatatgggatgaaacctaccattctggcttggatagtggagtggagggggctgcgattcactatgacactgaacaggtaattagcaacagttttgtttgttgtggtttttattttaaaatcaacagataactttgtatggatttatgtataacatgatgttttgaagtatgtatacattgtggagtgactaaatctagctaattatgcattaactcacatagttattacttttgtggtggcaacaccgtctaccctcttttagaatatttttaaaacacagtatgttattaactatagccaccatgttgcacaatagatctcttgaactttttccacctatcggaagttttgtaacctttgaccaatatctctccaacacccacccaccaccacaactattctagctgccagtaaacaccattctactttctacatctatgagatcaactcttttagattccatatctgagggggatcacgtcatatttatttttctgtgcctggtttatttcacttaacataatgtcctccaggttaatccatgaggatagttttaatggttattaaattttcatagcttgaaagaggccatgttgagaacatttacacctcagaaaatatgctcagtattggtttttatttttttgagaactggtttactagctcatgactgagatttggacattggagctggaagtaatgattgggacatcaaaatagagatgtccagcagctgatagattaaatatatctggagccatggagagaagtagtttggaaacaaagatttgggactcaagaattgtgggtaactggattatttatttactaattcaacttgtttacctacttgaaggggaaactaataataacctggataaaataacattttaatatttgatgtactacaaaaggtagagtgatttttgtctttgctttatactacatactgtatataaaactgtattttcctgtctatggaatatactcaggatacatttaggcatatttctttattttaaaaacatagtatatttgaaggaaactcaggcttgtttttcctcaatttgttattgttgtttataatatcatttaccaaagttaattctgtgatggactgtaccagttatctgcttatggcatctcagctccaaatctactcttcttttttcctgctttgtgatactgaagctgggccctacaaacatttctcctttgtcaggtaactcagtgttaggttttgtcaataaagggcattggagagcaatgtacagtatagcagaggaaaaggcttctcttccaagttctggtatgattccttttttctttgtagaatgcctgtggggacaggtatgtggggagactgtggtgcttggcctttagtgtgttctccaacccctggaaaatttctctagcaccccagcagtgattggctgactccatcccatgggattcagaaggcagctttctatatacccgttccagcccacagtgcttcagtgaacattgtaggcaacctgaagggcagctttcagcacaccagctctgacccaggataccctcacacgtatttttgtcatcctatgtgctgtagtcatactcttcctaacgagatcttaatatcatctttatggaagagggatgggagagcttacaatttggccccttctttgggttttctcacttaaccctaaggtacaatattctccctaaatctgcaatgcctatattttttagatttttaaaaattcattttagacattaactatcttttactagttaataactctctttacatgaaattttatttttcctgcttcaattattggtgtggtttgtgtctcttccctggaccctgactaacacatggaccatgtaagaagttggtcggaaggcagaaacctccctatgcagaaaaataaaatatcatccttttctatgaaataaagaggatgcttttggacacctattaaaataatagcgaaggacttttatatttattatatatatggcatttttctgacctgcatttttaaattaatgtatttttcagaatcctctgaaaggttctgactttctagatgcagcattgatttcagaagcaatggtgaatcttttttgttccattttttttttaatttttccgcataagtctacataatggtcatttctacctttgtaacttggatttactataatttccacttagtatttctctccttttttttttgctcttctaatgccgatcatcctttatggtctagctcaggtcatgattctttccaagcttatctaccctccccacatgcagattatctactactctttatctgccaaatcatatctcaagagccatctctaatcaacttattgaggtatttctcatgtttccaatgaaatattaaactatgaacctttgtggaattttatacttctttatggggaagttattttttctctcattttcttctctcaagactatttttttcttttcacatatttaaaaaatgttttaagactgattttgataagaacagtatataatagtcccatattaaaatagaagaagtggattaacagtgatgttaacaataagaaatgtactgttaacatattaacagtgaaataatgaagtatggtggggaaatgactataaagcaaacagaataacaattaaccttaattgagtttaaggtttagctaagagtttctgggagtcaaatgaaaaagggaaatacaatgggctttgtatttattttacatttttagtcagagattatattcattggtgatatggtttggatgtgtgtcccctctaaatctcatgttgaaatgtaatccccaatgttggaggtggagcctgatgagaggtattggatcatgggggcagattcctcatgaatggcttagtgtcatctccttgctggtgaacgaattcttgctcaattagttcatctgagatgttgtttaaaagtctggggtctcccctcaatctctttcctactccctctttgccttctgccatgattgcaagcttcctaatgccctcactaggagcagatgccagcatcatgcttcctgtacagcctgcagaaccatgagccaaaattaaactttttctttataaattaccatgcctcaggtattactttatagcaatgaaagaaatgactaatataattggaaagcagactatgaagtggatattattgtgcaggaatttctatagggaaatggaaaaaaagcaggattgggcaaatggaatgctccgaagctgtgatgaccccttcacagttgtcacaagtaggggtgatggatctgtgtccttatatcctgacatcctggcattgatcagttattagatgtgagttacctagaaaggaggtatgctttggtaaaaaacttcagctgaggcaattcctgggaagaccagctgacaacatttccatcagctgaaggaatgtatccttcagtgttgaaagcgattctggaagtcatgggatagaattactaatatcacatatatatatatatatatatatatatatatatatattgctttttcacagacaagcactacgtctatcatctctctttagcaggaaggactgggctttgcagaattgttcagcaataaatttctaggattgaattgaagcaaaattatattcatgactttggggggtttgggtgtgggaagaagtggaagattaaaacacttaatttttaatggccactgatgtctcattgagagatgagaaaatgacaactgtataaaggaaatgaaaatataagtaacagcttgatgcaacagcagaacagatgctgtaaggaattacatcacatgattaattgtcaaatgagccacattaattatttgctggaacaaataaaaacaaattaccagattaatgatataggcaattgttgctgcaggagtttagctggagtggagagttagaaaaactgaacagttggagataaggctgagatatttccaaataaggaatttagattgcttctggcatcctatgggtgtttgaaggtgtttgatacaatgattgtgatctaagtaagaacttggtttggtgttggcataatagatttagaataggaagtaactgggggcagtagatcactgatagataatttccagtctggatataaagtgatggaggtgatgatgggaatagaagcaacttccttcataaagatttccctaactctctgctctaagttgatttctcccaaagcttcactatttgtttcatatattctgatctttaataatttgctgtcgtgtaatgagcatcataataataataattaagatttctgtagttatttatattttacagagtgctttcactgttcctctgactctttcaaacataccatgagctaggcaggacaggaatttcatctccatttttagatgtgaaaactaaagcccagctgcttaatgctattattcctctctcacaatattataaacttcttcaagctacagagtgtatttctatttttacagagcctaaaatagaaaggcagtcaacagattttagtaggatgtgtgggagctcatatttgaggcaatacaaactcataaaattaggtgttatagattacgctgccaaaagatgactccaagtaatattaaagttgactttttcattttttacttcccaatgagcaaagtttagtttttgaacagatgacagcttcatatgttactttaggtataatatcacatctgggggatatttcttttttctcatgctattggaaaattttacagaattttcagatagattgcgctataagtatttctctaaaatgaatatgcctccccatgaaaaatgtacatatatccagggatgcttacatcacatgaaaaaatcttgtaagaaataaaagcatatgtaaaaaacaaaaaatgtattatgaaatgtcaggtgttgggataaaacattaacctaaattcacaattcctgataatccacaagtaataagtgagtttattaattaaatgagttattacttttcttaagataccttgaaaaggaaaacattccatgccaatttagtaatgtaatagaggtagcactaaaatgttataccaagcactggaacaggcttgagtgtgccggctttatcagtaatttattttctcaacataggaaagtcaatggggttggaatagatgatctccgaattttctttcagagagtaaatacatctattccgttgttatttagtatttaacatgtaactgatgctcaagacacaataatgaataaaaaagacattttcatatcctcctggagttatatttgatggatgtattatatcacaacttggagtagaaagtgcttgtgccacacaaaaagcatagtttttcaaagaaagcacaaccataaaatgggtttaaggcaaggaaatatatagcatatgtttgagaaaaagttgtattttacttgaatactagtggaatttttagtctcagaaacaaaatgagtatagagtttcaataaagatataagaaaatcccttaccaaaaagaccttaatgaagaacaaaacaaaattggtgacaagttggctcttggtagcttctaagtaaaattcagtggagtagcaaggcaaagccaggttgaaggcatttatagtgtaagtggatggtaacaaagtggaggcagtgacatatgagttatgtttaaagaaatatttgtagtttaaaagcatggatgaaggcagatagggcggtgaattacagggaatcagaattggtgagacatctttttgtgtttttttctcttttttttcttatgttgttttatactttaagggagaataaagaaaaattttagacaaataagcatgtgggcaagatagcaaagtctggaagatcttatatcagggcaaatgttggtggctaagctttggaatatacaaatgaataaaagagggaggttaaggtaccgagaaacctcaagtaggcattcatagacttttcaataacttttaaaattctaaaaagtttagaatagccacttttgacaatgtgatgatcagtcaaaaacatgaaaaccaaaaggaataaaaaggaagaaggcaagaaatggaaggagaaagggaggaaaacagggagagaagaaaggtgggagagacagacagaaggaggggagtgatgtacagatcagttagcaaactgtctgtgaaggaccaggtagttacagactttcagtatttgggggtatatggtttgttgcaactgttctactctgctttgtaaaagcacaaaagtagtcttagacaatatataaggcaatgagtgtggttgtgtttcaatacatctttatttataaaaacagatagctggtcaagtttggcctaagggccatagattgctgacattccagccagatgatgccagattctatgtagttcaaaacaagccatattagcatggtcctatgactttcttgaatgtaagaatagggattttatatgtgtatatatatacacacacacaggtacaaacacacacatgtgtatgcatacacacacagacatatatataaacacatatttatatacacataaatatatttgtgcatgtatatatatatgtgtgtgtgtgtgtgtgtgtatatatatatatatatatatattcatacacatataaatgctagaagtcatctggagtctccaactccttgaatctgcttaagatcagtctgtcacagacccagtttttatgggccttatattttcttggtcacctatggttctgactttcttctataccagtgttttcttcctatgtgttttatacccttttatttacctctgccccggtgttcagctaaatataattcattaaaatttttttttttttttgcttttttaaatttcagctgcaaatccatgaaggcaagcatgttgtgaggaaaatttcttttactaacagagtgagggtctccaggagttctagcctcatgaatcacagagcaaacaacttcaaattttaaactgatttcaggcattcatattttcacaaggcctttgggttatcatgccaccaagacattatcagtggtcaactgacccttgcagaattgtttttaaactaatcctttttttttttcttgctgtgtccttttttttttttcctctcaggcaaaataaatgaatgaatggtgtcacgcaggattcagctaattttttcattatttatatctttgctaacaaccatcacctagaaatttacctttttacctgagaggcttaacttctaagaagtatcagttgttttttcttttttaactagggtctagcattctaggtcatctaatttgtgttatcctgtgagatcacaacaactctgtattgtatggttggtattatcttctacattttaatagatgataggaagaatcaagagatagtcaaaatgggaagcataaactctttcttaaagggtgagtgaatgaaatttataatttggtgtctatgggaagtgggcttgatgatactctagatttagattagagttaattagtagcacctcatttacttttgactactttctcagaaaagtaatcataaaaacccttaaatagaggcaatgttttaactgcatggagaaagaaatggaagcagcaattaaagctcttctagaacccaggagtacttttcttcaataaaaatgcagtgatccctggagcagtatagccaaagtaggtaactcttttttaaaatgtctttatgtagaactaaaaatagaactaccatttgaataaccaatcgcattacaggctatatacccaaaggaaagtaaattaatctgccaaaaagacacatgcacttatatgttaatcacagcagtattcacaatagcaaaggcatggaatcaacctaggtgcccaataatggtagattggataaagaaaatatggtacatatacaacataaaatactatgcagccatagaaaacaacaaaattatgtcctttgcagcaacatggatgcagctggaggtcattatcctaagtgaattgatagagaaaaccaaataccacatgttctcacttataagtggatgctaaatattgggtatacatgaacataaatttgggaacagtagacattaatagaggggaggaggagggaggggaagaaaggttgaaaacctgttaggtactatgcttactacctgggtgacagaatcatttgtacccagacctcaacatcatgcaatatacccttgtaacaagcctgcaaatgtattccctgaatctcaataaaagttgacataatttttaaagtatctatgtaaatttaaataaatccctatctgaacttaagttttgtgttgattttagtgtatactgaaaagacagggtttggttcaccattatttaaggtctttagtagttaatactgaatcagaatttaagcccattgaaatgtaaacctcatgagcacaggaatttttgtctgttttgttcaatgctctattctctgacacaaagaagattctgaatactaatttgttgaatgaattaatttagaacttcttcagttttaaacaaagttaatgtgaagccttcagagcccatttggtttcctgcagcattcctgtgcatactctgtgcccctggcctcacccttttcttccatttcaaagcaaggacgttctctgtttttagtagaagagttgttaaaaagacagcattgaagaataaccaagatgtcatcagggccactcagcccttttcaacatctttgaggattctgtcctgcggtggcgctggtattttactgagtcacctctggctatagttgctttctctgaattctctcatctcaatctggtcgggcagctgttatgacatcaccccaaatatgaacaaaatctctagtccttgattatcccaaataccacccacacaaagacatcagttatgacagaatgtactgactgattgtatggctagaaaatgtttagtaacttttcaactgaactgaatagtaagcctttctatttttaaaagtcatttggataatgctctctctctttccttctgcattttcacttgtattctctcttgcttgtatataaacctggcttgttgctgagctagctagtcacttcaatacccccttttcaatcttcttcctagttcatttgcccttgtctacaacctcctttaatacgttgttagcagaactgtttgtctttcctttgtctcaactcatcctgcgggcaacaccagttcagtatttaaagatgcatactccagactgagactttattggtgcaagtcttcctctactttattagctttgtaatcttagaaaacttacttttcttttccccagttacatttttatttgtttttttgcaagcttgtaatgaattggtgaatgtaaagcatttagaaaagcatggtgtggtagaaagctctcactaaatattattttacatttttgtcttgctccagggctctcttccttaataaaaaaaaaaaaaaaaaaagaaagaaaaaaaatttaaaaaaaaggaaaaggaaaaccaaaaggaaaaaaaagtattctacaatgactttcactaaacagagccaaataggaccaccacaaggaattcagtagtcagcaattaaagtaaaattatttcttccctgctaaagaaagcaagtagcagttttttaacaccagaggctattatgtcctcattttggtcagttaattttctctttcctgtggaaagtgatcatcataattttatgttttagggctcaattcactatttttcaacattaaattgtacaatttaaaaataattttaattttaattttagattcatgagtgtatgtggaggtttgtatgtggctatattatgtgatgctgaggtttgggatattaatgatttcatcacccaggtagtcagcatagtatccaacagttagtttttcaacccttgtccccttccctccctccatccccactctagtagttcccagtgtctattgcttccatatttatgtccatgagcatccaatatttagcacccacttataagtgaaaatatgtggtattgggttttcagtttctgcattaatttgctcaagataatggtctctagctgtatccgtgctgctgcaaaggacaccattttgttcttttttatggctacagattattccatgatgtacctgtattatatttcttgatcagtcccctattgatgggcaccttggttgattccctgtctttgctgttgtgtatagtactccaatgaacagacgagtacatgtgtcttcatggtagaactatgtcttttcttttagatatatacccagtaataggattgctgggtcaaatgatagttgtgtgttagttttttgagaaatctttgaactgttttccacaatgcctgaactaatttatgttcccaccaacaatgtatacacgttcccctttctctgcagccttgctagcctctatacttttttataatagccattctgactggtgtaagatggtatctcgttgtggttttgatttgtatttctctaatgatcagtgatattgagctttttttcatatgcttgttgaccacatgtatgtcttcttttgaaaattgttcatgtttttttgcacactttttaatggggttgttttttgcttgttcaattgtttaggcttcttatagattttggaattagaacttagtaaaaggcatattttgtgattcttttcttctatcctgtaggttgtctgttcactctgttgatagttccctttactgtgctgcagctccttaatttaattaagtcccacttgtaaatttttgtttttgttgaaattgtttttgaggacctaatcataagttctttctcaaggccagtgtccagaatgatgttacctaggttttctactaggattcttacagtttaaggtcttacatttaaatatttaatctgtcttgagttaatttttatgtaaggttaaaagtaggaatctagttttattcttcatatagctagccagctatcccaacacaacttattgaatagggagtcctttttatcattgcttatttttgtcaactttgttgaagatcagatggctgtaggtatgcaagtttatttctgggttctccgttcttttccactggtctttgtggctgattttgttccagtaccatgctcttttggttattgtagccttatagtacagattgaagtcagataatgtaatgctcctggctttgttctttttcttagggttgctttagctttttgggctattttttggttccatgtgaaatttggaatagttttcttctagttttgtaaaaaaatggcattggtagtttgaaaggaatagcactgaatctgtaacttgctttgggcagtatgaccattttagcaatattggttctttcaatccatgagcatggaatgtttttctatttgtttgtgtcacctgtggtttctttacacagtgttttgtagttcttcttgtagagaactttcaccctgttggttacatgtagttgaaggtttttgttttttgtggattttttttaagctaattgtaaacgggattgcattcttgacttggctctcagcttgaacattattggtgtgtaaaatgttactgatttttgtaattggttttgtatcctgatactttactaacattgtttatcagttataggagccctttggtgaagtctttagggtattctaggcatagaatcatatcatcagtgaaggcagattgatttcttcttttctgatttgtattccttttttttatttctctttcctgattgctctggctaggacttccactactggcctagccacagccagcactgtgttgaataggagtgatgagagtgggcaagcttgtcttcttcagttcttatggggaatggttcaaacttttgcccatttggtatgatgttggctgtgtgtttgtcatagatggctcttattattttgaagtatgttcctctgatgcctagtttgttgagttttttttttttttttttatcatgaagagatgttggattttatcaaatgctttttctgtgtctgttgagattacatggtttttggttttaaatctttttatatggtgaatcatatttattgacttgcatatgttgaaccaaccttgtatctcaggaatgaaccttacttgagcatggtgaattaactttttgatgtactaaaggattcagtttgctagtattttgcaaagatttttatgtttgtgttcaccagggatattaggctgtagttttgctccttttgttgtgtctctgctaggttttggtagcagaatgatgctggcttcacggaataagttatggaggaatccctccttcttgatgttttggaatagttctggtagaattagtaccagcccttctttttacaactgatagaatttggctgtaaagccatctggtctggggtgttttagatttgtagtttttgttactgattcaatttcagaactcaatgttgatctgttcagggttttagttttttcctgattcagtcttgggaggttgtgtgttttcaggaatttatccatttcctatagattttttagtttgtaggcatataggtgttcataatagtctctgaggatcttttgtatttctgtggggtcagttgtaatgccaccttcgacatttctgatgatgcttatttggagcttctctttttttcttggttaatctagctagcaatctattgatcatgtgtatcctttcaagggaccaaattttagttttattgattttttatgtatgggctttgggtcttaattttattcagttcctgtctaattatagttattttcttctgctagcttaggctagttcttgtttttctattatccctaggagtgatgttaaattgtttatttgagatcttactaacattttgaggtaggtgtttagcaccataaactttagtcttaactctgtttttctgcatccagagattttggtatatgttgtgtatctcttttcatttatttcaaagaatattttgttctctcccttaattttattgtttatgcagaagtcatttgggagcaagttgtagttatttatttctgtataattctgtagttttgggagatctttttggtgttgattttgatttttattccactatggtctgagagtatggttggcataattccaatttttttcgaatttattgagacttgctttgtgaccaagcatgtgtttggtcttagagtatgttctgcactttcattgtatatatacagtaaatagggttttaccttactgagcagaaaaacaattcttctttttctaatagtctaagatactagataatacctcttaagcagaaattatttcattatttcttacattttaaaaatttgaattatactgattatcagagggagagaatgaatgattagtttttttttaaagaaatggagggtaatttattgattatacagtgtatctccctacactttacaaatgaagactttgagttcattggttatatgacttgcagaaggtctatgtttcagtgcctggattggagtcaagcaactcagaatacttttgtacctgcacccttccttgttttgttatataactctagaataaaataaaaagccagtaagtagtgcttaactagaatcagtatagaaagaaacaatcctgctttcacacttctcccaaaggacaatgttcaatataatatggagtcaacttttatttgaattgttgagtgatttgcatcatattagtcatagctctaatcaaacagaattgttttttggaacaagattatcatctctatcttctctatatcttctactttcttatagcagggtcttacagaaatgctcaacctacttcttgttgactacattcgattgttgccttaatttgccttttgagggtccaaattattattttaatatataatcttcctttgaacagacataagtcaaatcaatgacaaaatccctaatcttaaagatcttatcatatacctgaaaacactggatgtaaaatagacctaagagagtaaataatcaacatatacacccacagtatcaactgaatacagtagaatttcacaagttcccttatgttgacatcaagccaaaggggatatgtagttaatttacctaacttaatcacaataaccttagaaggaggtgagaattttattagaggactgaagaaagaggatagaagtatgagctggtggataagacagagtcttgtagatcattggaggagagaggaataaataaccacgatttggaaagcaagaattttggttgggctactgaagttcatgtgatgagaaagaagagttacctaattttaagaatggagtgagattgggtctaaagctatttgtgaaaaaaacttaaaggctactctccgcaaagtctgaatataattttatgatttaacatgtttttgcttcttactctcttttggcaagaacttcataaactgaaaataactcatgaatgaattataactagtatcttttcatgttttaggagctccatgaatttataatgaattctattctttgtattctctgtttgagtgatgaaagggtcagaagcacaatttataggttaaatgatattagagaactatgtattgtgtgacatatttcattaaagaagaggctatgagctggggctttaacaaccaggaatttcacacatctggccagcaatcttgttcataactacttttataattgctaagaataagaaaaaagaattatgtgcatgcatttttttttaaggtttacaactgcagtttctattcagagtagattttagtggtgagggggtactgtgcccatataacatgtaaatataaagtataataattactttgataatactcatataaagtaaaaaagttttgtctttataacttttctgaaaatatatattagcatactagcactgtactaaaattaaaattctttcgaggatttatctttgttaggagtagaaaaggttagttacaaattatcccagaaaattaaaaagcagattgaaccctttgtttctcattaaaacattaataccatttgaaaactctgcttaaattctctgttcctaaaattaaagtatttaaaaatagaaatataacatataatatataattacaacaccagctgcatgtatatggatatatccaatggatgatattgacagccaacagtaaatcaattttaaaaattttaggcatcttccatttgcccttctgcagtcatgagatttcttgggagcctaatttaatacacatgaaactatgacagaaataaagaacaaggcaagacgatctataattaagtgatgaatgccatagctttaagtgctgttggaatttaacagaagtaaatacagcctttgagaagaatagccattttccaaattttgtaacactcattttattcattttaatcaatggccacagggaagtttcagagccgaggatgataaactatgctatttgaagggctgttagaagacaagaagattggttaattatccacataatgatagtttaaaaagccaataatttatttagatatgtaatgacctgtttgatgatgaacattttttcctgctctttgctaagcaagatatgatatcttattttcttcgtagtaataagtaacatttaaaacataatattgactagcttccctttttaggcacaattaaatataagtccccaaaccagcaggtagcttgaatcttcaaatttaaaataggtgtagaaatttggagaaacgacaagaacaatatagtaaaatgggaaggatttacccttgctaatgatttttggaatcttacataattagtgaatgaaacaatttcattaattttgacacctatcttttggctggatatcatcctatgacagataaattgttactattttcattccttaaatctatttatattttttaccacctctcaacacaatgcatatgttgtggctgaaatacaaaggaaaggcttgatgcttatgttcagaaggcctgaatttaagtcctggctatattgtatccctgctgtgtgatcttaaacaagttacttaatttctctgaatgagatttgattactcatctgaaaaatggatcagtactgatactttccttacccagtggtgaatccatgcatgcttatggaaactgttaattaccaagtgctctggattcattagttcttctgtattctctttcttactttcctccttctcttcctttttctttcctttttttcttcgtcttctttccaatatctgtccatattaacgcaggtatttaaaataaaataaagcttaaataattatatctatccatattaacacaggtatttaaaataaaaaaagcttaaatgattatattttaaattgctacatgttggatctgatttttaaaatctttaactaccctggacccaggaggtggggtggcagtgagccaagatcgtgccattgcactccggcctaggtgacaagagtaaaactccgtctccaaaaaacaaacaaacaaaaacactttaactacattttttccttttatgtagatatttagaaggtgactatataccttcaatgatgaccttggtagaggctcaaatcagtgttatttctttttaatcatttttttctaaccttgaataaaagccatagagaattactttgtagagagcaactgattaacataataatatcacagggtagaaatataattactggattatttcaaatacatttctgtttctagaaagtagagctcacttcctattcttgggtaagatgtggcattaacaagaaaggcagtaggctgacagaaatccatagttatgatttttgctgttcagtacaaggtcaatggttaattaagtcaccaccagtggaaatttgatcacagatgaggtctccaactttgcccatattactgggctctcactggatgactcagctaagtcattatattaactttgcttcctccagacaggtacatgactcaaactgggctgacaggggacttaggttgtggtgctgtaatattactttctagacactgtgattatccatttcagaaaatacacattcttctcagaaataggatttaattttaaacgtgtcgtttgttatgaaaattaatcacctaatgtcatagatagattagattggcaagggtcttatgggtacctttattcactgatctgttaaatactgacctcattcatttccatgaatattggaatcattgagtatctttcatgtgctcagcattgtgctgggcgctggagttagatagaacagcatgagccttctttctcttgagacctttaagctcctcagatcacagctaggtaaactaaagccaagaacgtttaactaacttgcttaaagttcagttggctaataatagcagaaacaggactagaaccccagactctgagccacctccttgttaagcacttatcataagtaagatgacttttaatttttcttgtgagttcatataagtatggtatactatgcttagacaccttatatttgtattagcacttaaatatataaaatgcaaacaaaaggtaccagagaaaactcaggtggatttagatgcaatcagtgtacctagcatcccaagccttttcctgcattagaggaaaaatggctttgtttaagtttgtactgtcttctcagtatctttattccatgaatttgtccataaataaccttttctagcttttctctgaggtgtactttgtgccacgctttctgtgtcacaaacaggtatgtgagaagaaaaacaaatggtgcttttactcaaattaggaatatgagatatttgttgtcctctgctaaaacctaaataaatatgcatgacatcctacaaatgtagtggaaattccatctctgcctctaggctgccttcaactaggtcacactaggcagataaggatatatgttggctcttatgtgtctattgggagaaatccattcttgaaagttgggttgggaaaccgtttcagttgtggcttatgtatatttatagtgcttgcatttattcttttgctgttcccctgtgtgaagcgttatatgggttcattttgacaggattggacgaggcacaatgtgttaacctcttttttcttgtaattatataaacatgtacactgtacacagtgacctgggaatgaggatcagaacatctgttataataactgaaatggtgaatgagagtagattttgaattgtaaagcaataaaagtcactcttctgatctgtggctttatgcaaatgcaaatgtttgaaaatgctgctgaaacgtgttattctttaacttaccagaggtagaaagagagcttgctttttattgttctcacatgggtgctcccagctagggagttatttgtctttcttggaatcaattaagttaacctttacagcaatttgtttagtagtttaagcattctagaagctacagaaaagtgtctatttaaagtagctgataatgtcaggataacctcatgctagcaaggcatatttcacagtagttctttggtatgcaatcagcatcacctacataggctcttgataaattttggattaaggaaccaagagccttttgggtacaaattaataaaatgaatgttactttcatcattcttttcccaaaatgaatgattagttgaagaccctacctaggggcaggtcatgaactcaccttgcagaggaacctttgcccattcttctgattccatgcaaaccctcttcaccacaccaagattacctttctcacgagaattatcattgtctttgccagtaccagcttggctgcaagcagaggacattttaaaagattattttaaaattatttaaaaatttaaagttacttaaaattactggttagtacttggttatacaaataatgtagcaatttttttcaatagaaaactgaagtataaaaaatgaagtgatttgcctaaggccactcagcagaaaggctgaactggactgtgaacccaagccaactgactccaagagcccttatctttaatcactatacaatatttcctattttattagccatatattctgaatatttttccacatcaataaatataaatttaaccatgcattttaacgattgcacagtattcctctggtggtttacaatgctattgtagaatctcctcccagatgatatacatttagattgtttcaattgtatttcataattaaaaatagttcttctatgaatataattgaacatgtgttatttctagtaaaatttgtctaattcttcaatagctatgtaatttgcctttcttactaatagaaatatacaaaattgcttgctcaaagattattccttgactctacatatcattatatttatattaatgcaaaaaacacttattgagcacctactgtgttacactcagttaagagctgcacattcaacatggagtaaatgcacaagaggttatagactaataattctcactaacgaattttagaacaaatgctttaaaacctttgcttgattataaatatgcagttcacttctcaggggatgtttaggagtattatcatttttaatggaaatctctcatagaggggtgtgtgtgtgtgtgtgtgtgtgtgtgtgtatgtatgtatgtgtgtgtgtgtctcactctccaccctgaacacacaaagtcccatagtctacagttgggtcatttcatttgatcttgagacatttgtttaagctatgtctacacaaagtcactgtaaacattttggtcagtgacctgctttgtttgacagtgtcacaccactgtatttttttctggtctactttcactctggattaactagcaggtttttaaagctttcctcagactgcttttatatgagtccttgtgggtatgcattagtttgcatgcaaactcatatatgtacattatttctgcattagatctctactagattagctacattatctgcaattcgaatttccacaatcagtttttgagttagatgtttagaaaagaaaagttactaaactttaactctttatttatacatttacattttccctggacaattttctacaatattttcttcccacacctgctttgggttctttcagtttttcaatttcacaggaaaaaaatacctattattgtatgttgaaactagttgtaaagagtaagaatttttaaaataaattctagttagcattagatatatcctctattccacagactgttctaattataaaaataactcatgtcattttgtaattaacaaaaggctttagcaaatacctgaggctttctggatttctggaaggaacacagtgtgatccccatgattgtcttagttgcctgcaaaaggaaaataatggccatttgatcaatttctacaacattttaatatgatgttgatacaaaaatatggctttaaaacttcattttgttttaatacatgagacactctcatatttcttctccatattagtgagattctccaaacatttattaaaaactcacactacatgtgaggcaccaagttaagtccgataagtcaaagaagagtaagccatcaaagagttttcagaggaaccatgtatggtaatagaaggttatacccttggtcctgtcagaagtagtagaaaaaaggaatgaaaaagatggtgtgagagggaacttgaaatctatatgaggaatagatagatatttatagagaagtaggcttcttgaaggagaagatgaggtgttattaatgtaatatgaatgttaatattttagcaatctcaagataatttaatactatagttttaaaaagggggaaaccaaaagtaattttaagaattttaagaaactttgccagaaaatatagaagtaaacagttgttttactcttctttgttccttcatttaaaacaaaataaaataataagcacacaaaaatatacatttatatataatagtaaatattccacctaagagcattaaaatattgcttaaagaaactgcaaagtaaataggtaagaagaaatgaaggacctatcttaaagttatagtccatataaataatagatactgttttgtatataatatcaaattacatatgtagattgctttatgaataatactattaaattaatttgcatttttataaaatattaacttgctagccatcttttaaattactatttctggattaaaactctagaatgtttaatactttcattttaaactcatgatatctaaatcatctttctaaactcaaaacatatttgcatctatattttattgattgaatttcataatattttggcagatgatttctcacatcaatgtattttttgcaaaagagagagttaagtgtcccatatttgcaaaagactggcatttaaccagatctgaaattcagaatcattattcttccacaatttactgtgcagttcttaaggcagttttagaatcattaaagtgttataaatctctgatattcagatcatttcacctgatcccttcattttgcagaagagatgatggaggtctggggagtgaagaggcttgctcatccagtcacttttcgccttttcttttcatttggttgacctattttcttttaaataagtacgattaagcacatgctttttaccttcaaatagttggtattatttatactgtttatattataattatgtgactacctttcctgttatctcagtttgatcagttctatttatatcttgatactattcaagcgtctgccttcccaatcagtatgcaggccctcttggttgtaaattgctaacatttaagtagccatttcccaattttcttctcagtgtgcagtgcctctactttaaaattaatattatttgcatgtgtattttgaagtcctcccttggattttaatggtccatttatagaaagaaaaatcaacacttattttccatccactactgaaaaataatgttggaaagtgtaggagctttgtcaagtaaaagcttatttatttttaaaataagaaagcacatttacatgccagaaaacaaccaatctttgtcaaggggctattacactatttcctgcaacttgatttcagtttatatactgacttctcactcatattctttattctggactgtatcagcaacttctttttttcaaatgcccaggacaagtctgagaatatgatagatgtaggaagatgtatgcaagtggacctttaacgtcttctctagttgaagaactgcagagagtgctagaacttcgaaaattccaggacattctgcagacaaaattttcattggttacatatttgtatagtttttatttcacctgaaatattgacaaagtgctaatgtgtatgctttgatgagataacttagcaacaatgaagaaggttattgtcattagaaataaggttgaaaatactggagccagtctttttattaaatcaaaaatacctgttgtttcatggctcaaatgactcaaaagcaagtaggaagggtgggagatatttttcagcgtgaagtggagaccagacactcctcctcgcctggaaaatgagtacattacgctatatactttccacataatcaccttttgggaagctgtcacctacttatttatttttccatggtgtgtccacgggtcacatgtatatatgttttatttttgttttcactttttaaccagcatacatttaggcactcaccaacttcacacaaaattaatttcaaattgttatagtcatagtttatatggacataaaactcttagaatttgttcaaagaaacaaagtatttaccacttagaaagaggaaagttattgagaaaatagccagaagttgaggataaagagtggcaatattacccagcaagaagcaatacagaatggcaattaaaagatggggcctggactgaggtccctcgtgtcttaatccagcatccatcacttgccaactgtgtaactgaccttaggaaggcactgaggatgctagacctgtttcacggtcttgctaaagcagaattcaataagctcagtgaagcaggttctttggactaagaattaatctaccttgcaggactgaaacataaagaagaaaaacaaatcttagactcagtaattgggacaacttaaatattattatattcagacttaaaatataaattttatttgatgggaaatagattaaagacagaaaacgtgagtcaaataaactttttgatgactttttattaatgtttgtaaaatacacagtgcctgatgtagcgtatgatgtcaataaatgttgactgttaggaactttcattcttcaatgagattgagcttaggtgtaaacatgtttcatacttatttaaatttctttagcttcaaattgcaggagtttgcattatgtttgaaaggggtctggaacattgagcacataaagcaaagacacaattagttcagtgcagttaggaccagtgaggaatgttttcccagaaaaggtgactatttcaaaagctcacaatgagagataaatttacagatgtatgtgttaatgtgtgtgtgtgtgtgtgtgtgtgtgtgtgtgtgtgtaggtacataggtcagtaagaagaagctgggctcctgggcagatgagccctgtttggaaagcaatggaggcatttgattttggttcaatcaggtaaaggtaagtggtttaatatggctgtatgactggggaagtgggagtggtaagaaaagaggttggaaaggaaggtagaagacaaattatgaaaaactttgtaaatagcattaagcttaaagattagtcattgaaagattttaggaagttgaataataagatcaatgtttcacgttataaaaatgactttgattgtagtagctataaactactgaaaaaagctagaataggtgcaagtatccatgaaaaatccagtggagatgcattgttgtggtgtggaagacatagaacttctggacttagtcaagcatatgaaaaggtttacagtgacattcctgtagaaatgatgggaatctataaactgttagctagaataattaagaagaccattacctagtttaacaatagggacagactccagtggggtatctatgaggttatggtctaaagctttgcttggtctttaactctttctggcttatgatttttatcactgacttagatataaaagcaaaactgaatatgacctaaaggcagaaggtaaagaaacacatttcacatacctttgtaatattagtaaattaccttgatacattagatgttgaataagttaataataacagttgatgatagaattaggccccaagtggttttaattagaaaattagaccaactgtaagtaaaagatattaatcagggatacttgtaaaaaaattttaaaaaagtacatcacaaacataaactttttaaacaataagcttaagatgaatgagcagtgtgatactgtactgttaaaaaaatccagtattttatctataatacattaacttatggagctggccactctctcataatttgctttgcttggatacacttggagtataacattgaactgtggacacactaggctgtgttcagaaaaaaaaaaaaaactagaaaaacgaaaggatcagattagtcatgtgacaaacagttaaacaatttcaaagtgttaggctagatgaaagaaacgcagtaggaagatgaaatgttttcaaattctggaagataatcatgtttaagttgggattaaatgtatctcaataaaaagatatgattaaaaactttaggaaaacaggggatggattaatatatgggagaactttgtgctggagctctccagagaggtgagggactgcttcagatgataagtttgtcattcctggaggccaatgtgtagtaataaaggcaatctatgtatctgaatgatgagtagaccagatgatttacagattgtatgattcttagactccatcttttacactcaggataatagtgcaattttagtgcatagtacatgtaaatatttgcaggttaatttaatggtcattttgagaagtctgttaaaaatatgcattaagaacaaaatgagtattggggttttatttcttcttgtccattttcttttccccccaaacttttattttgaatttttaaacatacagaaaagttcaaacaattgtataaataaacactcataagcactttgattaaacaattgcttatatttttccagttttttgtttatgatacttctttcatacctaaagacttgatctcctaagagtcaggatattttcttatataaccactatatcattattttgcctaaggagaaaaaaatgataccctaatgtcatttaatatccatggcatgtcatttaatagccaaaggccaatgtaacattgtcctttggcattatattgtataaaaattaaagaagcttgatgattttgtcctttggataatgatttgtacaaaattaaaatgcagaggaaccttttgcaattgtttagacaggaaataagattggtataacatttgatggagaaaatcaacatatcttctgggaggataacagatggtgtgccatttagaacatcagtttctttattaaattaaagtctacaaaacacagattgtactcactttaaggtaagacctatttgaaaagtctcagaggttagatgtgacgttggttggtacatccatcatgggtttatgagtcatacagtcctcagtagtagttacaattgatttaaaagagaaaggcattgactaggctttagcagttgactaatcttttatttcaagtcttaagtagtgaagttcttttgtgagtcagagactgtgatgtgaaaagtttcagcactgagtgttctgtgtaaaccagggatcacttgacatttggtttcctatatctacaaaacaaaggagggcaattgtgcccatgaaaaagaaaggtattctcctctccttctttttttcttcttttaacaagccttttgtagtgaagagaactgttaacttttaatataagcttggaaaaagaattgcgggcattttatggtttgatatagaggttatgtgagatatgatggcccttcctgaattaagaaataaaacaatgataaagctgtgagaatgattttcttagatgatgttttgaacctaaaaagttcaaggtaagtatgagaaagcagtacattttgcttgtgttgtatggagaataaggaattagatgataactacacaggagtctccagattcttgaaaatgtgaaactggttgaattttggtgtaagtctagaaagagcacaaaattattgattactaagatgcttctttaagatcatataggtcttatgagtcctttattattctgagatatattttatccatcaaacatgatttatgaactctcaggagagcaattatctcttcatggatcacatgcttatgaaatactatgtacaatcctgacattataataaaaagaataattctaggagaaaacagttttatagaagattcccagtacaaaatggatattattttttcaagtcataggaaagaaaaacatcttgtttaaaatcatgtgaacaattatccttttgcaggctcatgaacaggtggaaaaaatgctttgccattcaattttataatagcaatttaaaaatcaaagatgttcttttaaaattataaaaaccagctgagatcttcctcagagaatcaaatatagagagccttatatttcactttacaaagaaaatacatgaagtatatatgcccctgatttcctgcccatcttcacatctgcagattacagataattgcttcttgctggagtgaataaggtgtcctcctcccctaggcttagcctatttgccatgctttggatttgatcctctctttttcctgagacacctggctccatcactaatgccttctcttttctaccttttagctttctcttcctattggttctttccctctgcatataaatatgttaagtctttctcattataaatgaagcaaagacacaaacaccctgagattttatcttcacctttcactgtcctgttttctgctactctttaatattctagcttcattttgaagaatattcatttttttaaataacaagattaacatatttccattgttagctatttaaattatacaaataaataaaaaatcagaaagtcaaaattaatcaaatgcctatcatctaaaatgaaccaaggttaatatattgttatgcataagggcatattataactacttctgaagcattttgtcatgaaataccttctatagaataattttaaaatggctaaatatatagtattttattaagtatatctaccatagtttctgtaaaaagtcttttaccattgtatacttagaaaattttgaatcattgtgttcttataaataaagaagtgaacatccttgcagctaaatcagtgacattttccttaagtttccatcctgtaagtagaattagtgctttcaagtgtgtgatatttttaaagcttgatagatttaaaaaaaggacttcaataaagtttgtgtcgatttatttttctattcagctgtgctctttcttacacctcaatacatttgattcataaagattctatctcattgttttaattaacctttcccttttcctgtttttgaacattttcttacatttagcggttatttgcatttattatttatgaatattatctacttatgttctttgccagtttttctactggagttgtgttttcagtagctagtttttttattgaatatattattttcttgtaaaatgtattatatttaatatactttcatatattttcatatttgtctttcgttatatttgatgcatagatgtttttcaaatattgaagctacatttagtaatattgcctttatttttactgcttgtgttttcaaacttagaaaggccttagcactttcatacaattgttttttaaagtaaaattttattaaagaatgatctatgtaaagtgcacacatgatacaagtaaagttctagtaataagtatccaagcactcagattaagaaacagatcatcaccagcatcccaaaagcacatcatgctctcttcttactgctattcccaccactaacattttttgaactttttgaacaatgaaatcatgcagcagtatacttttgtgtctggcttctttcactcaatcatttgtttgtgagattcatctcatgttattgcatgtagttctttattgatgcaggtcttccatgttgttataaatattcttgcacatatgctttgatgaacttatgtacagatttatgtttatcagctatcccagagtgaaatttctgtgtcacagagtttgtatattttcagtggtagaagattcagacactcaattttcaatgttgattgagccagtttgtctttttcattttagccatgctggtgtatataaaattgtttcaaattgtggtttaaattttcattttccataataccatgaaattgatcacttttttatgtacattgtccatttcaacttatcttttggggaatgcttgttcaaattttctacccatatttctgttggtttgactgccattttctttttttgtagattctttaaaagagaagtcttttctgtctctccctctgtcacacacacacacgtgaaactactaaatgtgtgtatatatgtgtgaatccactaattctacttataggatataaagaaaatgtcatatatatatgtgtgtgtatatatatgtgtgtgtgtgttttgtcatttgtttatggcacacatatacacgtgtgtgtgtctgttgagtgtgtgtcttgtgtgtgtctctgattaggaagttcttaattttaagaaagtctaatatgtcacatttttacctttataagcatcactttttgttttcttttaaaacatcttctcttagcttttttttgaactttattttttaatgtcacatttcaatgtatgattgaaataatttctatataattatctacttaatccagaaatatttattgaaaatacaatccttttttattagaactgcagtattatcactttaatattgttgtctatatagatggaaaactatggattctgtgttctacttatctatttttctctattaatttttcatcagatactatttcattatttgtttagtctttgtcctagaattcaaaatgcattcttgaattactatgttcagttatttctgaacatagtatttctccaaatactgctaaaacattaaaatcctttaattctatttatgcattttttgcttttttaattatacttaccatacactttaattctaaacataaacttcatcagtcattcctattctttctttttatagtccaaatttattgattttcacccatgtgtttgtattttctcgtatacttcacatgttgaagcaatgtagtggcttcctctgtaatcaataacctgcctatagaacttgatttagttagtatttgttttagtggaggcttgttggtgataaatcctttcaattttggtattttcattgatatagtcaaacatatttggcaaaacacatttgtatctcttctctatatgttatgaaatgaaaataaatactaaagaagagtggatattgtagacattttatctttttcctgaccttaatggaacttcctcctcttatatataaaatttactgttcattcgtgatttttatcttaataaagtctcattattttattgttttccaaaaaagtatttttaaataaaaataattatcaattgcatttatactatctagtatggtgaatctacttttttcttcttggaacaattactaagttggatgatagtaagattttccgaatttttaaatagaattaaaaagttctttctcctcaatagtttgtaacaccaatctaactttatttggaaaccaattctttactagatttttttcatctccttccacatacaaggggtaataagctattcatgatttatctcttttctttagttaacattgttgggtggttatattttgtcttaaaaggttgcgttatctggatgtttttattacaaaattttaaactctggcttggattaataaaatatagctatttattttttaatttaaggtggaaaatgggttatcctaaggaaataaaaagatttctttaaacattcaaacttgtgataaatatgtaaacttaaagtcgaatttgaattattattttaaagattgataaagaataagaaagtttcaattcagtatcatcaaatattgattcaatattataactgggtaaaatattgatccaatattataaaatatgatctttattgcatacttttattacatagaaactaccattttgaacgaaaaaagtagaagattcagttttttgttttatttgccagcaagaaaccacttaaggcttgcatttctataattttctctttatttctacttaactttacaagtaccttacaattagttaactatttttctgtttcatatataagatcttacatttttagttacgtcttattaagtcatcttatctcacattttaggaagttttgtatattttgcctgactgaaattttgcagaaaactactagtttgtagtggaacaggcaagggttttgaagtcaggcatgagcagattctactagtggctctatcacttgatagctatgtgatctttgaccagaggggtaattcctgtaaaataatgctattttggatggctttgaaggttcattgtgacctcaaatacttgttgagtgcttactctgtgacagccactctaaatgttttgtacatgctaacatttattctttattgcaattctatgcagtaacctcccttgtcattcttctttcagagatgaggcagctcagactgaggttttaagcaactgcccaaaattatacagatagcaattggcaaatccagaatgttaaacccggtctagctccaaataaatgttatatataagggtagagagtaaagaagaataccactgttcttctccacatacacagaaggaatctaggttagttctttacacccattagacacatataattattatccttttgcttaacataagtcaccaaagacttcaaatatattgagtgccatttcacaagttgattgttttagtaagtacacccttaaattggttaaaatccagaataagagaaatatttcaaatgaatatggtatcaaataatattttttatcttgttcctgaatgtaaatttgcctcacccctctagtctattctgagtcctaattcctcatagttagaggaattgttacaacattacgacttcttactaatttataataggtagtttgctaatagtatagtcacctgacattcatgtgtcaaaatatctttgatgaggtatgaattgctagatgtggaatagcttattcaagaaagtttaatttatgaatgactgtacggggagtacatggtgtgaaatttgaaaggaagaaagataaatgttctgcgtttttaaagtacttgtttcctaaggacagaggttggaggggattaggaatcagatgctccaccttttatttcattattcaaaccaacaatgattcttttggaggcaaaggcctcagttgggtcactcccagctaacgagagagcaatgatattagagagaaggaaggttgtgacaagagtgagggaactggaatgagacagagctggtggaaggtcacaaattgaagggacatattttaaaattatactctatggccaaaattatatactagttttattcattgattaaaggagttgcattgttttggagaggcatccttcataaatgtcaagtgtcttcttaaaagggacttagaataaagcaactagcaaaatgctaactctcttttctcgcaagtaagatgctgaaatttgcaaataatttgggcttttaacacaataaatgcacggtggctcactcctgtaaatcccaacaatttgggaggccaaggcaggcagatggcttgagcccaggagtttgagactagcctgggcaatatagtgaaaccccgactatacaaaaaatacaaaaattagctggaaatgatggcacacgcctgtagtctcaactactggggaggctgaggtgagaggatcacctgagcccaaggaggtcaaggctgcagtgggctgtgatcgctcctctgcactccagcctgggcaagtgagtgactgtcttaaaaaagaaaaaaaattgtttaaaagaattttgatttctgaatggagacggaatttaacacatttttttcaatgcttaattttatagtatatatcaatgaagaggattgattattctggaactgtttacaaattttgggggggataaatttcagtacttaagtcaagacctctctatacctaggccctaaaataagtaataactaaagaaaaaaagtccaaatcatatttgtatcatgttaaattttggcagcaatactaaggcaattttaccagtatggctgtggctaaaagagaatatcccaaagttcataaagtaagcacacaccccatgtacttaaatctctccctctctctctctctttctctctctcacacacacacacgcaaatgcacttgcacatatataaaagtacagaaaacttctgatattttctttatcttgtgaaaattatgtttattcttgtaaaatttatgatttttctctttctttttgccaggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaaggtaattgatagatttttaacatctttgtttcctggaattcaaatttctaggtattcttaagagatttttttatttttcaacatacagttaataagttgttaggaatatttgcatgcaaagatttattttcaaaatgcatataaattttatcagagaagataaagtataattcctcttgcaaaaaatctgcttataacatgaaatacaattacatctgttagtgaaattttttttctattgatccttccatcttattatagaagcattcctatttttaagaacccacaaatataaaatttatatgagtggattttaccaattttgcaatccattcttacatctttatttgcattatctttcaatcccattatattattactgtggtctcaattgattggctaccttgaaagttatgtggttctaagtgacttcaaaatgtcagcatatattgaaacttaattggaaaattttaaacaaccattagtttatgtatattccatgctcatattttaaccatctaatatttctttttgtaactgaaaataaatggctgattatgtaaaaactgaattatataaggacataattagaatactttatgagttttattttcatgttataactgttgtaaatgtcaaaaatatagaaaaagaataaaaagaaaaataatttggtggaataaaaatttaatatttatatatgaaggaaggcaatagagaaaactattattaaagcatttattttaaccagacagctgtcagtagtaaatgtgtttgagaggtgcttctatagtcttatgtgggtgatcttttcttatatatgtagataatcttatagtaggtgatcttttcttttgcatagttagcatttatataataggaattaaattttataataaagatttttctcaaaggaaaaggcttataaagtgtttgttctaacattatattttaaaacaatgtttgcctttctgtaatgctaatatggttttactgtagctaccttatattggtggaaatgtacataattatttataattccaggttagtgcaaattgtttaagctcattaatattaatggtagctgacaaggtacagtatttctcgagatgaaagtatccttcttttcccccagcagctaagtagtgtttatcaaagccatactttgcatgccctttgaattcatatctttatgaatacaaataagtttccacatttcagagcctgtcaggtgatgaaaggttttgaagactgagaaaaaggttaaaggtaactgtgaaatattacatttgtcatcataattgcaaaataaatcattaattcaagactattacatttgattagtggcatagttcatgattgtttccattaggaagaagaagttctgcctctaatgaaagcattttgatcaaagaatatggagtatgagtgcagtatagataaaatattagtagatttcttaatggtgatttcaaatgaacagcataaaaaaacacaggttcggatgttctcacaacagagtactatcctgggaatgccctagcaaaattatgaattgataaagtcatgtggtttgaccaaaatattataagaaatttacaagctttgttacccaataaaaactcactgggaatcaaatccatcatttcactttggcttgaagctaggaaaagctgaaataagtgtatgaataactgtctttgtgaatgtcatggtttggattttatcttctgaatctcttgtttgttgagttattactgcttggaggacacagcaatacataaaaacataatataacagagccaatatttttttaactttatcaagaaatgtatatattgataatattgttaatgattaattataaaataactttagatattttaaaaatgtaattatttatccaatgcaagaaaataataataaatgagatgttaccttttgacattttatctaatttttttctgttatagttttaaagggtagtattgttctgctcaattaataaatactttgatgtattagagcttgaattattgtttgaatcatatatttttaaataactcttctgataaccgaaagctctaatcttgcttgaaacacacttagaaacattctaaataacttaattcagtgtttttagcttttcttggtttgtgatttgtcacaaacctggtgaaggaagatcatttatcttcagtatatatgaattaaaatctcatgttgagtgaaaaattctcaagtctagccaccatttatactaatttagaattccacatgttatttaaaaagtaagaatccatgtatttaaaaacaatttatttagatcatattgatttttaaagaatgtttaaacaagtgttctgacaataatttacttaattattaaatatttccatgcttaattcacgtataatattatattttatggagaaaactgagggaaaatagcagaaattttcacacggtagaataataaactatccattttggaggaattgagtctgaacacctaatttatgcctaaagctcagtaacaatccttctctgtcctttaaatatttgcagtgatgggcaaaccattgcctcttggggaagactatttcatttttcaacatggtttactttttttttgacacacagttttggtctggcacccaggtaggccaggagtggcaccatcatggctcactgcaacctcaatgtcccaggctcaagtgatcctcccacctcagcctgccaagtagctaggactataggcacacagcaccatgcccagctgaatttttttttgtttctttttgtttgtttgtttttgtttttctttttgttttagtagagaggaggtctcactgtgttgcccaggcaggtctcgaattcctcgtctcaagcgatcttcctgcattggcctcccgaagtgctgggattacaggtgtgaaccatggcatgaggccattatttagaattaaaaataatagccgggtgtggtggctcatgcctgtaatcccagcactttgggaggccgaggcgggtggatcacgaggtcaggagatcaagatcatcctggctaacatggtgaaaccctgtctctactaaaaatacaaaaaattacccaggcttggtggcatgtgcctgtagtcccagctactcgggaggctgaggcaggagaatcgcttgaacccgggaggcaaaggtcgcagtgagctgagatcacaccactgcactcaagcctgggcgacagactgagactctatatcaacaaaataaataataaataaataaataaataaataaataaataaatatgaagtgggtaaaaattcaggggaagcttctattttttttctaattcccctttgcccatcaagtgaaacaaacttaagcttctttcacatgccaggtcttcatatatttaaagataagttttgtgttcccaataattactcactttctaggcccaagctcgctatttgtgtcagtgtgccttatagaaagttcaggtcatggcacagtctattttaatctgaataccctctagtttgttcatgcctttcttaattactgtggttattattgatatgaataaaattttctgtgagtaaatacaaactttaaaaaatagaataatagaaaacacttatagcatccaaaagccaaatatataaagatgactgagtacttgtctaatgacttttctgtttttctactcagtgtgactgatccatatgaaatcactctctaagagctatagcaggttttgtgtggctgagtgttcgcataacccgacatgtatcatcagataggtggaaatgttcatctgtgtgtgagcatagctaattgcacgagtaaagggggaaccatgtggcttttgattaagaaatggaaaatgtaaaaactgttcagtgaatttgagaagctgcactattccctcattcccctcatataaactagtcttccaaaacaagcactgcccccttaaattaaaaaatattcatcctctctctccttgcctgtctccctcccctgacattatttatagaattatttgaacattgagctgcagggtgagttaattcccttgtaacaaacggaaagtgttcagagtcagacaaaattttaaattagtgaaaagtagatatatattttttaaaaacacaaatctttcttgagaatgatacctttgggtttaaaataataatgtggtatctgttggcacactggcacctctcctctcattattgacagacctttatctcctcttcagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtaagaaaaatcagtatcttttggagctatgctttaaatatagataattttctgaagcccattccaggttcttattgtattcttatgtgctttattttgagttttgaaaattcagctaaggggtagaaagacagaatcaaacaccaatcctaatttcacatatccaaacaaagaatacctatgttgaatacttcttctctgtatttgtaaaataagcatttttttattcctgtgaaagatcagctagtttggtaggttggatgaaagatagatgtagtaaacaatattatagatagatagatagatacacacacacgtacacatacacatacacacacacatatgtatatatatatttagaattccagtcatttaaaaagtaagaatccatgtattcaaaaacaatttattcaaaaacaatatggtctaacaatttagatcatattgaataatgtgtgtgtgtgtgcgtgtgtgtgtctctgtgtgtgtgtgtgtgtgtgtgtgtgtgtgtgtacatagacagatagatagagtcactctgtcgcccaggctggcatacaagggtgcaatctcagcttactgcaacctctgcctcccaggttcaagcgattctcctgcctcagcttcccaagtagctgggattacaggcatacgccaccacttctggctaatttttgtatttttagtggagtcagggtttcatcatgttggccaggctggtctcgaactcctgaccttaaaagattcacctgccttggcttcccaaactgctgggattacaggtgtgagccactggacccattctgaaatatttatttaaagaatttttctgctatgaagtttttgctagggtagtttctcaaggcaaagccttgtgatgagtcagtgaaacttgccaagaaattcagaattatgccttactattttatctggctgtttatgtgcaaagaatgcatataaaacgtaacaaactttataaggcatgttaaggttagaaaagtttttactcatatgtggaacaatataatattcactgaaacactcaagtttgtggaactgcttttgtgtagatgtcatttagagacttagaaaatagaatttactaaatgatatttatttcagtgagttaaaggaatattttaataaatatttgctaactacaggttgtctgctttcttatgttaatgcattttattatttttgcatacaaatggttatcttgaattatcagttaaaaacaagtctcagagaaatacaataaagtaacaaaaatgaaattttaattttcattgaaagttacattggtgatgcagctgcatactattttgcttactatagagtgataattaattttactttaagatgtttatcaacaatataaacagtgctctttaaattagaacataaaaacattttattttaggacacttcgctatactttcataattacattgagattgaatttcatttgaatttaaattctctcaaagtatgccaggagcacattttgttcatgcatgcagtatatagaactctgtgcagaaatttgcccatttgccaataaaattggtcatctgcaaattgacagataagaactctttcaagggaataggaaactgggagctacaggattaaaaaaagggaaaataatttcaaaaacattttcaattagataagaaagagtgaaatgcatctagatacaaattagagtaattttgttttcttatttaaaatgtgaaatatttataaataattaaaaattaggaatacattattaagagtccttaaaaataagtatgtttgatctctgttagctcaaattaaacctattaaatttattatattgctttcttcctaaatcattacttctttgtcattggtaaagttctgtgttccaattttgaatgtcaggttctatatgaatgatttctgtgagtatgtgtaatcaaatgatccaagggatcctcagttgcaaattggtccacttatgtttatggatggtcatctacaaaactatataaatatagatacatgtgcattgttaatctgtggattgtttacttctccattccttcctgatgtaattcatgtataggttgtccaaacatcatatatccttataatgtatacattatatacatatgtgcatgcacacaggtatgtacatcatacatgtgatattttgtattaattatcatccttaaactcctcataggaagaagaaaattgacaagtattcaaaatgtctacagacatattaactttattcacaatcctacgtgtatgcacatgtgtggcatttttatttaatatatgtgggtcttaagtgattcactaaatagataatgggatttgcaatcaggtcctacaataatttggtaaaatacagcctcatgtatttgttctattcctgctttaaattatattctcaattatatcattgaggcaaatataaatagggacatatgtatagctagttgattatatacatttaatggagtcctgacctcaaatttattaaaatgcttactatttagttactcgttactatttaaaggaaactttgccactcccttggctttgaaggtgacatagacagttggatatttgaaaagtctgattagttaagtggtaatgctaacttagaattgttacagaattattcatagaataaatatgtcttgaaatcctctgaagaataaaacatattgctgttccattttatgcaacatttaattcaatgaattttgattatcaactgatacatgccagggagagttaaatgccacgaaaggaattatatgccactaaaggaaacaaaggcccagcccttgttgagcttctaatccctattgagggacatgtaataactcatatttttaatactatttgcaatgggataattgcacttgtaacagaccaattgttgcctcttactttacagcatttttgagaactttgattatttaatatgatagaactgactcgaaggcagaaaagtccctttgaaatgtatttataaatatatagtagactttttgtctttttgtttatgtgtcaaagtctcaaggtagaatttttttcaactttcattttaaaatcagggagtgcatgtgcaggtttgttacaaggctatattgcatgatgctgagcattgggtacaactgaaccaatcacccaatgaacagggtatccaatagatagtttttcaacccttaacctcttctctccctccccacgcttgtagtctccagtgtctattttttcctagatttatgtacgtatgtaccaaatgtttagctcctacttataaataagaacatgaagtatttggttttctgttcctctgtaattcacttaggataatggctttcagctacatccatgttgctgcaaagaacataattttgttcttttatatggctgcatagtattccatggtgtatatgtaccacattttctttattcaatccacaattgatgggcatcttggttgattccatgtctttgctgttgtgaatagtgctgcaatgaacatatgcatgcatgtgtctatttgatagaatcatgtattttcctttgtgtatatacccagtaatggtattgctgagtcaaatgtcgttctatgtttagctctttgaaaaatctccaaacttctttctacaatggctgaactaatttacattcccaccaaactgtacaagcattcctttttctctgcaacctcaccaacatttattgttttgacttcttaataatagccattcagactagtgtgaaatggtatctcattgaggttttgttttgcatttctctgatgattagtgatgctgaacgtttctttcatatgtttgttggctgcatgtacatcttcttttgaggagtatctgttcctgtcctttgcttacttttttaatggggttatttgttttttgcttgttgatttatttcagtttcttataggttctgggtattagacctttgcttgatgcatagtttgtgaatatttgcaaggtatagttttaatgatagaattcagcaaagagaatttgtcagcttctcaaaagagcaagatgactatttgatgatgtgataggaaatttactgtgaactgaaatgggaaaaactccacctcatacacaataaaataaacattactgtctttatgatggacttatgtatctgcttttactgcaaaacacacatgtgcttttttttttacatatttcctttttcctttccatatttatttattatgtatgctgttgctcccatttgtattcatttcttttttgttgtgttgtccagtttgatacatgataattatactttcatccagtctttgttcccacccccaaaacagatgggatgataaatgaaatatagtgctggaataggataaattcttaaaatgatgttaacaggagctatttattttttacgataattagcatttgttgttgtcatggatgaatgcttttaaacacgctgaaagtctgttatagctctgaatgatgtccaaaaatgatggaaaagaattggcttcagaaacaaagctgtgtttctgtcagtcattttggaacatatgattcattttaaatataaactaaaaataagttggctagatgacagcttgtaagcaattccagaataagttgttcatatttgctttaaaatccctgtgtttcatctttgtttatagatcagcagtccattaacaaaaaaactctggactggtaaacagaagcatgggattctattcccagttttgctactaaattactggtacaacttcagaaaatacaagaagggaatggaaatgcctgcagaaatgagctataatgcactatgaattgacattgtgttagttgctgtcacgtaaactatttcacttaatcttcaaaacaattctgtgtgtcccaaaggaaacaggtgatcatgacatcatacctgttatctccagtgactggctctcctgctcaccagagcctaaactagaaacatgaacatcttccttgattcttttctttttttggctcgacaacaatcggttgtcaattctatacttgtatgatctctcaaatcttttatttttttcctaccccctaccacttcttaggtcaaaatcacctccctctgtcagctggatgattaacagccttctaactggtctccctttttctagtctctccattgcagttagtgtaatttttttaaaaatgcaattctgatctgtttccctcttaatagcttctcattcctctaaggcatttttaagaagacttacaatgcttagtgtgatgtagcccctatacttgtccagtgatatttgagtccaaatcccccactaatttatttcaaattgagccagtagacaccttttagttgttgaaaataatcttctgtttacctgggaagctctctttctgatcctattcctcctagccatgaagtgcacacgtacatgtgcacatttgcacaaacacactcaggcataccatccggcttgggtgtcacaaagaaaggctgccctgacccctgctttcaagtctggaataggtctctccaaacacatcccaaaggaccatggaaacacccatgaccatccccacccccatgagaactcttatcacactctgaatggcttttcttgggtggatcttctactggatcaaccacacatctgagcagggtgaaccctaaggctgctcactgttttatcaccagcatctagaatgttgcctggttgtggaagtaccttaatacttcttaataataggaagatgtgttatatccatttttaagcaagataattccaatgagttaagtattctgccaaagtcaaatttggttaagtagcctttaactacttgccaaggaataaatagattcagccataattttcagatatatggacatgactcttttatgatttcaaaaattttataagaaagctcgagtgaattgtgtttctttgatttcaactgcagttaaacatatatatgtgagtatatacatatatatgtattcttatttgagcaattattaaatttctgtataccagctgctatcttaggcagaggggacaagaattatagataaaactttgaccttctccatgggctcagagtagagtaagttaggagagaataacactacactctagtgtaacaagtgcacagagaggcaagaaaacagcatcatgacatctcaggagaagaagggctcaggagaagaagctgcctggaaaggatggagaagagttttagagaaagtgacgttataaaattatcatgaaggataagtaaaatgctgcaactggagaagagtctacagtgtgcaacatgtgtaaatgtgaagatgactgagggagccagtttgtcaggaaattgcaagcacttcattatgactgagtaacagaaacaaggaagatgaggaatgatcaatggattttataaaaagctagcgtaggagagatcacagagagctttgtactaccaagtccaccttttcttgcccaccctgccctggaatctacatggttatagcaatatcagtgatgtttgtgtgatgtgagcctgctttcaaaccaccatggaatgcctcaaaaattggcatatatccattcacctttttcctggaaactcagaaaaagacatagagggccatctgtcagcctagactattgtggttactacggtctttggtatcaggacattctagactgaaatcctgaccctgtcgtgtagtttttagcaagggatttgaccactaacagtctgagagttgatgcatgtataaggtgaggataatatgtgtcatacttcacaggattgttgttgtgtaaagtgcctcatagaggaaacataacaagaatttaaaactttcaacaatataaatgctatgggccatgtgccatttttcttcactaaactctatgataaagaaattattaatctcacaatttttgaaattgatgcttgtttattataggaaattcaggaactacaataaagtttaataaaaataagataaaataatcaagattttttgctatcaagttaatcattttagatttctttccagtctgtttctctacaaatacacatacacatacacacaaagagcatatcatttagagttctgggaaagaaacagaagaaacacgtagcttgtaatcccactattttaatatgagaaaacttagatgcagtgagttgaagtaatttgcccaaggttacatacatagcacataagtgatagatctgggttttgaaactaggcagtcaactttagaatctactctgttaaatactgttacatgatgttagttgttgttttattttgtgggggttttttttggctctttttaaaaatcattattttaagcaagataatggcaagattagaactatttttggtaatggctttctgactgcagtgtggagaatgtgttggggatatgagatatggagagcaatagggcaacactggaagcaggggaattcctgaattagccaagttgaaaagagatgacagtttcaattaagaagattttgatggaataatgttgacatgaagaattctaagaggacttaggagatacagattgtagaatttagtaagtggttgccgggaaggagtgatgaagacaggaaataagaattactctatgttcctagttggggatactaatcagtggcacatttacctagaaggggaaaacaagaaaaacagcttcaagagagaagacggtgtctgcttcttaacatatgaagtttgaaacatctatgaaatattcacttgctatcattcagtggtattgtatatatcataaattcatcttaaaaataggaacttggtctgggcaggcatataatgcttccattggcattttgctgtgcccttcatttgaacttctttgtagtattaggaaatgaagaaaatcaacaaaaaacaatgaaataaaaatagggtgatagtacaaaagaaatgagttagtaggtgggcagccatggagataaatatagacatgagaagagcttacagacagaatgtacattcttttcattagtgaaggaaaagcagtaatatttttagaaatagtaatatttaccaaattgagcctagactaatttctatgatacgatcacaggaaaaaaaaaagccaaagcttttatcttaagcaaaaacacaaacactttcttaaaacactaactttattcatttggatgaagtatacttatagattgctttagatacatttttgtgtgcttttggagttagcataatataatggaaagtcaattaatagtgaaaactcattttattttatcttgcacgtatatttaaataggataaaataaaattaaagttaatataaaaatgtatattcctggaagacactaatttttgaataagataatttttatattatgaagcatacaatcaaataatttccattttattttagggagtggggtaatttggatctcagatgattatatgttgtacattttaaatacaagcttcaagtgctgtgttctctaattccaagtgcaaatacaattagcaattatgagttaaacttaattatttggatatacttgattacatagcttggtgtagtagtatttccacacagttggttatgcttgaacttatttttttattcctatttaagcaatcataaaaatttttttagaaaaaagttaactcaagatggattaaagacttaaacgtaagaccaaaaaccctaaaaaccctagaagaaaacctaggcaatacctttcaggacataggcatgggcaaagatttcatgactaaaacaccaaaagcaatggcaacagaagccaagattgactaatgggatctaattaaactaaacagcttctgcacagcaaaagaaactatcatcagagtgaacaggcaacctagagaatgggagaaaatttttgcaatctatccatctgaaaaagggctaatatccagaatctacaaggagcttaaccaaatttacaagaagaaaaaaccctatcaaaaagtgggtgaaggatatgaacagacatttctcaaaagaagacatttttgtggccaacaaacatatgaaaaaaagctcatcatcactggtcattagagaaatgcaaatcaaaaccacaatgagataccatctcacaccaattagaatagcaatcattaaaaagtcaggaaacaacagatgctggagaggatgtggagaaatagcaatgcttttacactgttggtaggagtgtaaattagttcaaccattgtggaagacagtgtggtgattcctcaaggatctagaaccagaaataccatttgacccagtaatcccgttactgggtatatacccaaaggattataaatcattctactataaagacacatgcacacgtatgtttattgcagaactgttcacaatagcaaagacagaatcaacccaaatgcccatcaataatagactggataaagaaaatgtggcacatataaactatggaatgctatgcagccataaaaaaaaggatgagttcatgtcctttgcagggtcatagatgaagctggaaaccatcattctcagcaaactaacacaagaacagaaaaccaaacaccgcatgttctcagtcataagtgggagttgaacgatgagaacacatggacacagagggggcacatcacacactggggcctgtcagggggtgagggagtaggagagggatagcattgggagaaactcctaaggtagatgacggcttgatgggtgcagcaaaccaccatggcacatgtatacctacgtaacatacctgcatgttctgcacatgtatcccataacttaaagtataataaaaaaaagaaaagaaaattatttcttgggttctgattaaataatagtgaatatttacaaatatgtttataggactaattctcaagttttaaaacctttaaaatatatgccaacacggaaagacaaaaatcaaattttgaatctgtagcaatcacacaattcatgtttctgtagatagtgaaataaatccacactagatctaaaaatgtagaaggagcaagtcttatactaaacctcaataatatttgcattttgggggggcggggaaatgtgaaggaagaataattctggtgatagtcaaacactgccattttttaatttacatttttctaaatttaagcatattggcatgcacatttttggtaggtactgccctcctgccccctacagcctttccttgttcttggctatcttcctttctatgtggtgaagtgggaaggatagttcttgtatcatctctctgaaacacttgaaaattttgaccattccttttttcagggcaaaaataaaaattattttgctttggcttctgcactgtcattctatctgtgttacctccttctttttggccatttattcccattgtcatactcttaaactcctttttcttttcctatttcttaactcatgatgttgttcaagattttattcccagtcttgttttctcattgtttacctcgttctccctaaaacctttcatttgactcgtgtttctgtacctgtatgctgtagactcaccaatctacattttcagttgtttgtactgacctccatattcacagttccagccatcactgatcatctttatttgaatgtctcataggtacatctaacgcaacataacaaaagccaaactcagtatctttgcccgaaatttgctttttactcctgaatttccctctttattgggttgcccacatcagatccctagtgatcattctagattctttcctctctctcaccctctattttcagttgatcatttagacttcccatttttatctcacatttctcaaatttactcctagcttctatccctgtcttagttaatatcatttagtgctgaaacaacgccctgcctgctactctatttaaatgtgtctacctgacgtagagaaaagggtctttttttgaaatgatagtctcatgaggtcattcccaagcttaaagctgttcatagtctccccagttcagagaaaaacgaattgttcctcggcatgacacatacagtgtccatcattgacactctcatgcctctctgattttaaatttctggtattccttctcttaatattgtgctgcagctttccttgaataattatagctctctcttaccaagcatgctatgctgtctcaatctctttgctgtgcacaagttgtcctctctgcctgatgtgtctttcccatttggtggcctattcatcacctgtaagatgtaccttaaaatagaatatcatttctaaatatttataaattatttctaaatattctaatatttagaatattatttcttgatgcaagagttactttagtagataaaatagttcatcttcatttctgtagtaagtcttatttttagcatcctcacataagtaatttagcaggagtgatgctgtcctggtcatggaagctctaaatatcttacaatttatttacctatttattcatttactgatttgtttgtttgttttattactttatttactccacaagtaattatcaagtatctagtatgtgtcagcactgttctaggtaccggagatatataagtaaacaaaatagataaaaattctttgccttatggagcttacattctaatgtaaggtgataaacaataacaaaataaatatgtgtacacaatagtatcaaacgtgataggtgttatgaagagaaataaagcaggagagatgtgtagggagtacatgggaagaaatattgcagtattaagaagggttgccagaaaataccttatttagaaaatggcatttgaactaagacttgaataaactaagcaattatgccatatctaaagaaaagtgtttcagaaaaagcaaggagaaaaaaatataaccacggggaaaatagattaagaattttgagctaaaggagccacgttttagttttgatgatgagttttgggaaaatctaaaaaccaaagaagactattgtgacatctgtcatttgttgtgtgtgtgtatgtagatctgtagatatatgatgacatatgtagatgtttcattactgttttagtaacaataatgtcatttcttttaaaatagctttgtgtaagcctgggcaacatagtgaaacctagtctctacagaaaaaaaaaaattaattagctaggtgtggtggcactcacctgtaaccccagctactcaggaggctgaggtgagatgattgcttgagcccaggaagttgaagctacagtgaaccatgattgcaccaccctactccagcctgagcaacaaagtcagattctgtttcaaacaaatacacaaacaaaaaatagttcagtgtaaggacttgtccacgtaaaagttcgtttttcttgttgttaagagggagtctcgctctgtcgccaggctggaatgcagtggcgcaatctcggctcactgcaacccccaccttccggattcaagctattctgcctcagcctcctgagtagctgagactacaggcacgtgccaccatgcccggctaattttagtattttttagtagagatgggatttcaccatgttggtcgggtcgcaaactcctgatatcaagtgatctgccctcctcggcctcccaaaatgctgggattacaggcgtgagccaccaagcacagccagataactgattttataagacagttatgttgacctagtgtatcacatgtatcaaacctaggtttaaatttaatccagataggatctagactttttagaggtatttctgatacagaatcacttatttttagttaagtattcaataaatgaccatgttagacttatttctcctctttatagttcagtgtaaggacttgtccacataaaaattgagtgccactgcaccccagtctgggcgagagagcgacactccatctcaatacatgcatacatacatacatacatacatacatacacacagttttctgttttctgggacctaatatttgctactcaacattctataaactttactttgttttaaatatatagtatatatggtatattcagagataacattatctaagcatctaactttttcagaatgcaagaaaataattaaaactcaaattctagacaggctaattgtccattccagagttcttccaagttagaagtggaacagtatccactaggatagtatttcagtgactcaaaaaggaaccaaacaaataatttttttgcatgaatgcattaaatgcgtactaataatatcttgttacaaacagaattctgactaacaaaccctaatgaaaatacaaagcctaacatatacctcttcttatccccaaagggattattttactattcataaatacttgtatttttgtaagcccagtaatctttcttttgagaaaacaaaacttattgtgtaacatatcttacagttataactcaaagcacttgtttttaaatttaattcataacacagaataaaatatctgggctactgttaaaactaaagattcctaggcaaatctctatgattcagtaactctagagttatattcaggggcttgcatttggaaacatagctaattgtagtaggcattcctcacatttaccaatatctctggttatcttcacttctaaacctcaaaaagttgcagtttccaaatccttgctgtggccaagaggattgctttagctgatgaaatgtgataagtggcattgttcacttccaggtggatgcatttaattgccttgctcttcctctccaactcattcatttcccaacatagcaattgtgctcaagttcaaagcatcctaaaataccgccaaaatatcaaagattgctaacctggagaattatctggacctacagcagacctggcttttatgagatatgaaatcttgttctgttaaatcactgtgatttgggaagggggatgatttttactatagtataacccagtcaagttgtcgttgaatttccatgtgtattaaaaacattaggaaggcttgataaaacactgcttgctagactgactcccagtttctgattttataggtatagttgtggcctaataatttctttttctaataagtttctgggtaatcgtgatgccattagtttagtaactccacttgagaatcactgatctagccaatcttgaccaatatacaaattttcatattttgaaacaaattgacattaagtcaaacttatcaatatgataaacaaaggcatcattttgtatgtaaaacaaatttaaaatgtttaaacaagcataattttttagtgatttaacactgacaaaattattaatcacttcttaaaaacacttaattgtctgaacttcaacactgagtagcaattattctgctaaatattcttgtccttaagagtattcaaaatggttttgaattagctttaatatgaaggaagaacagtcccctgtaaatacagtaaaaattgtgaagtataaattgagatttaaaacaatctgatattactagaatgttttataatatccatttcatataaatttaaaaatagttttactttttaacttttaaaaaatgtacaaaaagtactaattaattacatgtgcaatgattctgacttgtcatttaagtatttttttcaaattccccattccactctcacaatgaactttttatccaattgaaataattgagttggcattaaagaaagaaaattaagtcagctcttaaaatcttaacactaacttgttaattaccctattaataacacaatgaaaaatgacaagctgtaattccttttccaaaaatatggctgaaggtcagagagctgtcttgctggcatattgagagaccgaaaattacaaatgatgagcttttttttcttttaaatatcatcagatgccattagaaattcagcgaagagactagatcaatatttaaaatataattttaaacataattttcctattattaaagaaaacaactgctatatattaggaaataacctagcaaagatacttgtatttgtgtgttaagaagacaaatctaaagggtttccaaacattgtccaggtctgagcttttacactattgaaaaaggattccgtgtgcttttagcctacagcaaagatcaaaaagcattcacagagcctactggcaaaccagagataaatagaatggttttctctgccattaaacaataattcttgaaaatgacttttttcttttatgtggggtagagtaaatccaaattatgcaggacaaagtttacatgcacagtaagtgatctattgtggtattgtttgcatttttcttggtacagtttaatttattgttgtaactgcttcgctatttaggagaatagaattggttaccaaagacattgtaaaactgttctataatactgtagtactcatttaatatacatatataaatagttttactttttaatttaacttttaaagaattttgcaaaataaaacagaattctgtttcagagtagagacacttaaacatttgtagttttcttagaacatgtataacagtaccataatcttgtattcagatttttaaaatttgtaattgtggtaaaatacacatacaatttgccatcttaaccatttttaaatgtacaattcagtagtgttaaaaatattcacattgtagtgcaaccaatctccagaacttttttattttgcaaaactaaacttttgtatgcactaaacaaccattctccatttctctttccatagtctccagaaaccaccattctactttctgtttctatgaattaaatactctagatactcatagaaatcgattatacagtgtttgtctttttgtactggtttatttcacttaaaatagtattttcaaggttcatcgatgttgctgtgttgtaaagtgtcgaaattttctttgtttttaaggctcaattatattccattgtatgtatgtgtcacatattattcattcattcatcaaatacttgggttgcttccaccttttagctattataaataatgctgctatggacatgggtaaacaaatatctctttgaggccctgttctcaattcttttcagtatatacccagatgtggaattgctggatcatatattacttctctgttgaactttttgaggaaccatcatactgttttccataatggatataacatcattcctaccaacagtgcacaagagttctaacttatccgtatcctcactaacatatatatatattttaattgtactcatgttgatgggtgtaaggtgatatctaactgtggttttgatttgcatttccctcatgattaatgatgttaaacacatttctatattcttattgatcatttgaatattttatttggggaaatgtttaagttgtatgctgatttttttattttagctgtttgattcattggttgttgagtttcagtaattctttctatattctggatattaactgactatcagatatattatttgcaaatgttttcttctattccatgggttgctttttcacgttgttggttgtgtcctttgatgcaaatttttaaatttcataatccagtttatttttactttttttaaacctatacttttgctgtcatattcaataaatcattgccaaatctaatgtcatgaagattttcccctatgtttttttctaagggttgtatagttttagatcttacatttaggttttttatgttttttgaattaattttttttctatcttgaagagtaagagtccaactttattcttttgtatgtggatatccagtttccctatctctgtttattgaaaagactattcttttgtcatttattgaccacatatgttagagtttattgttgaaaatgaaaattattttaccacatatgtgagagtttatttctgagctctctattttattccattggtttatatgtctgcctttgtgccagtatcatactgttttaactagctttgtaataagtttgaaatcaggaactatgagatctccaactttgttcttttttaagattgttttggctagtcaggatttcttgagattctatatgaagttttagctgagtttttctgtttctgcaaaaaattttattggaattttgatagagagtacattaaatctatagatcactttgagtaatgtactcatatttttaaaaccaaggaaatttgagttatactaaaatatactttataaataaaacaacatttatttgtcaatttattagtctatttagtagccaatcaactaacatagattctttctatagcagtacatttgctgcttcagttagggtccatcacattctttaatttgagctcacttccttatttgtctgaaaattattttttctttataaactttatatactgatgacatatacaactatataaagtaatatcttatcaagcacttccttggccaaagaagaaccaaatgtgaataagatgttttgattctccaaatacttaaacactagtgttacaaataaattacagtacagtatgataaatgctaaaagagagttatataaaagtgttatggcaaactggaagttgaaatcaaggagatccagttggttggagaactaaacagagatgacatttaaactgggtctcaagtaatgttaagagtaggtaagataggaaatgcaagtgtacagagctgtgaaatggtatggtgaactggtagcatgatgaaacatctactgaggttgatacaccagacatcatctagagatgcccaagaataaagacaaatggatcaaaagagatcatgaagggactggcaagactgaaaatcagagcatataaccatataagactaaagtaggttagtcaccagcagccctgtagaagaggctgtggctggaatttgaaattattaaatatcactggacaggttggaggcataaataggttccaaagaacagtcttgatttaggcctcataatgctgcttaccaagaatcaattaactttttaggaaaaagtgatataatgaatttttgagtatggaatttttaattcatataatgtatttagaacattaaaaggttattaagttttgtagttattggtgctatttaccaaatatatctagctctggtctcaggcatagaacagaattgcattttctcaccctctttgaggttaggcaaagccatgtgattttcttttgccagtgaaatgtgagcaaagtactgaaatatttcttggtgactgtttcaaaagtcagttatcagtttgtcacattttcttctccatgctatagtaatgatgagaacatgattcttgatggaggtactggagtaactgtaaggtgcaaagccaccctaccaatccatgctagacaaacaataggaacggcaataaacttgcctgttgtttagcccctgagacatgtaaacataacttaccctatcctgactgtacaacaagtaagacataataatggctgtagaaagccttgataacagaataagaagaaaaaaaaaaaaactaaaatcaaccataatcttacccaaatgagtcattgtaactatttttatatttacctcttaaactatagtgttacaaagaagcttaattcatcatgtcaattatttacttaattgtgacagatgtttactctgctaaaggtatatgctgttgctctctctctcaggagattagcttccctgtcagtagctattgtgttataactagccatcatcaatttttctcttaagtgggaaactacaatacataacaaggttgttttgaatctcatatgagacaaggtatataaaataagtggcacatagtacgttaaacaataaagatgggagaggccgtttgtctttctaaaggtttgcttatcaaaattttaaaatacttgataccttcaaaatataaaccatttttgttcaacaaaactaaagcataatgtaataattctccatctcccttaagcaagtgtatgccatttgtcattttctttaaaaataaatgaacttgttcaattagttgaaaattttcttttatagatctgattttacaagttgatgggtttttattgcagcattatgtaaaaaagcttgaactttattgctcttgattagtccttatccttctaagaattttaatggtaatagaatattttaagatgcatcagtgcacatttatgttgaatgttagtatcctttctgctctttactgactaacactacagttaataataaaaatttatctttatttttgaaggcttattatgcatatatgatatttatacatttttggtgataaattctatcgccacctagtgctttggacaacattttatatttctgccatttctttttgcattacattaagatgtgtaaactgtgactgcccattcttctcataagacttttctctccccagtaagcttacttttctctccccagtaagctgttccacaagggcagagaatgcgttttctttagaactgtgtcctcacctcctggatcagggcatggcttgtagtagatgcttaatgcacatttggggagtgaactaatagataaatactatacagttcagagtccaataactatattctgacacaactacatcccctacttggattttaaaagagaaagtttttgtatcttcttgatgatctaattataatgctgtgcatctagtttagccaggacaagatttacatatgttgctgaatttagtaaattcttacttcctggacttcagataaggtaaaaagtaagcataattacaaagggcaggaaaaacccttagttatgaaaatatgtattatcttgactatggtaattatatcataatgtcaaagttaatcaaattttacactttaagtacatatattttagtttactttaattagaataaaattgaaaacaaaagccaaaaaagtaagaataacatattaaattgctttatattacaacagcaatatttctgtaaatattcttcctctacatttcaaaatttgcaaaagatatcaccacaggcaattgggcattacttttgagattctttgtcagtggaatacattaaatctcccgcctgatagagaaattaaaactgccacatttctgtctctgctagcatcatcttgaaatgttcatccctcaaacaggaatagatggaaaggagaggaaaggagagatgaacagagtttggagaggaaattacctcattactatgagcacagagaagagagacaagaaagagatataaaacatgagaggtaaacataataatcatcatgacaacaacagctattgaaagctcgctgcatgccagtaacagtctaaacacttagcatgcatttctcgtttttctgttttcatggcaactctgtttagtctccctatataaaaaaatgtaaaatctgagtcttaaagatgttatgaaacttttctgagggaaagtacaagtgtcagaataaggatttaaacccaaaatgttgaatctaatagtcaggttcttcactgaacgctatacctgttcataacagacacaaaatgtaaaaaacaaagaggtaaaacagaaagaaacaagcttctatgtgtattggtagatgaggagagactttgcagctgatgctaaacaagaggctagggtccacagctatctacacatctcctcaagacagagctccactgtagacagttaactccaggtagacagaagttaagacatgtggaaaacattaaatagaagcaattgtttgctataatctttgccacttttgcactgtatgcatttttgaagatccaaggccttctcccaggctatagaagtgcactttaagccaatattttgttttatgagatataagaaatcacagccatataaataaggcacaagcagagatgagtaaatggtatatagtgtctccagttttagaaaggatgcagattatatctgaaccagcataatgtcactacaagaaggatgcataatgtcataaaaatgtacttcatacgactcagttatttgtattttttatttatttgtttttaactaaagatgaatagcctctgccatattttaaaagggcaggcaatataaagttcaatattagaaaatgtacctaaatgactggaaaacacatcttatgaactagtatattaatcattcagtgtaggaagcagaaggcaacattacatatcactgtgatgtgctaagtgctagtctcaaatattcatggcttaggcaagagtttatcaaccttggtgctgtttagttgaagtcatggggggctattttttgtaaaatgtttaccagcatccctaacctttacccagtagatgttagtagtagttctcatccccagttgtgacaattaaaaatatctccagactttttgccaaatgtcccctagaggcaacatcacccctgatggatcactggcttcatttgagtatatttctaatcattatttttcattaaataattatgtttcagacttgcagtaaagatatgctgtaactttagatatgatttagaagtctatatcttagaaactactataaatagactcagtacaattggaagtggaattggactaccgatgattatattcattcacataaccatttgttaaatacacactaaatgcctgtcactgttccaggttctaggaatacaaaaataaaggacacatttgagatctgcattacaccaaaagtgatataaactgtttattgatccagattctccaagatctacttttgtattctattaatttaatcatcagaaaccatgaattgttaggccatattaccttacatctatgtagaaatatttttcctaagttatcatggtttctctgggaaatgaatataaaaatttcctttgaaatattttttagttttttttaaagtgatgagccaacataccatgcaccatgctattcactgtcttcaatccaaataacaatttacatgataaactaaagattgaattcaaagcataaagattgtttatcaacccttgatttcatttatttatcatttgagataacaattctactttttaaattatttatatcgttagagaattagagaagaaactatatgtattagtctgttctcatactgctaataaaaagatacctgagattgggtaatttataaaggaaagaggtttaatggactcacagttccacttggctggggaggcctcacaaacatggtggaagataaaggaaagacatgtcttacatggtggcaggcaagaaagcttgtgcaagggaattcctatttataaaaccatctgttcttgtgagacttattcactaccacaagaacagtatgggggaaactgccccatgactcaattatcttcacttggccacacccttgacacgtggagattattacaattcaaggtgagaatatgggtggggacacagccaaaccatatcactaaatgttctgagtacttaccagaatcattctctccggaagcttccttctaactgtgctctctcctctcttcctttcaagaaggtagtttaggtcctgggataaaaacaaaagacaaacaagtgacataatactagctccagaaactgtgatagcatattttatttccatcacctcaatcccctcaggaagtacagaaaactcacagagagcattgaagaagtaaagaagttatgcaacgtgcccaaggtcacacagtgcttggtacccatgtttgactcaatcttaagtccatgcttttgtcatgccactgcttttcctctggatcacgtgggttggagtaatattaaacatgtttaacaagtgatcttacagacagcaaccaacagctcgtacatcatagagatgtttactagctgataatcagctttcacccttctagaagacccagtctacatacaagtacaagccacatttaatttcctacctgtattctcataaattagtcgaactgagtcaccttcctaaactctggataccctccttataataatcttggagatttaagattatagcaaacaggtaaatgagtttataaaatgttcaaggcaccagcagtgttactgtgcttcagggtagagtcagggaaattagaccaggtgccagctaagagtaaagggagaaagcccagagtatgattctggatcactgacaactgatgctgtgggctgaggaagggaaaggtgcagaagggtgaaagtgggtggagtttggtaccaagtctgagcagaaactacacattaggactgcaaaggagatcagtaaaagccagatgatccctttttccatctctagatcttctagaagtaaatttcacacagttaaggctcattaagtgctcctagacaagctctttgcaacagggcttcctggggagtccagacaaattactgtttcctttgaccaaagcagcctgaaagcaggttggacctctttattagaatgaacttaggtacttaaattctcctttccctttcagagcacataggatttttctgaccataactaaagtgcaaaggtttaaaatactaataattccaagaaaggaaacattggaaaccaattagtaaggatatccatctaaatgaccagaaagatattttccactgtttggctagaaggagaggaaaaaggcgtgctgaccacttggtttctgaagcaccagaggggtcaccaatgtgaggaaaaggataagagaggggaatcttagagcaaagatcaactttaaccacctccttttcagtttaagtctccaaattcccctgtcaaagaatactcagtcgacaaagagaagctgtaccaaaaactgtttcatccataatcagctgtgcccagaaacagctgatgcagggagtgaggtgcattagcagaaagtcaggtcaagccccaagcaaaagtgatggttggtgagcccagggtctctttgaggagactccagcctgaatctcccattatctgccctccctctttgctccattagaaataatcactcctaagtggcccattatcaatgccagcatgattttttcacatttgctaaaagcttttccctttttcttttgtttctaaggaactattttaattccctctcccctttattttgcagttaactgacttgaaaaatatctgatttgaaatggggcttacagaccaatttcttctttccttcagtacatcccacgacccattccccaccccctagcacctagtaacagccatcgcatatgcattaaacaaaagacccattagtggagcattgttttgcacttctgcagacaaagaagaaagagacctccagttagaatgaactctttttgtatttctttctttttctttttttttttttttttttggcaacaaatagctttcttttaaattcagaaatgaaatggaattgagaccctaaattgctctcatctaaaatgtttcactctcatcttcactttcctagattatgatcaattttccccagaatgaataattcaaattgagcccagtcttctgaatccttagaaaaaacaatgccttagcattttgggtctattctactcacttatcacttggcacattttgtctggtactggcagatattctttttgtaacatataatttatttttccaaatggactacaagcttctgaagattaaagaccatttcattcattcattcattcattcaacaaatgtatttgagctcttaccatgtgttagacatgtgctaatcacttgcaatacagccaagaactaatcagacaaaaatccctgcctccctggagtttatattctagtggagggagacagagaataagaaatcagtgtcataaatatgtaaattgtagagtatgttagaaggcgataagtgcaacagaaaaaaatagagcaatgcaagaggaatctgaagcttaagggagggctacaattttaaatagggtggtcatgggggatgagagagtaagccatgtggataaacagaagaacattccaggcaaaggatatacattaaagtgagaacttaaaaaatggagttgccatcagctgactgggaaggctgtgtttggatatgttaagttttgggtgcctactaacgtctcactggagatctgatggagtaggcagttggatataggtgtctgaagatccagtagggtctgggatgaactattcatttgagagtagttttaaaaacatgaaattggatgagatcatcacagaagtgagtataaacaaagaagactcggagatgacaggaaatgatctctaagataagaagaaaactaaaaatgtggggtaccctgaaagtcaagtgaagaaatcatgacaaagaagcagagaataatactgctggtatgtcatgtaaatgaaggctgaaaattggctgtggaatttagcaatctggaggtcattggcaatcttgccaagaaaagtttccgtggagtgatggaggttaaaacttgattagagtgagcttaagtgagaatgcaaggtgcagtccaccagatgtttgtgttccccctaaattcatattgaaactctcatcccagtgttattgcacttagagatggggcctttgggaagtaattaggtcatgaaggtggagccctcatgaatggaattagtgtccttaccataagaggccagagagctagctcactctccttctatctgtgaggatacaaaaaggtggccctccacaactaagaagaagattctcaatagaacctgatgatacgggcatcctgacttcaaactttcagcctctagaactgtaggaaatatctgttgtgtataagccatccagtctatggtactttgttataccagcctgaactaattaaggcgggggcaaggatttgatgattatatatacagacaacaatttttagaatattttctacaaagaaaagcagagaaatgaagtgatagatggcaggggaattggtgtcaagataaaacttaattaaaattaaataaataacagtatgtttatattctgctgggaataaatcaggagagaaggaagacttaataatgcagtattgagagaattgtgaccaactgtaacaatacaaaggaaatgttattttttatagcaggtagcaaagcggtttcctcaaaggagagaccctatttgtgatttctttcataagcctgcttagtggataggcctccaggacttctttgtcagctggtgcttaagcttgaggagttgaaatgcgtttgtgtttgccataggaaagaggaagagaactggacaaggcatgaggggaagaagactacatatcacgtagccaagaagacagatgtggggagtgcattgtgacttgtgatataaaccttctcctctgtctctctatcttttcaccaaaatctacacttgtagttttgctaatggaaaatgtcaagacgtgctgaaagttgccttgaggttgtaaacagatttaaagagtgaaagtagagcctgcccatggaaggacaagtcatgggggttacagagtggactctctctgacagacttctgttattattgcttgccccaggcagctctcacttattttgtatcaaattatcccctcagaacgtcatacctgtctcattctacaaagtcttccctggcaacacacactctagactcctaacttacttagctacctggtcttgacctttggagctgtcatcctatgcctatataatggcccagcctctgcttactcctcacccccaccctgcgccctcactccccaccacctgatctctcactaccatgtttcctccttgatcaatgccaggcaaagtgaactatttgcagttccccaaactcgtcatgctgtctcattactaacgtctttgtgcattaagttccctctgcctgagtatttttctactctttcaagagtcaagccctcctctttgctgatttaactcagagtcctttaaaattttgtctaaaacatctttattttctttctttcttttttttttcctcacttgttgcccaggctggagtacagtggcactatctcagctcactgaaatctccacttcctaggttcaagcaattctgcctcagcctcctgagtagctgggattacagttgcctgccaccacgcctggctaaatttttgtagttttagtagagatggggtttcactatgtcggccaggctggtctcaaacacctgacctcaggtgaaccacctgcctcggcctttcaaagagctaggattgcaggcatgagccactgcacctggcactttaaatatctttctagtggaaaattataccggcttatgcacttctctcatggtaatacttttcataatgtaccacaactgatggtttattttctgtctcctcgtttaaactgtgaggtctctatcatcctggtattctttgtacctaggatagcatctacttcacagtagctgcctaataaatatttgctgaaaactgaataaacatctaatgtcaaaagttgtgaataccaggtaacttagcataagccttgaccccatatgagtggggcttagagttcatctgctgctctaaaatcaaggtcattgtatctagtagtgaccccctggtactcacaactatataaagatacaactgggatcgtgatgtttgttcctattttattttactttttttccccagtcctgtattagaactagaagctgattggtcctgaatcacaacgaatttgactggagtcctatccttcagattagttcttctgatgtctgcttctatacttccagctaatagagcctttcccaaggtcaggtagttggcctacattctctagagcctgaatggctaggagactgaggttgcacagcatctgctgctatttgactcttttctccctactcctctccccattctgtaatatgttcaataccagcaccagtctgtaataaggcaaattttatgactggatttaggatcccatttgggaagaagtattactgtactattgcattggttttctatctcaactaggctacttccaacttacacttcacccgtgtcccacccacccaagatgtcaggtacatctcacagctgagacctgggttattgttccactttaacctctatgccagatgtctacctgctgaaccattttgcatgctcaacccactctcctatccacctctgctctgaaatctttcccaattcccactcttcatcttgcatgtactactctcagctcttccttgtgttaacaacttagtgtcttttactgaaattaaaaattttgtcaggaagtttgcagatgacatatatatggggattgagtgtcctggtacaactaactttgacctttgaatactataaaactatagctgtggaactttgtatgacaaatcagtgattcttctagttctggttcccaaatgactaataaaaagttaacaattttccacatttctctgattttaaggtactcatttaatactcattcctatccctaaagctcaagttcataggtttcctccaactgtctaggaagattaaatcacatgtgtaaatgtgataagagtattttaggtttgaacacatggattgcagaatttgtatgctggccagaatttctggtggagtaagaattttttgtagaaatttattccacccatcatgtaaatggctaaattcttcttaaggcagatcattacctagatattttgacagatttggcaaaaagaaacaggacagcccaacctaattcaattaatcttaccacctattcttaagaacaattactcacaagaaaaatacagctgcaccaaagaataaaatccatacctgccacttattaaagtaattttcaatttgcttaagtctctgtgcctcattttcctgtacgaagaaaaaaaaccacttcctcgtagtaagttgtcataaatattatcaaatatcattctcaaaaatcctgagttgcattaaagcaaaaataaatcatgaatggtatatttttattttctttttaaaatgtagaataaaacacaatggaccatagacatgtacttagggtaccaaccagtggacatgacaagataacataatgttgatagggaataggagtagggaacaatgtataactatctaaatgtgcatgggaaggggtgctaactagccctagtttttaggagttccctacagaattacaaggaccactgcttaatatcagttatgagagaggctgtggtatgcatcagcttattgtttgggaagagcttagtatgagatggacccttctctcatcttattaggactgaaaaattaagttagttgatttacgggaaagtggtaaagatttgaaaagtgatagatatgataaatggcaggctgggcatggtggctcatgcccaaaatcccagcactttgggaggccaaggtgggtggatcacttgaggtcaggagtttgagaccagcttggccaaaatggggagaccccatctctactaaaaatatgaaaattagctgggtgtggtggcaggtgctcataatcccagctacttgggaggctgaggcaggagaatcgcttgaacctgggaggcagaggttgcagtgagctgagattgcaccattgtactccagcctgggtaacaagagagagactccatccaaaaaaaaaaaaaagaaaaaagaaatgataaatgacaataagaaaggcataagagaaaaatattcaagacaatagcaatgaagaaaatatttaaatgttctaaaaatattttggaataggtgtttagaaattaaaaaaaatgatttatgcttaaatacaaggctagacttttcatttcagcaaataggataattctactgcccaaacatataggtagataatattcaacctttaccacaaatttagtagccattgtcattgttaagggcaacagtaaagtattttggaaacatttggaatttaaatcgccctttgatagttaaactgtgaaattaacacataatgaatatctatgaaaagttgcaaagctaccttaaaaaacacagaaagcttcccagttaaggctgtattacatctttactgaaggtaccaatataaccaaagaaagaagaaagaaaatgtccatcagaaagaggacttaagtcagacatttaagtttcttaaaagcagaggcttgcagaggaaaccaaacacaacacttctccaaaaattgttaacgggaaatagatccttaacatttactaccaataaggccagttatattgcactctggaggcaaagactaagtactatatttggagaaagacttccagggtttaaatctggctttgccatttaatagccatgggcctttcaaaataatatcccagatatcagtgttttaacttcatctgcaggtggggctgacaatatttcttcttcatagagttcatgtggataaaatacacactatcaataaatgttatctatgattattacatttactgagtgatattgataggctttgtgtcctcacccaaatctcatcttgaattgtaatctccttaattctcatgtgtctgggcagagacctggtggaaggggtactttgccttatggtgttcttgtgatagtgagttctcacaagatctgatatttttacaaggggctcttccccctttgctcctcacacttctctgtcctgccgccatgtaagatgtgcctcttttccttccaacatgattgtaagtttcctgaggcctcctcagccatggggaacttaaagtcaattaaacctctttcctttataaattacgcagtcttgggtggtatctttatagcagtgtgagaacagactgatacattgagccaattccctttgccctgatttcaaattaacattaagcaaccttcagattatgatatggtttcttgtataactcaagaaagcaatggccaatttgagtattggcacgcctggaacaggttttgtatttttattataaattaatggattgaatttctcctgttatattccagtcttatgatcttgattattatgagtctattatgttagcaatgtggcatatgtttgatagcaacccaaaggtcttttgagctaatgtcaagattcaaaaattcaacacaggttgcctcagttaagggtgtaaatttttttttcataagaaattctatttccagggaaataaataatagagaatgcatatagatacatggtagggcatcagtcaaatctaggatgagggggagtatagagagaattatccctgttcttctttcacttatgctgatagaggctaaaatgcaagataatctcctttctattagtaacttggactatttcaatataccctagtttaccaacccatccttagatatgcaaccaaagtgatctcttttttaaaatttattaatttatttattttattatactttaagttctgggatacatgtgcagaatatgtaggtttgttaaataggtatacacaagccatggtggtttgctgcatccatcaacccattgtctacatgaggtacttctcctaatactatccctcccctagtccctcacccccaacagaccctggtgtgtgatgttctccctctgtgtccatgtgttcttattgttcaactcccacttatgactaagaacatgcagtgtttggtattctgttcttgtgttagtttgctgagaatgatggtttccagcttcatccttgtcccagcaaagaacatgaactcatccttttttatggctgcatagtattccgtagtgtgtatgtgccacattctctttatccagtctatcattgatgggcatttgggttggttccaagtcttagctattgtgaatagtgccacaataaacatacgtgtgcatgtgtctttatagtagaatgatttataatcctttgggtatatactcagtagtgggattgctggatcaaatggtatttctgtttcttgatccttgaggaatcaccactctgtcttccaccaacagtgtaaaagcattgctatttcccacatcctctccagcatctgtcatttcctgactttttaatgatctccattctaactggcatgagatggtatctcactgtggttttgatttgcatttctctaatgaacagtgatgatgagctttttttcatatatttgttggctgcaaaaatatcttcttttgagaagtgtctgttcatatcctttgcccattttttgatgaggttgtttgctttttcctgcaaatttgtttaacttccttgtagattctggatattagccctttgtcagatagatagatagcaaaaattttctcccattctataggttgcctgttcactctgattatagtttctgtttctgggcagaagctgtttagtttaattagatcccatttgtcaattttggcttttgttgccattgcttttggtgttttagacatgaagtctttgctctgaatcatattgcctaggttttcttctaaggtttttatggttttaaatcttatgtttaagtctttaatccatcttgagttaattttgtataaagaataaggaagggatccagattcagttttctgcatatgaccagccagttttcccaacaccatttattaaatagggaatcctttccttactgcttgttttttgtcaggtttgtccagatagttgcttgcagatgtgtgatgttatttctgaggcctcgttctgttccattggtctgtatatctgttttggtaccagtaccgtgctcttttggttactgtagccttttagtatagtttgaagtcaggtagcagtatgccatcagctttgttctttttgcttacattttaatattgttatgtgtgaatttgatctcgtcattatgatgttagctggttattttgcccattagttgatgcactttcttcatagtgtcgatggtctttacaatttgttatgttcttgcagtagctggtactagtttttcctttccatatttagtgcttccttcaggagctcttgtaagacaggcctagtggtgacaaaatgtctcagcatttgcttgtctgtaaaggattttatttctcttttgcttatgaagcttagtttggctggatatgaaattctggatgaaaattcttttctttaagaatgctgaatattggcccccactctcttctggcttgtagggcttctgaagagagatacactgttagtctgatgggctttcctttgtgggtaaccagatctttctctctggctgcccttaacattttttccttcatttcaaccttggtgaatctgacgattatgtgtctttggggttgctcttctcgaagagtatctttgtggtgttctctgtgtttcctgaatttgaatgttggcctctcttgctaggttggggaagttctccttgataatatcctgaagaatattttccaacttggttccattctccccatcactttcagacacactaatcaaacataagtttggttttctcacattgttccatatttcttggaggctttgttcattccttttcattcttttttctctaatcttgtcttcacatttttttttattaagttgatcttcaatctctgatatcatttcttccacttgtttgattcagctattgatacttgtgtatgcttcatgaaattctcgtgctgtgtttttcagctccatcaggtcatttatgttcttttctaaactggttattctaattagcaattcctctaacctttttttaaggttcttagtttccttgcattgggttagaacatgctcctttagatcggaggagtttgttattacccaccttctgaagcctacttctgtcaattcatcaaactcattctcttccagttttattcccttgctggtgaggagttgtgatcctttgcgggagaagagacatcctggtatttggaattttcagcatttttgtgctggtttttccttatcttagatgatttatctacctttggtgtctgatgttggtgaccttctgatggagtttttgtgtggacctcctttttgtcaatgttgatgccattcctttctgtttgttagttttccttctaacagtcaggcccctctgctgcaggtcttctggagtttgctggaggtccactccagaccctttttgcttgggtgtcaccagtggaggctgcagaacagtaaagattgctgccagttcattcctctggaagcttcatcccagatgggcatctgccagatgccagctggagctctcctgtatgaggtgtctgttgaccgctgctgggaggtgtctcccagtcaggaggcatggggatcagggacccacttgaggaggcattctgttccttagcagagctcgaatgctatgctgggagatctgctgctctcttcagagccagcaggcaggaatgtttaagtctgctgaatctgtgcccacagctgccccttccctcaggtgctctgtctaggaagacagatgttttatctataagccctgactggggctgctgcctttctttcagagatgccctgctcagagaggaggaatctagaggggcgatctggccactgtggctttgctgagctgcagtgggctccagccagttcaaacttctcagcggctttgtttacactgtgaggggaaaattgcctactcaagcctcagtaatagcagacgctcctcctgcccccaagctcaagcatcccaggttgacttcagatggctgtgctagcagcaagaatttcaagccagtggatcttagcttgctgggctcggtgggggtgagatacgctgagctagaccacttggctccctgacttcagcccccttgccaggggagtgaacggttctgtcttgctggcattgcaggtgtcactgtggtaagaaaaaacactcctgcagctagctcagtgtctgctcaaatggctgcccagttttgtgcttgaaacccagggccctggtggtgtaggaacctgaggaatctcctggtctggtggttgtgaagactgtgggaaaagcatagtatcttggctggaatgcacttttcctcacagcacagtctctcatggcttcccttggctaggggagggagttccccaaccccttgcacttcccgtgtgaggcgatgccccaccatgatttggcttgccctccgtggactgcacccactgtctaactagtcccaatgagatgagctgggtacctcagttggaaatgcagtgccttctgcattgatctctctgggagctgcagaccggagctgttcctattcggccatcttcccagttaccaaagtgatcttataacaagaaaatttgtttatatcattcttaatttcttcagtgatttcacagtgggcagggtaagtatttacctaactcacagaatactccagcttcctcaccctcagaggtaaggcccaggcagtaatgttcatacattaaagtaaatctatgcccctggctgcagttgattataccaagggttaaaacagctgggccaattatattctttcttctagaaatttggaattgtgatgaagaaagattagtctcttccaattgctggactcagtagttgaatgatggctatgtcttctgtgtgaactgtgaagcagagaaagctggtctagttagaaagaaaataatgaaacagaaacactaagaagaacagaagtgaaagaaggtgacatcttcataggctcgcttctccttgtttctgtttctaaggacttactgaattgccacacttgagtttcaagaaactgcctagatttttctgtttaagtcaaattattttttagcttaatcctgaattatgttttaactgattgcaactatgaaactccttctcttggaaagtgcagtctaacatgatacccttcataagtgttttttaccagctactggtcagcctcaccttctactgtcacagcttctgcttgattccccatctctccaccaaacaccacagaagacattttaactttttatgttctcataccatggtgttttctatatgctattttctatttctacagtaatcacccatccttgtccacttgctaaatggttacccattctgaacacttctatcgtgctttggagattctcacattattgtacataagtcattgaagaaaaatgatttgcatatctgtctcaccaccaccaccctataatctcacaggtggtgaacatataccatttatattttttaatttcacttctgtattctcaattcaaaatacacaatatgtgctgtcatgtattcctgatacatttacatcttttaatcattcataagataacatgtatgttcaataagcacaactactaaagactttggggttgatgatattatttctgggacaagaagataaaataaaacctgagattctaaagagttacgttctacttggcattcccaccaggacataaaagttctgataattgttagtcatgagcccagcaacataaaacatcataagctctttcatcaatgtcaacgttaaatcatatttgatgtattaagtgccagtataaaaccaataacagcagcatcctgggacatagccagaataagagctgtgaaggatcatttgccgttcataactgcattgacttgagcacaagtggggattaaagaacagcaggctacctaatcagccgctgtctggagagctgaagttgggttatcacaagctgagagggcagtgagagcgacagtaagacaggcgtacatctgaacaggttgtcaggagacaaaagtgcctgtgaagtggccatcagaattgaacaatgaagtgtgttggtcccactgagggtgagtcagtcacaccgccaggatagcagatgatgaagtatggtgaagtaggagaagaaatatacaggagaagaaatatacaggatgcttctggattatgcttgttgtctttgtttaattattaagcaactacctctgtgtcttcttttaaaaagatgcccgtttggtgaaaaataagagtgactgattataaacaaccattaaatcaaaatattaccaaattctgcacacagaccaaagttacaataatcctgttaaagagtttctaaaacattgctgtgatgcatttctgggttgtgtttgtgtaggtgtctgtgtgcccagaatccctttgagggaatcttcgcagtccatgtagttcaggcgaggctgcttcagtcacccactgatgccattcggtaggcatctaacctaactgcaactctctactcccaccaaatcacaccagtctgggacagaggccttcctaggatactgacagaacttttgaggaaaatatctttttatgagtgtgaaattctgattgtcatctgtgttataaaatgggaaaaagggaaggagtaattaaggtaacagaggaaaagagaacagagaaacaaagaattccttgtttcaaccatgcctggagtttattctcagttatgggagacaatgagttacctttttgctcagtgtagtgtgaattgggcctgcacatattaccaagatagtcctgacaaatacaactgctttttcactaaactgtccaactttttatctgccccatctcattataccaaatataagcccatgtgcagcagctgtacaaacaggacaaaaaagaaatagataataggatgggtctaggctttggtcagcaaagaactaagccactgtccatgactggtgctccagcaagcacagctcttatatcagtcgctaatgtgcttatttctctcacgattgagatgcaagcaaattttaatagcaataagcaaagagatagaattaaaatgcaacattaattttactggcttctcacaaactgaaatattctgaagagaaaattgaaattagcatatactgagcttagaccctaaagtgttagaagccaaaaggttttagccttggcatggccaaaagcactgcttactttttgataatggcataattgctttttttcatatcagtgaaagcagaaacagaaacagcatattgactttataagtcataatcaggctggcagcctgtattagtctgttcccacactgctaataaagacatacccaagactgggccatttctaaagagaaagaggtttaatggactcacagatgactggggaggcctcacaatcatggtagaaggttaaggaggagcaaaggcacatcttacatggtggcaggcaagagaggatgctcaagggaacagcccttttataaaaaacaacaacaaaaaatcagttcttgtgagacttactaacatgagaacagtatagaaaaacccacccccatgattcaattacctcccactgggcccctcgcatggcatgtggagatcaggaaagctacaattctggatgagatttgcgtggggacacagctaaatatcttagcccttgccttccttaacatttctctgctggaatcacagatacactccatataacacctcagtttagccctggctatgaccaggtaggtgctccttggcattgttatagggctagtcttgcatattgggcccagcctcaatcatatgatgggagttctggcactctctgtccacttcattttccttaaccctactgcttcccccatccagaacctgaaacttctggttatatctaagacaccacctagtaggactgcattctgttctccatgctgtttactatacaattttctatgaaaagactggttgtttggaatcacagtaactccctccacctggccaagagaagcacagccactgtcatagtgtatgtctgctttggagttcattgtatattgagtcaaatctaaaattttatattctagtagacactgaatatggtttcacctaggtgatttcatgtgtttaatactgcatcaaaacatccttggcaagttcctgccttctttattcccacctttctgtcactaagttctctatattttaaaaataaaccttaaaggttatgaattgctgttggatatacaaatatataggagcaatactagttaggaggcttttgttagaatccatttgagagactatgttagtttagtccagtatgttagaagaggtaagagttggtcattttctaggtatttttgaaggtagatctgatgggattttctaaaatgttggatatgggttgtgccagaaagaatgccatcaaaggtgacacctctattttttatttgagtaactggaaaggtgagttgctgttatcctacttagagatgattgagggaggagcagctttggagggtacagagatggagaactagtttgggaatactgtttgtagtatctattaatcatcaaaatagagacgtagcattatttaggcaccctgaaggccaccctcactttaacaccagctgaaaagttcaagggcctccaaggccaccttcacttctgacaccagttgcaatttcaggggtcccaaagattactctcaagtttgataatttgctagaatgagtcacagagtggactgaaagctgttatactcatggatacaatttatagcagcaaaacaatgtaggttaaaattggccaacggaaggagtgcatagggaagagtccaggagaggtccgtgcccagacttttcagttgttctttcccagtggatttgtggacagtgctcacttcttcaggcaatgacctgtaacaatgtgcatgtagtattgccaactaggcaagctcactagagcttgaatgtcttaagtgtttattagggtttaatcatgtagacatgactggccacccacttggctgacctgtagtctccaacccctccagaacttgagctgatgccacatagctcaaagcctctaccatgaatcacattgtttgactaatcacattgttagcccaaggtgcccaaataaacaaaagcactcttgttagataggacatggcaaaggcttagagagtgtctcccaggagctaatggcaaaggccggatctctctttaggtaaaattaattctttattacacagatgccaaatagaaaagtgaatttaaaagtctagagtttgagaaagtggactggtaagagatatgccagcgtacagacagtgtattagagtcctagcagaaagtaaaattcacttagatggttttaatgaaaacattttgataaagataccccttacaggactgcaggcaagattttgagatcaagtagggcctgttgagacacatatataccatcctgggatccaaaggaaaagcagttaacagaaccaatgaaaagggttaacatgtgccaagcacagtgctaagtgatttgttcatttgatttttcctatatggtaataattattattatcaaatgcttataagggagaaaactaaagtttaaaacatttaaatacctttgtctatatttgttcaggagagagttaatgacctgggattcagcctgaatctgcctgccacgggctgccatgccacttatatgattctaaaatttgacattgttatgccacatataagatcatcctgtgggtttcagccgctctccatgacttacctacaaaagggtgtctagttagtgactctcccacttaggctttcctgagaggcttctgctttgctagatcagggttgtgagcatttctggtatggaagtttacaaatgggagtggagtagaaaaaacaaaaacataatggccgaattctcctgtggaaggaagttagggaagaggtaaactagacttccaggaaaacagaagcaaaggaagtatgtatgtgtatgattctaagtgtgtacacacatacacatgtacatgtattaagtgtcaaagtgtgttttcaggatttgggtgtgtttgagaagagaaaaaaatacaggattttagttgcaactgactataaatttgtacacttttaaaatgttttcatgggattgtaaaggtctgaattcctgctggaattctatttatttgaatgtatcatggttcaaggttatcaagtgtgtcctggcttcgaagagaacatagtgcctagaatgtatcatctatactgtattattattatgatttttgttacaaagcgtggaagggctttgccattaataaaacaatataatggatatgatttaatatcattaaaaataatcaagagattttaatatggggataaccattatataatcccaccatgcctatcccaccacctgggtcagatcccgtattgaaacatgcccctagacacagaactggactcagaaagattcttggcacagtgcttcatttagctacaaataatcaattatccctgacatgcaagttaaaactcatttgccacttggtttataatgtatcaagctaaaatgttttaacatgttctgggtcttcaatttactaggttatatcataattttaaaataaagaaaatttcaaagaaagaaggcaatatctctgtaaaattagcattcagacttgagtatgtcccaaggagactagccctccaattctattttgtatagctttcttttcctcctctgagaaggtgaaaaactctttgaagatttcctttcatttccttttctcttctctcttatttctctaagccccaattatctctgttttcaatgttctctgtacagaaaaaatccgcatcaccacccacctccagaaggagagaatggctgataaaaaattggagattggattttgtttcagtgccaatctactacttgtgtcaaaccattttaaattttctcattatagttagctctcttctctatttttacagcattgccacacattacaaaatccatagctggtacatatgcactatttagttagctttaaaacatttctgtagcccacatacattctaataaaattaattctttgaaaggccatactttggcttctgaataaattattatcttttctcaactgaaaaaaaaaagatgatgatgaaacatggaatatagatgaatcatttttgtgtagcttataatacaatgcattttgggttgagtctgagcttgcataaagactgactgaaatgataaataggcctgatgattaagccaggtggcaaatcactagtttgtgtagctgccaaaatggatacctgggtatgggaggaaacctgggactcccttcctggggatagggtagtcgaggcctgccgtagaagtggtgtgattaatctctttagaagagagtgccagctgcagtgtgcataaatgtctcctcctggattctccttaaaagctaaattgatgacagtctcttaaaagagcagctcagccctctgtccctgtaagataaagacaaaccttgatttcagctactactgaaataagtaaaagtagaaaaaggttaaaaaaaaataacagtactgtactcttagtgaaggaattagaggtaatagaatgttactcatctaccaaaatataaggataattgcaatgtggtacccttttttgttagaaggttttgtggagcccatctgtgcagattgtttgttttttactatcattacatcaattaattacattagggaagaaggggacactttaattaaaaggctgttttaaggagttataattctactctgtcattaaataatttaacaatttaaataggcaccaaatttgttagtaaagaataattctgaaaatgtttgtttgtaaattatttatattaaccacattttcagcaaaattaattttgcctttttatttcatcaaatcaaagcgtccattgatttcttcattttgaccaatggactgtaggataggaagacatataaaccatctcaattattttgagagacttattttttcctaaaagagaaaaacctctcattttaccaagtatgcatatttgcttgtgtgtgatatgtctgattagggtaatcttttctgcaattggcatttttagaacatgatgagttgcaaagagaagacatggctggtgaaaagatggatatagacccacagaaataaatatatagccaataatgtaatttaaaaacattgctgctacttaagtccatacttctttggataaaaaccttcatccacataagttatactacaggaatgcctttgtgtatttcacataaaatgggtggataaacatctattttttggatgtcttgaatgcatctttctttttgtcaaccatcttccatttttctagagtgtgctaaataatggaattcagagacttgtatctaaatgtcagggaataaggaaagcaaaggattaagaatgaaaataaatatggaaatatgagaaataatatcatgggacagaacaagagaggcttagaagctaagagaagattctaagcaactcctggtgcaggagttgatggaaagtgagaatttaaaaataatgattctgcattctgtatttaaactgttctctagactgtttctgtctgattgaaatagtaagccattttttttaaaacattgaatgtgaaaagcattatagaaactgcttttgtacttaaaaaaaatgccagagtcaaactgtatctcatgcagttgaagactgaataagtaatattattccagtcattatatttatctaggatcagtgtcttacacatagtggatgtgcaaaaaatatatgtggaatgaatgaatgaagataacattttactcaaatttttaagtaggagacggcaggtcctactagtagtgaggtttttatctttttttcactcttcaatgttattccccagggaaactggcaaactgaaatctgttacattaatgccagcagagatgtatgagtgtgaagagaataagtaaacatttattgtacctgatggctcaatggactatcaacatgagctcttaagagacttgaaaatacttggcagtgtttatccttaggatgaactctacaaaaactatttgtggacattattttcagaaaatttctattttggggtcagctgagctttttcaattcaaaacttatgagctaatatgtaactatataacgcctttcctttggcaatgagttaatttcttaatgttttttaattctaatgttaggttttctatctaaatcagtgtcaaaatatcatccaaaaatagagatagtagctagtacatttttaatacaatattttcccatgttacccaatataaacataatgacaaacagccatttactgagagtctaatatatgccagtttatttttcagagttttacatgttaaaccatagatgattttaccttcttatagagaaaaatatatcaaagctgagagtaacatagtgccttgcacaaagccacacggattgtaaaattttgaactgagattcaaacccaacaccccagctataatagactaaatcccccaaatttacatttgacgctcacaaaatcttgtgaggtaagtagggcaaaagcaatttttattttctttattcacctagggttgttatttgattattctgcatttatggaaataattttgtgagaatgatagaaatttaaaatgggaacaatttaggggtaatctaaattagcaattcttagacattttcgttttagtaccactttacatccttaataattattgaataactctaaaagtatttgaaatatgtgctatattccttgataccatattagcaataaaaattggaacattaaattcattattagttatttaataacaatagtaaactacctcttcacataaatattatatttttatgataagtacctagatgttccaaaacaaaaaaaaaagtgagaagggtagcattattttatatacttataagtctctttactatttagtttaatgggaggcagctagattttcacatctgcttcctcattcaatctgttgtaacatcacatgtcctgtaacgtctggaacactccactgcacatgtgtgagagaatggaagttaaaaaaacaaagaagggctgggcacggtggctcacgactgtaatcccagcactttgggaggccaaggcgggtggatcgtgaggtcaggagttcgagaccagtctggccaacagggtgaaaccccatctctactaaaaatacaaaaattatccgggtgtgatggtgggcacctgtaatcccagctactcgggaggctgaggcaggagaattgtttgaacccaggaggcggaggttgtagtgagccaagatcgcgcaattgcactccagcctgggtgagagtctgagactatatcaaaaacaacaacaaaaactacttagtattatttaaaaatagctagacttcagggacccttctgaagggtacaggtgtctgtggagccacttcgagagctgctgatctagataaaactttcatttagaagacatggaaattaaggtgtctcatggatctgctactgatgatcgattagagaggggctgatactttcctacaagggtattagatatggctaggatggatgctcaaactatcttatggaaatatatgaaggtgattttgagtggcggtttgtattttacctccctcccactgatgacacaacaaccaacccgcacaacccttctgaaactacccttgcctggaacagcaatgatcttgttaaattcaataatcattttttaaaaagtgcttactgagatttgtttgttagcaacccttgacatggctgatcactcccttcattttgactcaattgtatggtcctcccatgatctcacactcagtgaaagcaccctctctctccagatgcccaaccagaagtcagaaacttcccagactctgatctcttcctcaccaagtgatctcaatcatcttttcttataaatatctcagtattccatccacattttttctgcctgatattttgccctgactatgcatcttacctctcttacattatcactactatcttctaacgatttgattttattccttatttttatgtgtttttttttccaaattttattttagtttccaggtgtacatgtgcaggtttgttacatgggtaaattttgtgttgtgggggtttggtgtacacataattttgtcacccaagtaatcagcataataccaataggcagtttttcagtcattagttcacttcaaataatgaactccagctctgtctgtgttgttgcaaaggccatggtctcatttttatggctgtgtagcattccatggtgtatatgtaccacattttctggtatctaggttgatttcacatctttactatcatgaatagtgctgcgatgaacatacacatgcatgttttttaatggtagagttatattcctttgggtatatcccattaatgggattgctgagttgaatggtgttttaaattctttaagaaatctccagactgctttccagagtggctgaactaatttacattcccaccttttctccacaacttcaccagcatgttactttttgactttttaataatagtcattctgaatggaaaatatttgcacactatatctctgacaaaggtctcatttccagaatctacaaggaactcaagtccgcaagcaaaaaataatcaacctcatttaaaaatgggcaaaagacatgaaaagacacttccaaaagaagacatatatgtggccaacaaacatatgaaccaatgctcaatatcactaatcattagggaaatgcaaattaaaaccacaatgagataccatctcacactagccagcatgggttttattaaaaatccaactatttctttccccggttcttctcatcggtcctccataatctgagcaattcttttgaactacagattccaagtgggcacttttcacagctcttaggttaaagccccaattctttcaagtattttacaaaagcttctgaagcagccccgtgcttgcatctacagctgggcttgtcactgattcttctttgcttcataagattctctgacctgctccctcacttccatgacagtatataaaaactgtttattcttctatatgcattcctttgactctttctctttttattcatgtattaacttggatgtcacctcctttggaataatttcccctgagtcctcccactctgagttagattatcctgtatatgattcctcaatgatgtgttctttccaaccaaaatattatttgccagtcttcatttgtagttacttgcttaatatcattttcccctgtatacttttagtattgtatgcacagaaacttcatctgattttgtctttctatagtgaaagaataaccccattaaaaaatgggcaaatgacatgaaaagacacttctcagaattgttctacccaatgttgagaacaatgttggacttacagtaagaagattataagtcatacacatttgttagatgcattattaaatgaatattttttctcttttttctgcagttagttgtatttatggttttctgactcacctttatgaagttgagaatcttgctttgaattaattattttattgtcctgttagtataatatagttactatcctgtatgactgctatgccaaagtggttcaaagactggctctcgtatgacacctaaaaccaggtgaaaccaggcctatatttggaaattggcctcattcttttatgaccaagaaggtcatctgggaagattggttaaaatatgcatgcatgagttctaccctctgaagattctaaattggttgtttagattgtaagcagctccacagattactgccacacctttcaaagtgtaggaactactgacttactgcaagaatactctggtttatttataaaaagtagttaaagagttaccttgtaaaatgtactctaatttagtagcagagcactcccatgttcaaagaaatatatagttttctgaatgtatagttttctgtacatatatgtttggaaggacgtcatagccgaacattaaactctagcaggtattacaagttcaagtacctatttttgtttctttacagctcaatgttaacacctgtactcattaaacacatcttacttctctagaacttattgtagtatgtttaatggatgcatttaatatcaatttttatgtagtatttatttaaatagcattagtaaatatttaactttgcaaaacaaaatgtggtaatactattttaccatgcaatttttgcagctgttatgtgtagaagctgttaggtgtagaagctgtataacttacagtgaagcaactttatggggccatgtgtttttaaaacaaaatataccaagtatatttgtgaattcacattttttattgttaattgatacataataattttgcatatttatggagtataatgtaatgttttgacatatgtatatatgtactgatgacattagagtaattagcatatccattaccttgaacatttatcatttatttgtgataagaacagacaaaatcttctagctattttgaagtaaataaaaccttattgttaactatagtaatccttctaagcaacaggacaccagcatttattcttcctttctaattgtaactttgtacccactgaccatcccctctccatccctctcttccctctaccctccatttatttttatttatatttactcctgttttcaaaaaggttaagtaacaggtatgtatacatacatacagacagtacatgtacgcacacgcgcacgcacacgcagacacacacacaccacacacacacacacacacactcgagaaacagagagaaggaaaaagagacagtttctgattatttacaaatattttgctttatcattgtttgtcatactgtattgatgaaggtagtttttcagggaaaatagaaatagatactagtatagagatgagatttttaaaagataagaagaaagagtagaaggagaaaagaaaattgcttcatttgatccaagctgcaatggaattggatgatctttttttcttttcacactcttttatatagtggatcttttgtgtcagctctttaatgtgtttcattacttgaagactgtataaaggaatacattcaataatttttctcttattttaaaatgcatcacagttatatgacttattggaaatatattcattaatgtgatatatttttaatttaattatcaggtacttctctaggagaatgcttactttacaaatgtgtgcaggtatatttactttttaatttaatgttgttaactagaaaacaatacaaaaattgttagcattattttttaaaataattatggttcaggctatttaaaatctattttattaaggaaagttatttcactgttacatatacaccaacttgagtttccaggttattcaccagaacattacatgttactgacgatgaaaaccaagtaaccaaagtttctaataatagggaatagttacataaattaggtgcgtgataaaacacagtgttcattaaaggcaatctagaataataatcactgacttacaaggccctctaaggcattatcacaaaacaattattaatgtaaaatacaatacaaacaaagctatgtgtgtacacgtgtaaacgcacagaacgtgttatggaaaaacagtatttcaagcctttaatagtgacagcctgcaggggagtagaactggggtataaagggaaactattttactctatgtctttttatacatttaagttatttatattaacttttagtcatgtgtttcttttataacttgaaaaatgtcttaaagaatttgagaaatgtttattttaacaaaaataacagaggatatggaattgttttgaaacaggaatttcaagttgcaccattaaatacacttatacatggtcaagaaaattatgcgttcttggccgtatcaaactatctcatgtagtttataatatacaaacctatgtaaccacaaaaattaaaatgaaataagaagaaaattatacattctaatgagtgttttctgattctttgccctactctattttttatctctaatattcttttttttttttccattttaattaaaggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggtaacctttaaattacttcaattcttgttttcttcataaacttgcacttacaatatgatcttcttttaaatcaaaatattattgttatgcaatcagttataataaccttgatgtaattttatgatagaaagtctgacaattgcttttaattaattgtcttaaaagaaaagtaatgtaaacattgatgatcttcaaaacgggttgttggaagtttggaggttattttcaaatgactgcaatgctgttggttaatgagatagttgattaatgagatagttatttctttttgttttgaaatgagggaaggaactaagagtcaaccagttgagcagctcactcattacaatcagccagtaggaaaaagatgtaatagatttaccatttacctgatatttactgtaagagactttatatatttgatcttatttcatcatcactacaacaaaaagaagtagggactatctctactttacagacaaactgagtcccaaaatgaacaagtaacttgaccaatgtcaagtagcaagaacatagcagagggattgatatccaacctaatgatgttaacaagtattcattccagaataaagcattgcctgacaaaaaccaaccaaccaaccaaacaaacaaacaaaaccttctaaatcaatcaaacaaaacaatttgtagctgtgaaatcttttagtattatgtcagcattattcagacctaacagcaaactggaaaacagaaattattatcagtccatatcttacagatgaaggaactgaagttgggagttaaatggccagaacaaggccctacacttactatgtagtagagcctggatttgaacacaaatttttggattttgtttcttaaactcttttatgcacactgagctgacacctttgtagcttggaactagtcagtcatttagaaacctctcatgtataggacaaaatatttctactggagagttacgcagattcagatgtcaaattatatcccgttaaatataactgccaatagtaaatgcctgttatagcatggttaatttattaagcagatgtttatccaatattccaatataaatgttgattttcacagtaaaatatttactttgatttgaaaaattgctatagttttatctttggataatgaagcatatgagagtttttgggtttttttggcaacaaataaaacaacgcactaagattactactgaactctagagtcaagatttatttcacataattcccaaacaattcctgatcatggtttgaatacacaggcttggaaaagagacctttcctttactcctggagtgagtggcactaagctatttcagtgacagagctttggctgctttctctaggcttctagtaagtatgtaaatgatcagctgtcttttctctaaagaactaactctcactattttgctatctggaaggtgagaagcctgtcacctttaaatttgaacttgctttctgacttctattagatatatttattattttatacttgttttcttatgtgttctttgcaaacatgctttgtttgcaaaaggaaaacagaaataatagaatatttaaatacatataacagaaaaatgtaattttaacaaggtcagtagatgaaaaattagaaaataggtaaaatgagaatatgaaagttgagatgaatccagagcgacattattatacagtatgcatcctctgaggtcctataccagaagaccacaaatatggtggtgttatttttaactttgtctcacatttgaattttccagttattctagtaaccaagaagaaagtgaatagcttctaggaaattcagcagtgcatttaatagggtcctattttgtgatttgtgaaatttttctgagattcctgaacattcactgatgttggaactcctaagacatggtataggagttgaagagcaaaaatagatgagctttcagctagtctggcttcatccaagaatgaataataggactatgcagaaaaataaatggccttaatcagtttactcttgtgcgtttgtttgtgtaatttatttaatttatttatttaaactgattgagcttttactaggtattgaacaacagtgaatttgaagttttcctgctagaaagctttaaaagtgagtggagcttgcggttgagtagatttcctctgaggcaagttgagtacactaattggcatgcatgcctccatagcagatgattctacctccatccagatttatcaaagaaaataccctagggcagagccaagatcctctgaagtaaaacctcacaaggacattctatcacagggaaaaaatagtaatcaggaacttcaaagtttagatcagagagtgtgaaataaaaacttttagcctggaaaaaatgtaaaagaaaatgctaataaaatcctacagtggtgtgaagtaaaataaagtaaaaattgaagaaatgtgtataggcccccctcatattgttgaccttgagcaatatgatttctggatcttacctgaaaaataaactggttgcatattatctgcctagataactgcatgtgttaattcatcatatagcatagcactacaccagcttaatgttggggtttctaataatattttgactttagaaaatttaatctgtagtatttcttttaggagagatgatatgacaaccgcttttatgttgaggcaattattatattatttgtgcataaaaacatactgattttattctctctaatatgtttgaagtgtgcatacaattcactcaaaagtagcagtaagacatgctataattaaaaccagatccagagcaagttatttaaaaaaaaattctactggaaattattaactaatcttttaagagagtattcctgttgttcattctttttgagtaaggttacaatgtaggtacttaatcaaaaataactactatttctacctccaattttgtttgtttgtttgtttgatggagtctggctctgtcgcccaggctaaagtgcaatggtgcgatctcggctcactgcaacctctaccttctgggttcaagcaattctctgcctcggcctcctgagtagccggtattacaggcagctgccaccacgcccagcgtattttttgtatttttagtagagacaggctttcaccatcttggccaggctggtcttgaaatcctgacctcgtgatccacctgccttggcctcccaaagtgctgggattacaggcatgagccaccgcgcctggcctcccagcgttttctacgtcatatatcacagcacattaactgatccttgttttcaaaatcaaaagctgagagaaggtcaatgaaagccagaaacagactccaattaccctcatagatttcttctcaaggtgatgaagaaaaacctgtagccattggaaatacatatgtcagaacaaatcatcttcttctccaccatctcctcaacaacttcccctacaccaaagcagaatttgatgcacttgcctgagacgtccatgttttcaaattttcaaggaaggaacaggcaaaaattttagaatgcatggagtcaaaaattgttctacaactttgagaatatgaaatataccactttagaaaatgacatagattccaaactccacattagagacctggagtccatgtttactcactgtctcactttgttggacagtttattcattcttttcatgtcctagtttccttacccataaaatgaacataatagtaggactgacttctagggtttttatgaggcttaaatatgtaatgtgcttagaatagtatctgacaaattttaagcattatataagtattatttttagttatacatctgaatcgttatttctttcaattacctttatctctagttctatacctacagagttgataaagtaaaaaaaattgccaagcataatattgagctgtcattgaatggtactggagatagggagccatctgaacatatccatcaggagcaatgaatgccttctacaaatatgatcttgtaaatttgtatttaataagggaaattctgtcttattttgcttgagatgaaattttaatccgaatattattggtttatataagtattacccactgaagaaatattatttggtaatttgatacctaaatttcctgtgctcaattctttgatgccacctttcattaaccaatgtttctccctttttaaatatatttgatacattccaaatttttcacaaatatctattccttcttaaagaattcatgttgcagaactacaaattctatcctacctaactggttaatgctgatttatgagcatgatgcttttcttatttttattttttatttttaattgttgtgggtacatagtaggtgtacatatttatgaggtatatgggatattttgatacaggcatacaacgtgtaataattacatcagggtaaatgggatatccatcacctcaagtatttatccctgttttttgtttgtttgttttgtaatggggtgttgctctgtcactgcagcctcgactttgggagctcacgtgaccctctcaacctcagcttctcgagtagttgggactaaaggcatgtgccaccatgcctggctatttttcttttctatttttttttttttttttttgtagagatggggtcttgttatgttaccaaggctggtcttgggctcaaccagtcctcctgccttggtttcccgaagtccagggattacaggtgtgagacactgcacccagccagcatttatcctttatgttacaaacaatccatttatactcttttggttattttaaaatatacaattaaattattattgactatagtcaacctattgtgctatcaaatactagatcttattccttctattttttaacccattaatttctatatgcagaatgtagttgaggcagctacttcataaatgagtttttgtagttagtggcttttggaaggctattagatgtacctgagaataattgtttcctactaagaactcttcattcaactaaaaatgcattgttttttaattatccttgccaactgctgttcattgataagcagttatttcaaaagcattctcttatttttggagagaaaatgacatggacacttgttataactaaaagttctaacccaaaagtccttgtttttaagattgacagtctaaaattgatgaggactgtagaagagtgaaataaaacacagtaatttgtgactagtttattaataacaacaaaaacatttctttaattatatgtaatttttaaataagagtggtaatttacatttccttcattaatgctatggaaatgtctctaaagagctaaaataaatgcctgttggcattgtgttttgcagcacttttttcctaattcagtaatattgttcattaaaataaaatggtgttcctcattggagtatttgtagtgaagacgttacgaatgtaacaaattaagatgtgctaatttcaggttttgtgtcaaatttaatgccttctttaatgtgttaagccatagctttacaattgcaaacattcagctaatagcttttctatctagagaattgcttcagaaattccttcagtaaccactaatctttaactactgggaaaagatttagtttaacctaattgtatgtaacatgaatattgtaggttgattctttatcacatcctactatattttgttctcacttgaattactgacatactgtctttcctgaaatatgtaccttcagtaatttttttttttccttaggcattagctatgggaatgatgacagaatactatcattatatctttaccactctggtaagtacttcattaaaacaaaatgttctgaattttattattatgactttttcagatgaaaaataggttttttagtaagaagtattatgactgattcctttgtagttatattttaatttgataagactccaccaaaattattatcagagaggacaactcttaatagaagctgatgattttgaaataatatcatttcagatatcaattcaaaatattgcatatcttatttttatgttgctttagagaactttcagaatataatggatcttgaaattagtttcctgagaaatcagtgctttagaaaagcgcaaattcagccgggcacagtggctcatttctgtaatcccagcactttggtaggccggggcagaaggatcacctgaggtcaggaattcaagaacagcatgaccaatatggtgaaacccatctctactaaaaatacaaaaattagccgggcatggtggtgggtgcctgtagtcacagctactcgggagcctgagacaggagaattgcttggacctgggaggcggaggttgcagtgagccaacagtgccactgcactccagcctgggcgacagagctagactccatctagaaaaaaaaaaaaagaaaagaataagacaagaaaagcacaaattcttatgttatctcagctgtattcactttttgaaaatcagatgtattgaagctgtcctttcagtagattacattttctattctgcttttgcctgtatttagttagattttttaaaaagtcaatatactttaatttgccatcagcaaattgaatgttacctttatattttgttttcacatacccatcacacaattttcccttataatgtatgaaaatctgactttaacctgtatcaaacttactgttagctccattttgttatcaatacattatcctgacctttctttctctgtaaaacagctgtctctttactaattctttcttccacatgtcccaaatatgagtatctccaagtttggacttcatccaatcttattttctcttcaattattttcttcagaactggtttgtatttagagcctcagttaacatcttcgttcgaatgaggtctaaatgttctatgtaatatttatgaattactgtatactgtaaaacacttttaattgttgtgccattagataatttcgaaatatttaaactttagtgtcctctgaattgacgtctcttctgattatcttaaaaatttcaacttttgttgactcctgtatcaccaacaaaattttactgatttttcctttgtagtgtctctagcatctatcttctccattcccataacaaccagtctaaccaaagttttcttcattaacttgaaattcttccagttagtctccttgcttctagaagtcttgaagctgccagatcagattattaaaatttaattgattgcaatagcttcctgtgatgacaactcttacctccaaaggagattattcatgcagtaggatgtattttacttaaaaatagcaaagctggctctggcatatctctatattatttcctagcagacaactttttgcagcttgtaagaaacttagtggtgggggtggagaggaagtgagagcattccctcatcagcaaattatatttcagtgctgttacaactcagcataagcgtaagattttggggaaatcaaaagtatctctcaatagggaaaataaatgaaacaactagtttaggatacatagaactcataggcctacatttgaaggccttttatactttgatcctaatcgaactttcccatttccttttgctactattctcctttaggaattctcatttatagctgaactgatgtggatcagtctcctgaataggttttatatcttctaatttttgtgtctccactcacactttgaattctctttttgtcaatcatcagcccggtctttctttaatggcagctgtaggggagaaaagatttcttttcctcacacttcatgaggttcaaggctgagatctctataacaaaagagaggttgacaagagaaacacctaaaaatgtatttaatataaattttatgtgacacaaaagccatcagaaatgaagactcaaagaaatgggaaaatctggattttttttttttttttgctttggtttgataaagagtagatagttatgtaggaaaattattggacaaagggaggttatgatctaatggcaataaatccagaaaacttagcaaggccaaattgttgagattcttcttgacctccaggtatagggctggatccctctggaatgagagtcttatgacctcctttctgtgggggtaggtcagagaattcttttatggtccacttcaggggagaaaggtgggataaggtcacagagtgaccttcctgcttctgtgtcttctcaatttcctatagccaagtaccatatttgggggtagcatgttctgagcctcatcacagctaagatcccatctgctctgtgaagtttttcttgaccatacaaattgaaaataacttgtcttgcttctgacttcttttgcatttatgatttctactcttttaccacttggcatatattgccatcctttatttattcacctctttcctatctccttggctagattgtaaacattaaaaaataaaaacctaaagattcctatgtttttcatagcacagactagagctcaggccaatgccagctgctttccactgaattgtattcttattatctagcctgtgtagctgtatgagtctgaggcaagctgttcacagaaccaatggcattaatcttgccttgattctcaatattgtccataagttcgagggttagctatgccaactagaaagagggcaaaactccacatgctggatgttttcatggtggcatccatttccatgatagctttggcctcatatctcctgggacaactaaagggcagagcaagaaagttcactatatacagactagaaagggcaacaggcataaagtgtttattggaaacttatagtgaagttcctaggtgtgagacatgagatgaaggaactgtattgtttctgcaaccaaaaaggctagtcttggccttagcatttttttcacacctttcatacagttttcattagttagaagctgtattttgtgacttgctttctaaaaacaacaatcaaacaaagaaacactgacaaaaaaaaaattaaaaacagcaataaccaggcgaggaagcaggacacagaaaaaattaaagcaaaatattaacacataaaataagggcaagctatcctaaacagagagaagaaagctattgcaaatcttagatgtgagttgtagaagagcccattgtttcactggcggatttagaataaaatatatacatagatttttacatacggagcatgtatctctgcaatgccaaagcatgaggacagtctatttgaatcttggtgatttgtgatgtttaacgtcacttgacacaaaggtgttaagtgacctaaaaaaaacaaaaaaagtgactatttcagtaatacatgcctgtgaagatactctgtccataataacaacacaataacatttgtctttcaggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacggtatgaatacccacttaaagatcagtttgtgtgtttctaaatagtattgcatacatatgaacttctgggtttatatgcatacatataaacttcagtttaattgtttgacattaaaagcaaaatatcagagctacaatgcaaatacttgtattaacaatttttttaaatcaattttatatgaaaagcttatgcttccatccaagtatctcaaaaggcattacaactatcaccagggtactacaacataggaatttctgtaaagttaattagtgccctacatgggagaaatgagagactgaaagaagacatacatctggtagttatccttctgatcttacctatcaatatacgaatactcttcaacatgatgatttctggtatctggtgttatataaatgacttatgtcacacaaaacacacaaaattctcgcatgagcttactcactctttaaggctgaagactaatcaataatcacatttgtcattttcaagtcccagtttaaacccagaagcggcactattgcataaactatgaaagaagggtatattcttatataacttagttgtttatgccaaacaactttagttgtttataccaatgcttacaataaaaatctaatggcaaggcatacataattttaagttttcttatactgtgtcctccaaaagataggtaaaaatcagtgtttgtttaagctactatgtaaaaatattatttttaaataagtaatcaatataaaaattatgacttcagacattttatattttttatactaaatccttgaaagatggtatgtatttgacatcatgcatattaattcagagtagtcacatttcagtcatatttactctgtagtagccaaatgtggctagtgtctaccttgtcagacttggtaggtatgtgtcatgttatttttgaaaattataaatgcctgatgttttcttattaaatcatttttctacagactaaagtatcactataattaaggaaatagcttagcagtggggtgatatttacatttcataggaaattaccatctgcttttaatgagtattagtctaaatggagaatttataaacaaaaacatcctctatccttacatgtatgtagaaaagctttttctattatgcttgtaatttttccattaattacttcaatagcttcaaagcttgtttttgatactgtagggataaaaggaaaatttgatttttttatccttagaaggttttgtaatacaaattgagtgccttcatagagactatgaagaagaaatggttagcctaaaggcatcaactttctgatggaacaaaaaatacatttgttttcagtttgtgagaaaaatcacctactagaatttcaaaatatatccgtatgaatttgttttaaaagaaacactatagggaaattgtacttcgttgcataaagagatagttgaacagttctagtagtttagttttaacttatgtttgagaatttttattgagaggaaaatacctaaataacttaaaaattaaaatattttccttcaaagtggagccagatttaaaataaaatgcaaactagaaaaaattataaatgttatattttattaccagtttaaagatggtgaatcaaacttttgaaacttaagacaatgtgattttttaatattataatgtatgctatcctttaaattgttgttatgatcatgtgaatatttttatataatatataaaaatatttattatataaaaatatatattatataaaaatatttaaatattatataaaaatatttatatattataatagctttctttacaattctttgatttcaggatgaatgtcttattatttattttcaatagcactattaaatggttttaagaaaagtaaatcagtagatatcagcacaattttacacttttatatatttacttccacagataaataagtccaatgactaatgtgccccttcatgtatcagaatcataaaaattattcaattttactttggtacactctgtatagctatgtgagtccctctgtgactttacacatcatctcccgaaatgaagtaatccctaatttgtggcaacttatgtaaactattgaaagacagataagtacaaagaatgatgtattaatttccaaggtagaagctcttggagagaattaacctctacaatatggaaaaagagagaggatattaggagaattacaaatttgcattctctctttctagcacgagtctattcctcttctgcttttccctgttgaactggcagatgatttcttggaaggggaaaaatgttaaaatgaaaatggactgatgaaaaaatgtgtctattaaaaatcctgggcattatatataaaccatggattctgagttatttagaagaattttccatgcaattctctttcctttggtatagttcttaaatataaagtagatatgaagtttgtcattaaaataaaggtttctttcaaaatagatgcagattgattttgtttttacaatttcccttttggaaaattaatatattttaaaatcctttcatcatataacattgtaccaaaattttaaaaaaatacataaaatattttcattatgtaacattaattcttaattataaaatagcatatggttattaaaataaaaccaattgagttctgtattaaaatgtgggcatatttatgtcttacataagtattctttttcttttcaatttaaaattgtaagcattttcacaagtcattaaatgtttaggaaaagaaattaataagctgtttccaccatgaatatagtcagcaaattaagaggattctagttagaaaaaagagaaaaaagaattatagcctggcattgtggcattggcaacattcccttcagtcaattcatgagatctcagtgtttatgtatctctttttctttttatcccctatagtcccataaagaaatgggattatcagcaaagtttctagtgcttggagcaagacctattattatcagtatcataatcatttgccattgtgtaagatcatagtgctcagactttgacatcctttcttcatgtttgagctataaaaggaaacagtaaattggattcataagagtttttctagttgagttaggattttaattggcctttgagatgactgtttatcagttaaatgactactgaatacaaaaccacttcgcttgccattgtagtttctttctctgcagtctagggtcatcatattaaagatgttaatgttagtaactcagtaaaatttttagtttcacttggtataaacccaaccaaggaaccaactcacacagtacttccaagcctgatctagttaaggaggaagaaataaagctcaacactcttcttttacacatgagggttttcttttaacatatgatatcccacttttctccattcccacacaatgccatccagttagtgctctgaacttcccagacataaaccccttattgtaaaactctttccatactctgcattctgtattgtgttcccatcttttcatgctcctagaggtgtgcaaatacctttcaatgagcgttactactgttctttattgcaaaatcagataacatcttccccagtcctctgaccagacattgtctgcctttatgtagcacatttactataggatgagaattcacttttgaaccagtgccaatcagagcccgacaatggtgatacttgttattgatttattgagtttacagcaatttcaggtaaagacaaacacctcagagtacattttaaacagtctagctatatcccagaaatccttcccagtggttctaatatacatatgcatattaataccaatgtacctgtaatccattcagtagcttaatttaattatcagtattttttttcttgtgctgatagataataccacatatttccttgataatataaatgtattacacaaatcaataataatcatattgatagactatatcatttgggtttctatagggatattactgttttagaagtttaaaccctggacaccaaccgctatctccatttcctttcacctcaaaaatcattaagcactgtcaattttactgtatcaatatttttcttaactacattcatcttttcaacccagaactttatcttagttatgatcattccctggctttcctaataatcccctcactgaagtcctactcctaacatctctctcctacattcaccttctttctagtatgatttttttcagaactttgctcatggctcctcatcatttactaggtgtaacttgagctcatttgccaagcctaaaaagccttctatggtctggctctttccaatttgtccagcctcatatttgcttgctccctgttccaccaagccaccctctcatctcacctttgatgtgttgtcactcatcatgtatcacctattccagcataggatacttcattatttaaaccacttacctttttttgaatgtttggcatattcctactcatactctaattttcaggttttctgttaccttttagattgaatgtgctgagtcctccagatattttatatgtgtggtcctttatttatgcactttatgtataactccatgttgaaagttaactctagtgctttagtttctttttacatcactttttcaatagactgttagctcttttgaagcaagaagtagatattgtaatctttgaagtccctatacctagtttaatgcctggtgtaaaacaggagctcataatgagagagtgactgcctgattgaataaatgcatttgttaatttattttaatcatattacatctgtgttctaatcattagttcctctaatttccccaaatatatgttggagagcattttatttgccctcttgtactttattatcaatatatctaatcatttagaagatgtaattaggctagtctcaatgacagaagcttagaaatacttttttttcttttttttttttttgagacagagtctcgctctgccacccaggctggagtgcaatgacagtctctgctcactgcaacctctgcctccccagattgcagagattcttgcgcctcagcctccgagtagctgggattacaggcgcacaccaccacgcctggctaatttttgtatttttgctaaagatgggttttcaccatgttggccaggctggtctccaactcctgacctcaagtgatccacccaccttggcctcccaaagtgctgggattatttataggtatgagccactgcgctcggccattagaaatacttttgattaaatagtgaaagtatagtaagttagaagagtagttcccattctttttacaaaggaagagataatgtttatgagaggtgagtctttatgtgttttaattctaaagccctaacagttatttctttataataacagaccacagaccccagactttataatttccttttttatttgagtatcttaaaataaaaatgagcatcttgtatatacatcttacagcaggaatttagctcatccactaaggtgacacaagtaatcatttgttactgtataaagatttacttgtatagctgggtgtggtggggcaggcctgtagtcagctatgtgggaggctgaggtgggaggatcacttgagcctgggaagttgaggctgcagtgaacagtgttcacccagctaaactccaacgtaacaccccgtctcaaaaaaaaaaaaaaaaaaaaaaaaaaaagcaatggaaatagaaccatagagaaataaagtatgaacagaacagacaggctttttcatttactgctagaacaactgcaagcccacctttgctgctatttgcttgtcttaattaattttagctgtttttctttaattcatttgaaatgaatataaatataaggttttggcaagtaatggatcaaaccaactcaacattttttaaattggtgaagcattttgaaaaagttggcttcatcttatattgcactaaatcaccaaaataaaagaataaagagtagcaacataatgaattgatgaattaactttttaaaaatcaattttaatactgtgtattgtatgcagcacacaggatttgataccaggcactcaggatttggtaatcaagacaatacctctatttcatcaaataactaagggaattgataaaatcagaagatagtaactgtttttctgatcacttcacaatctttgttgatataacaattatgttcaaaatgtgatgttgattgcttcttaattttgtatttttggatcttctttcctgtcttcctgaaaattcttgttaaaatttcctgttttccgtaatcatttatgatagcaagagacacacatatatttaccaagaatttaacataacttcttagtattttgtcgaaaaatgtgtaacatttcacaaaatttattaacataaatgttataactactagccttattcttgttgttaccacagaaaaaacattttggggtccataatataataaaatatggcagaaatacttgtatatttcagagtatgtaatgaagtcataagtacaacatttgttacatttatatatgcttgatttaatgaatggtaaaaggacatggagcatggaatgtgaataacagaatggcactatatttctttattttatgtacatattaatcttctaagatgcactaagctacaagttaaatctaaatacaaataattgagatgacctaaaaacctccattgttttattaacatagaacatttcgtctaattgccttttctcatccacagattaaataagcagcatttaagcatctaaaattgatggatatggaatttctattttaagtaattgttttttacatgaaaaatggcagttgcagtgaagcattatctttatggtcatattatttttataggtcaattttcaaacttttcacttgggaaaagtaagggtaaatcaagagagattttttccccttcaccctgaagagcaaaatttatcttcaaagcattgatataatattatgtgacaccaacttataaaggataaatacatttctgcacacaattttcttcagtctcttattttatatttaaaaatgtaggggagaaaaaaaaaaaactttacctgtcttaggtttgttcattgtctgggacctctgacagaagacagactaacatgaaaaaataactgaagttcattgttgtatgcagcacctactcacactgaagaactcagatgggaatagctcaaggggtggttagaacgtggacttattagcctcttaacaaagaaagatatctttttagaaaagtgccaatacaaaggaaaagtgatttaggcttttaggggtggcaaattgtgagcagatagatatatacatataacattatataaaaataaaaaattatatatatctaatatggcacttgtaggatcatatgcatatatatgtgactatatcatatatatgtatatgatcatgtacagatatcatgtgatatgattatatcatatgtatatgtatatgatccaacaagtggcatattttggggtggcatatcctgaactccttcaacagctatatggttttacgtggatatgacgaatcaccaatgatatgaggaagtctagctagacagaaatttgtgacgttcaggaaggagggcccctcaaggacagtcaatgtcaaggacacccagaagaggtgatgcccaatgccctgacaagagcatgaagtccaactttgcagagtctgagaactgacaacattctgagatttaagactccacatctgcatctggactgtggcatcaaggtagaattaataaaagcaatgaatgtgaccttgaaaaacaaaaatgccaagctggttattgaggtaacaaggcattgaacttgagaaagcaagtacagggcacaaagtaaaggaaatacaacatggtcaagaaaatagagaatggattatttcactggggtcggcactcagattctaacctgagaatgaagttaacagcaagtttgacataatgttcaatgctgtaagttaaaggagtggattgggaaacagtgggatataaatctgggataatgttttttcacgctaattaattaaaagataattataaatattctacatttaacatagaaaatcaaaataattaaaaagcatcaaatactggttgaaattattaaagaagagagagtaagagatggaattgaggcctacaaataagaaatcttattattcaaatattcataatatcctacagcaaagttctggctaaggaagtttattactgtaactatagtgcactctcatcatagaaggaagagtggatctatttttaaaatgtatagaatatgttttctggctactagtttgcattcagggtaaaaatacaccaaactaaactatatgttgtatttgggatgaactaagatggagtagactggtggtaattatcaaagctataggttttcccatattatttcagttttatgaataatctttggaatttgtttttggctcctccccccaaaaatttaaaaccaatgccatataaaaaaataccttggcctcatcccagtctttaaaatttgcatttagttgaatacttacatttatatatgattttatataaatataaataatataaaataagagggaaatatataaaaatatataattcttatttatatctaaattcatattatcatattatcttaggtaatatcttaatacgtttgtgctgctctgacagaatacctaagactagataattaataaaaaacagaaatttatctcacaattctggtggccaaaaagcccagatcaaggtattggcaggattggtgtctggtgaaagcaactgtctgcttccaagacggcaccctcttatattctccagaggggaggaacactgtgtcctcacatggtgggagaaaccaaagggcaagagagtggtcctttcagcctggagctcttttataatgttgctaatctctttcatgagtgcttaatgcagtgatgatgacttaatcatctctcaaaagccacaccttttaattctgttttattggggattaagtttcaacatgaattttggaagggggcactgtcaaaccatagcacgcacttttgtgaatagtaagcaatattcatatttatctatttaatcatattcatacctatatttatctatgtactaaactatactatttatacatatctatatctatttactagaaagacagtgtcactggtcacagtattaataggataagcatttataatacatggacttggtacactcagtatatgcaaatgctctttgacttatgacaggattgcatgtttataaacccatcataagttgaaaatatcataagtcagaaatgcacttaatacacctaacctacctaacatgatagcttagcctcacctaccttaaacatgttcagaatacttacattaagtaagtattacttacctacatttggacaaaatcatttaacacaaagcctattttaaaacaaattgttgaatctctaatggaatttattgaatgctgtactgaaagtgaaacacagaattgttgtatgggtacttgaagtacaatttctactttttgcatatggcttttgcaacatcataaaataaaaaaaatcacaagctgcaccatcgttaagtaggggatcaattgtgtgtatcagattttggtatatttttgttattaaatattagctataaactattaaaatattaaaaaacaaatgacacacgtaactgtagattgcatcaattttagaatcaatatgtctgtaagaaatttaacaattttccctgctgtgatttataatgaacacattgcagctttttttagtcatgttcaattttagaggaattttatttaaaaatagagattctaaaaactatcataaatatagaacttggcatataataaaatttatattatatataatgcacaataatcctacctctgatgttttaatataaatatatacctcagtagatatttccatttcttttgttttaaattacctacctctggatcccaccagtgtagaatttctcctgcctaattgatccaaaaaagtactcaactctgttattagaaataagagtatatgcatatataaagaatatgaattttaaggatgttaggatgtatacagtggccctaggaatagtgacccaaacaatgactttatacaaattctgagtctagctaccagcgaatgttactatttgtatttgacatctaatataaataacctaaattgtgaattgtatttaatgcttactgcattttactgctgtttctgccttattaactcaagacatcatggggcagttatcatcttcattttatagattcagaaacatagaataggcaggttatatatagaaagaaagatccctaaactattgtcagaagcaaatataaaagaatccttaagcatctaaaggaaaaagttgagcatgatgaattagaaaccaggaaaaaaaaattactttagatgtgcagccagattttttgcttcatttttaaccttatagaatttcacaccagttttgggtaaggtggtagctagttggtctactaaaccctgttatttctttccttacagactaaactcatacatagaggtcacaagccatatctgaatctcattcccaaacctctctaatgctattactttaggcaagttacctaatctctttgagcctcactcgtcaaatagaaataataaattttagtgggttgtcataaggatcaaaagggataatgaattcacatataagatgatgaaaacctacctggctttttataattatgagttatattattgcctcctcttaaaggccctgtgacttataacatagaatttgacagagtgcttgtggtttaattaactgattcattatttcagcattaattatcatctgttgtatgcaaaatcactgtagtagatacttagggtgtacgtgtgtgtgtgtgtgtgtgtgtgtgtgtgtgtgtgtgtgtgttggatacaatcataagaagctttcatacagaatctgcttaaaacttgaatccagtagtcttctttttaaaatgagcccaattacaatgatttaaaatgtgctattacaataacatatccctatttaacagatatttaagtctaggtagaagtttatgaaaatgatatgtatcattttttctcaatgtcagatcatttcgtttttaagttaaaaagatggcttgttggacacagaattaaaggatggatttttggttaggtttttcatgcctgtagtagaagactattaaatatattctatttccatctgagagcaagagttttgtaatctaaatcacctaactcttgaaaacagtctgcttattccttcctttgtaaacttctgctaacagtttaatatttctgagcctcagttgccttagctattcgatgaaaccagcctacatcacagtgtcactctaaagattgaatacataactctggcaccacttgaagacagtgtctggccagtagttgatcctccataagtgatatccatttgtttcaagataaatgccctttcttcactttagtgcagatgctactatgttctgagtacagttcatcattctcaaaggatcttttgatccctgtttatacaaaagcgacaactgaataagaatgcaactgtgtaaatatttacttacttttaaatttaagagtaggtagttgcttattttaatgctctgggtgagattaactaaatgaatgaacatgacatagctagtttaatatcaaattgttgatgcttttttttcatgacactatctgagtaattatatttacattagaaaggcaaattttaaaaaatgtagcctatgcagttttgtgatataaaggcctaagaaatggtcaagaatctactctgatgcactaatttccaagatatgcttggccaatactttttaaatccacattaataaatcagaagaatgtttcagacaaaaatgaaatgaagagttttagggtgaatttgcctaacggatattaggaattctcctgctttattatgcagaggaaatattatgttgatctttcatttgcctttctaaaagaactcatacatattttattcattaatcttcagaatgccctgtgaccaaattgaaccagaaggggaaagtgaagttagtaaacagacacagatgttgaaatggtaccaaatcgatccttcataaaaaacctcctatgtattgctattcattcattcattctccaaatatttactgaacatctactctatgcaatgtatggtattatatcatgtgaaggataagaaaaatataaataaatagatagattacatgatgtttgcacttgaagaattatcagtttaataagacaagtgaaacgtagccttaaatcattggaaaaaatatgctggcatgcagtgagaaatgtatatagaaaacagtgcatttagatgagcatttatctactttttgtttaggatataactataactttacataaagacacaacttgagaatgttatgtgcccaattaacatgaagaatggttcactccctttgtagttacctcactggacttggataaaattctacattcctgtgataagtcaaagaaactcagaaacttgatcaggttgagcagactggttgatggaaccacaggtttcattgtaagatgctcagcacatatgtactctattcaagctagagaatttcatagctgctgccaggtttgaagtactccagaaagtgctaccacagtgctagagttactgccagacctggggtcctggtatttctgctgaaaatatggcagtcaaatggttatctctgtttatcctttcttccattgccttgagtgttgaaggccatttttgccaattgtctcctcacatcctgtctggtcactcatcactagtactagagctcaaatttactctcaaattgacctggactcccactattccagctgtttagttatctggttctttatgcaacaaaaggcacctctgagtctgcccatagtggctgagttaggacccccatatcagtcaaaagctatttccagatccagctcttctctgagactatcaggccttgtctacactgtacttactttcagctgagaatgtgttctctcacctaactccacttgagcatcctcagtccctcaaaggtaccctggattgtggtcttgattgtttttctcctaggagtttctttgattctttgtaaatttttccactttctttctagcaactttcaagccctgggtactactaaggagtgaaggacagagcagtgtctataaatccatgtatatagttgcaatttaagaaacagaggagagagtagtctcagtaaagccaaatatacatggctaccagagagaaggtgcaaagttgactttaatctatttaaaagaaaaaagtcactaaatgaatccattcacaatatgaaaacctacaccaaagccgggcttggtggctcctgcctgtaatcccagcactttgggaggccaaggtgagaggactgcttgatctcaggagttcacgaccagcatagacaacatactgagactccgtttctacaaacaaaatggaaaaaattagcctggcatagtttcacacgcatgtagtcccagctctttggcagtctgaggtgggaagatcacttgatcctgagaggtcgaagctgcagtgagccgtgatcatgcaactgcactccagcctcagtgacagagagagactctgtctcacaaaacaaacaaacaaacaaaaatccctatacaaagagaatttgatatttctatcttttcacatagaactaaattaataataataataataattgttattgttattattttagcatcactaagtacaggacacccctgctataaacgttataaaaatttgacagtttgatgttattggaaaaggaatttgggggaagatagggctcaaactgaatctcaagtataaatataaacataaaatagcattttgataaaaatagatgagagtaggaaggccatttaggaagaagataatggaaagccattaaagatgttagaacaggagagtgcaataaaagtaatatcatttaccatgccttgctaaatatcatgcaatttgtggtgattatataaagatatgtttgccttacactaactctaagtctcacaaaaatgctgtaggatgagcattatttctcacttacagatgatgggactgaggtgccaatatatttagcatgttgctcaaggacatttgattagtaaggttaaggctgagcgtttaagatcagtcccttctaacttgataacttgtgcttttcctgccctatcctgcttccaggaaggcatatctggtggctctgtgtgaatgcataagacacactccagcaggtagcaggcttcctgcaattcaagcctgagttaataaggactggtatagagcccagggggctcaaaggaatgattgaatgggaagatctttttgagatagggaaggatagtacggagacaaaagaggccttagagctttgcagcttaggtgactaggaagactctagtgcttttcaccgaagtggggctattgcaaaagcagggagcttgaaaaggagatggtattgattgcaaacaggaaaatttgagatgatggtaataccttaaaggaagagaggtccaacaaaaagctggaagctgaaaaattgtttctcatttctataatgactcagttttctgtttgtttcagaaatggagaaaaaaatttcagacttttgggagcatatgtttacaatccttcagagaaaaagacttagtcaacctatttggccacctagactaagtgactccagaagctgagagaatttaagtagtgttgaatgtcaaagaattactgcatactttagtgcccttgtttctcagtagtcatgccggaacagcctgtgccttcgtagtacctgtgtcaggggtcttacgaataatgccttgggagaagagatgttaatttgaattctggttccggctttcaagcaaaatattactcttgctaatgttgtctatcaaataaacttctcagatttcattcgcagccttcaaatatttattcctatttccaatttttttactaaatcaaaaggaaaagggaagtgaataagtgataaattaaagactgtgagatgtctttaaaatatgaacttctctagcccctaaggcaggtgcacatgaatttaactgacaaaaattatgcacagttttcttgatttgaaagtctcacttaagtgttattttaactaaaatttgaaacaatcaaaatctcaaggtaaatatagatattactcacttttaaaacatcataatttgaacatttactattacatagatattatgtactgtagcaaatttgtaagctataaaaatatgtggaagacaattacaattttccatttattaacataccaagcaaagaaaatgacaattatcattttaaggaccagtagaagttctcttaacccaccttcccctaaccgatttgtaagagtaaccaaagctctgtatccactggttaaaatatactgattgacatccacagaagtgagaaaactcaccatcaggaggctactatcatgtttctgtattttgactccgtggtttggtattcttatttttctataaccagtttattcttgttgtacctactaattcataattcaattaaacattacataaaacagttaaataaaagtgcaagcataacattgtttctatgaaaactcaaatgactgcatgaaaaaaattgataaaggtactttgcaagtatctctttattcttgtttcacttaaaagaaacaagttgaaaatcatggataatccattatgtttggagcttatgcaaaacagaagaggaaattcaatcagcagacccatgaaaaaggtcttggctctacattaatacatttaggaatacatttacagttagatgttgtacattaacatagaaattttgaagtatatatgccttaactgtttaactggccaaatgttagctttgattactttggaaaattatttataataaattttctgtgcccttgtacatatttcattaaaagtaggatcttatggtatacacagcttgcttaatgttttcttaagttaatttaacatttatttaaaatttgctatgtctcaagcactgtttttggaatagagctatagtggtgacttagatggagttcaccttctatgtggtacatagaaaatataaacaatgaaagaaaacaaattaggataagaagatggagagtgatttaggtgtggggaaggccctttagctagggttatgggagaaaaatatatgtggagtaagtcctaaaggataagaaataggtagccatacaaatattgatcagaaaagcatcctaggcagaaggaacaattgcaaacttcttgagatggaaacaagcaaggtgcatctgagggaaagaaaaggtaacccagcacactgataggttgcctttctttcataatttgtgatgagaaaaatcaagggtatccttttgatgcattatatttgaattgcctattagatatccaagcaggaatatgcagttttgtttactagtgtattatttgagcctctaacagtatttggcacattaataggcattcaatcaatatttgttgagtgaaggaaggaattattttgggaaggaataattttgagatgggtaatgttttacgagtttgaaactcaggtgaaaggattgtagaataaatttgtgagtcattagcacatagataatatttacagctaagaaactggttaagattatccaagggtatagtgtgaatagaggagtgccaaagagtgatcttagaagtcaagaagagaaagagaagcaaaggtgattgaagatgtgcagtaaggtagaagaaaaacaaaaagagtctaatttcaggaagactagagaagaaagtgttttgagaaggacatggtcaattgtgtcaaatcaagctatgagaactgcttaattttggtaagcttgaagaactaatcattttgatttgacacgaaagcattgttagcgacctcaatactattgtctgcttggaatgttggggacaaaagctaagctggactgtattgagggaatgtgaggtgagagagaagaggtatcaagtctaactagttatttcaatggggtttcaatttaggataccatagaaatgaacctgaagagatacataaagtcacataaattttttttaaacattgaattaaggcatgtttatataggtataaatattccagtagagaaggaaaaaataatgttgcaggaaagagtgaagatacttgcaaagctgaaatctaaggaagggacacttagagggagttagtcttagatagaagcagggattgtttattgcattataaaaaaaaaaagaagacagagtgtggaaattcagatgcaggtgggtggatgaatttgggcaggacagcagagtagttcttgactcattttctccattttattagtgaaaaatgaagtgagtataccagcagaaatggaattgaattggaagagaaatttagaaggtttaagaaggggcaataggagcaaaattatctttttggaaagtgggaaagtgaatattctggggaaatatggaacattttctgggtttatggcccacttgagattaggggccataaatgttaagtgatttcagttaactgcatcctactaaacccagaaggacagttaagtcagcaaatagttaaatttaatgagtttaatttctctaagagaccatgatggagaataagacctaaaagagttgccagtatttataaacaaataattataataccaaatcatagaagttagaatggaagtaagggaatgtgtgaggtgctggacagtgaaaatgtggattgaagttctccaagggggtgaaaattaggtggaatagggtcatttgagtcactgggctgggaggataggggatttgttaaaattaaaagatgcatgcaaaaattaaaagatacaattaaattttattaagcaattctaaattgtcttctaaaattgctgaactaatttatacactctccaatgtgtaccatactattattcattatgtttttaaatcaataataattcttagaaagttatttagacttatttgtttaacaatttaaatagaattgaatctcgccattattttgtgggctagtcttttttcagaatatgtagcctcctcccttctccccaccccccgaaaaaaacccatgtaacagaaatagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcaccttaattcagctttgttatccttcttcttcttcttcttttttttaactgtagcctatttggtagttcctttttcctgtgaaacatgtataaagttctacaaaaataccaaaagtttaccatatttattgctaagatgcaggtatactacattacttatcctcacatcattagacgaaatgcatatgaactctccttacaactgggtattgaacttcactggtcattggttattagaacattttcttttaatgactgtatctttttgtaagatacaagtgttactttggagagaggtaggaatagctctatggaaaatgtacatgtacatgtggtggaatttttcctgaaattaaaggaaacatgcagtttggtcaaatgcatcaaataaattaaaatagtgacggttactgcaaccgaatctgctgtcttaatatgctatcaatgtaaaacagcaatcatttataattgtcatcaaatgacaaagttaagtgtgataagaatattttgcacaccaattaatttttctatcagttttgatactttaaaatgttgaacatacagttctttaaactgcattgtttcttttttagctgtttaaaataaattctttaagaagtgcaacaataaaaaaacaaatcagcaatgttaaaaaatatgtaaggagacatgcagattttaatcttcttgttgctactgtattaaatattttgtccttatcaaaatgtatgcacaaaaactggacagaatatgcttctgtgatctttagcagctctgtattgccccataaatgactcagctacaaatcagtgaatgtgcttcaggctttgatttttgttattagttcaaagatgaacatcatgaggacatcactcagagacagatttatcatgttttgtttcagatctcatagtgaaagctgaattttcttgtctttgttctaccaaatacattgctatatacatgatagtttaaaaaaattaaacctttttgaatatgctagagaatattaaccaatgcataataaaattaaatcaagtaggtgccatcacagtctaaaaatataacacccgatatatgtctgttgacatatttgttattcaaattcaaattttctttctcatattgttgtatatttacaaatgtgtatctatactatgcaaacattgatggctttttaaaatttattttatattatgagtatataataggtgtatatatcatcaaatattgtatctgtttttctccttcatgaaacaaatgacaagatgagattagatgcacaacagatttattggcagatatgcctgtgaaagataaacaggcaggaggttagaatagacagttttcagaccgtgctataggtctgaaacctgtaaaaggagagagggaagacaggattggatagaaaaagtctcagacaactatgccaaaattcttagccaggccaatggggattcctagagccacagcttttcattagaggaattttgtacaggaatggtcttgttctagcaaggctgccaagctcaatcactggctggaagcagcctatctgaagagcagcctgctgaacacagtggtgtatgcaaaggtgcagatgctagaggctgtccttcagttatgttcctagtagcagtttcagcagagcttcttcatagtcatcaaatatatgtattttgggcctttcagtgaagttgttgctaagaagatatggattttctttcttaattttcttagttaatatgttcaccctaataggccatgtcctataagtgtataagtgttattaggtaagagaatgaagatggattctgtggctgcatcataggctctgaatttaaaaagcaacaacaaaaaccttactaaatcaaatctcaaaacatatatcctgattgtggggcagtgtgggcttatagatgtttgcaaatgaataagcacatattctaatttgactcataatgctgttaagaaacaaattcataaatgtaagatagttattgcatttcaatgaggcatgccagcaatgttcaacaaaataggggaagaaacttataagcaagtatggaaaataatacagtcagtcagcaaggtacataggtttaataactgagttaagaatatccatatgacttatgtgtgcagtatacatatataaatatattcttttatatacattatcacaattcttttatatatattatatataatatataaatatatatataaattcttttatatatgtaatagaattgtgaaaatatatatgtgtgtatatatgtatatatgtgtatatatatgtatatatgtgtatgtgtgtgtgtgtgtgtgtatatatgtgtgtatatatatatatatatatatgaattgtgataatagtcccccagaaagtaaaattctgcaagcgggaaaagagtgacaaggcactcatactcagtgagctctggaaaggtgctcaacttactttacctgaattaatagatcataatttagcatttgatgtatagtctttgattctcaccaaaaaaatcagaaagattgcaagatctctcagtagttctagatgagaattcattgttatttttcgttatcattgatcagtaatatagatgaaagctcaataacgggttacagtgaatgttcattgaatgccaagcactgtgtttggtactgctgatacaaaggcaagtaaatcaagtgttacctcttcccttgttaattagttaaaattgcattcattcactccttaagcaaaaataatatatggttcccaattgcttttctgggcattggggatacaacagtaaataaatgttacagacaaaataaatgaatgaaaaaataaacaagtcccaaaatacaactggatagcagctgtggaatttttcttagtagatggaatcttttattccgtatttaacactattaaattccttaatagactacaccataaactctacaatatagagctcaacttgagatacagaatgtttaaaagagaataaaaacttctctgaagaattccattgtttaaagaaatggaaatcagcattattcaacatttcttactttatatatttaaaattatcttagttgctttttgtgatactacattattattttaataaaatatataaagttggatgatgataatataactcttcaaagatacttctgttagtggtttgatatatattttttcataatttttagtgagtaaatccatctacacatacatttttacataaatttaatttcatgcccattgtcactctttaaaatttaccttcttttaaaattactacaatatatgggcatatgctaatttactgataaatatgttgattgtcttccgttacttaataaacaattttaagaagaatctgtttttatatatatgaatctccataagagtatttatattttcttaggatagattcttagcaagggtacacttgatcaaaatttctacatattttaatttttgacatatattttcaaatggctattcaaaccttgtctaacagttttccagtttttcctctgctataggttgaattatgtcaccaacaaagatatgttgaaatccttacccccaggtacctatgaatgtgatttcaattggaaatagggtctttgaagatgtaatcatgtcaagatcagctcattagggtcggccctaatccaatataattgatttccttgtatatattattacattactttgtaccccataaatatattgaccaccatagttagtcaatttaaaatttaaaaataaatattaacgataatttaaaaataatttttaaaacagaagagggaaattggaacacaggcacacacacaaggagagcaccctgtgaagaacagacaaacagggagaacacaaggtaaaatggaggcagagattccattttcactgcaagccaatgagtagtagctggcaaaacaccagaaactatgagaaagatataaaacagatagaccgtggccctgcaggaaccttagtttggacttcttgcctccagacctgagaaaataaatgtctgtgttttaagccatcctagtttgtagtaatttgttaaggcagtccaggaaaactaaaacccacctctaacattttagagtgcttctttaccctcatagtcaccaaattgagcattctcactactttattactctgtctattagaaaagtaaaattacaaagatacctaatacatttaaaactaaatgaatctcattagataaaaggcagagaagtttcacatttgtcatatatatgcatgtttgtctatttaccaacatacttacctgttatcctttactttgttttataaaaggatttaagcagctattctctagttaatatagaaaaaaaatgctttaaaatggaaggaaaagaatcttccattaaagaaatagataggtgtcatcctcccagccaaataactgggctttgcgcggggtaggtatttaagtttatggctatagcagtatctggattgcagggttcaaatcatatgtttctattttctggctaacctcttatctctcagcttcagggtttggcatagacctaggatggcacagaatcatctaccatttctatgagatagaagcctgagaattcttgccattaacgttcagcctttctctcataggggtttgccgtgctgctgaaatacgcagttggtctagatggaaaatagctttctgacagtgtcaattcaaggatgttctgagtttattattaactctgggaattatatcataagaggcaaatactcctacaaaacattgatcaatgccactgttagagatacttggtcttaggttgatttgatcagaattacatttactatgttttaagtacaagaagagccctctgatgttcctcattgtggagttcttttcaaatagaatgcattgtaaatgtcatctcctgtgatgacaaggcagttgtagagtgtaaggcagtaaaggtgagatggaagaacaggggattggcagtcagaagcctgcattctagttgtggctttgctgcttactggctgtgggcctttggaatggtgagttgaacttctgtgttctcatcagtcaaatgggctttgaagtatacctcaaaaggtgattgtgaagatcaaatgtgaccatgtttatgcaagtattttggaaacatctagcgttaaatatatgtaaaatgttttcagttgcagaaattttagtttgaatcaagagtggtgggactttgaaacctctattctctcttttgtaaatatttttgtcatatttaatctaaagataaaaacaaaacactttataataactaaaggtttgtttatttggggctggctgtaagcaagagagtattatcactgagggttgttcatagccactcctgtagctcatccactgtttcaatcctacagtttccttcctttccgcgtaggctgtcttcacctggggtcacaagacgtcctcatgctcagcaccatgctttgttgaagcaccagggtggaaatattattatattttctgtggaaaaagtgagggaaattgagataaaaaggggaaaagttatttaaataagtatgttcatatctggtttataagccttaagataatttttatgaagagctatcttgttttactcagattatttttattttggttgactttggcacctatctgcagtattagtagcattgaagttgttattcagtggatgaaaccttgctgaagtggctgtgtggataccctaaaatagccacttctcccttgatgagtgtcgcattaagattccatggaagttcacaagggaaaaacaccttttctgtgttggcttttgttattgcacccctctatcccaattaacatttactgttttttacattggtaacttaattggctgctaaattttagaagataaactctgaatgtttatgactaaaattagaaatacttaaaaacattatttaaaacaaatgcaatgtaatgatgaaattcactgactgtatagtaaatatgttgccaaatatatagaaatgcccacaaaataatattttaaaaatattctaagtttactcttcatctgtattctaaatttgattccataatttgagatacaaaaattcatgattttaatataaaatctgaagagtaatattcatgaccatatacttacatatgatctctctaaatatatagtagtaatattaactattaataaactctataatgcaatacttcgtattaaagaggatgattgagtttaaatagctttgttcttacttatactttacttccttgggaaacaagtgaccttatatccaaaccctctgaagcaaagcattgaaataaaatgtttttaatgctgtgatgagaatttaaatgtcacagagtgctattgacatacatgtaagatcaaaagaggaagtgtgttatgacagataaatcaagatagtagaaaattctgttaaggtctaaactgaaagtatcataactaaaaacatgtagtggcattttcatgtattctgggcacacaaatcagctacaattggccaaaatgttacataatgaaagccagtaaataacatttttttcctcaaaaatagtagactgtggcattatacgtgacatttagaaaaggttcttattgtagctgtttctatcaatattcctataacaattgatttaaagattgtatttattttgtacttcaaacttccttcaactggtaaaatagaaactataaaagatcccctacctatgggtcaaattacttaccccaaatgattgagtaaatttgcaaccaagctgaaattagaacttttaattataatttaaaagatatttgaaattgaatggaaccaatcatagaaaattttatatttagctcctcaacacactaaagttccctttttgggccataggatcatagctgactgctatcttttagaaccttgctaccctgtgtgtggtccactgagcagcagcatcaacatccatgcagaaatacagaatctcaggctctagcccatacttactgaatcagtttgccttctaacaagatcctcagtgatttatatgcccattggaattggagaagcacgatttcaaacatcattatatatttcctcagttttttttcttacaggcaataggtgtgaactacttactaaggtggactgcaataaaaaatattaactttgtcataaaatgtcgaatattcattagtgtatttatacatgtatgagtctgagaaagccagactccaaagagtgaactatgcaatacgtattttatttttttctaataaggtattgatttttgttacagataaagatttaaaactatccaaatactgcattaaagtggcaaagtgcttatgagaaagaagatatcagagctgaatttctacttttatcaccattgagggatacagcattctcaaatgcatccagtatcattatctgactagaaaattcttgctcaaatcattgttcaacagaatactgtttagatcttatttacagtttccaattggactttaggcaagaagctcttgtaggctttaaattccacacaaaggcacaatcacataatcatgactcttcttcctcaaatattttacatgcttcctcataaaaagtagagctcttcaaaaggttaggcctatctccctaccagtattggattgagtgtacagacaaaaacatacctcaaatatgtttggtaaagatcagaaaaaaactctaatttttcattttacaatgtagacttgtcacaaagaataaagaataagagaatagctggaagcagtacctctttcaaagcgtaggagggcaggctgtcagcaaaccaatgggactatgacgaaaggccagcatccactgtcttttagtttgtggaaaccatttattattttaaaaaattataccattaataaacttagaggcatggtatctgtcatcattactgatttgtatgcatgaaaaaacctcctgaccttttcttttttaaattttataactcatgtgaattcggtttccttaaggacttgttaaacagtactatggctttcttggtcatcctgaatgctaattttcttcaggtaattcggttcgtgaagactgaaagtcattatttgtttatgacctaatgtcattcattagttctgtttcattaaaaaaatggatattactgaagaaatatgtttatcaaagaaaagattcaaggtgggctttattatcttcaagcatgtggtctattaagcaaaataagatattcagcaaaagactatgataaatcagtttctctttattgaagaagctactttgacatttccattccagctcagtctaagtctgcatgacaaacaactgtttcttgctagcttctgtattaatgtttaaactctctttggtaatcaggacttttaaacattttttataatgatttggatagaaatagtcaaatttataattacatttgtgacagaaaggtgaaccttctaacagtagtatttttaaacatatctctatactgaagcaaaaagaacaacctagcatcctttgccttatcatcttctattctataaaatatgaaaatgggataaaagtgaagtatacactgtgttttcaccctacgcttgaattaagaattgctttctttccttcatattagagtaagttaaaattagaacactttttatttaaattgtcaggtaaaatgtgttgctttcaaaatatgctttctttttagtaaaataaagatccacctttctttcttatattaaaatgcaaagaaatgtatattttagagtaacatatgcatttattatttgcaggggtcatacagaatagaggtaggctaccagagtgcttctccagagctgatcaagcacgttagcatttgtaaagttcttttttttgtcaggagaaccaaaaagacatacttccaaaattaaaatgtaaatcatatgttcaaaactaaaatgaattaatgagttaagtcttacaatacctgttggaaacactttccacaagacttttgtgatcttttatttgatgggccatgagcaaccagaaatgagtatgtttttagattcctggactgccatgcttcaaatatattgatgtatcttactttacatctctttctctaagaggattattcagttaccacttttgagcttaaaaaaaatagactttaatgttgtattccagataaattcttttaaaattctggtatcaacttttaaaatattatcttctgaattatccactggatttttctccctggaggctcactttagagatgttcacacacaactgctggtttgctttagataaagcacttgttctcacgttctcatgtaagttttatcacaaacaatgtctaacttcacttttatcatttcgcttcttaattcctttctctttgtcacaagtcctgtgctttgtagctgttttccttatttttgtttttaatgtggcttacctttgcagttaaaattcttagaaattattgttactttgaatttcaaatcagaggaattaatttttttaaagtctataatgcaaacaaattattatgatattgaatacactaaaaatctgaagcatttttccagtttaaatgataattataatataaacaaatacactcttataaaatgtgagtaaaattaatattaagagagaatttgaatagcttcaatattaactctaatattatttcatatacaaacgttttacaatttatttccaggatcagaaaaggaaccatataaaataccacaaaaaaaaatataggctttgcctgaagtgttataagtaaaatttagaaatgttcataaagattataaagtttcttctcaatttgtttaagttcagaaacgtcattaaaatgtttatatttgctcacctttttggtaggcacaggctaattcaagataaaataatgtaatgtttttctgggtgctatgaccccacataaacagtcctgaagacaaataatgtcattcaggatgctaagtgcttacctagatacaggacatgatagggacagatcccccacctgaactgaagcaagtcaaagaggacttgaggctaacctgagacttggaagatgaagagttccctggcagacaggaggaaagaaagacaagactaatggggagtgttgtagggaaagaaactggcttatccaaagtcatggggacacataacagcacagacacataaactgtcagtattttagtttggtctacgtctagggacttaaagatcaaaccaacatctttaactataccaagaatataatatagtccaaacaacggcccataaatgttctaggtatgtgggagtttttatggcagtcttcattaatcccatgttatgaaaaagaattatttctgatgttcctgacaaatcagcagagttgcaagtgaaggaaggaaagtggaagaagtttggaaataaatgaccgtgatttaatatggaagaatcacagcaagagaaccctgatattttggttctaactccagtttagtttataaacctgcttcgtattctaaacaagtcatcactgaccctatattttctaaatacaggataatgtttggcctaaatatgttgtttgtgttttaacaaaactctgttagtcaagagacaaaaacacagtgtcattgttggaaatgctgaaagaaatcttgaaattcaacctccttcatcctatagcttcctccacttccaccttctacctgcttccccttctatcttccttttcctgtttctacattttctaccttcctatgttagctcctgagcgtctatgaataaacctaaagcttcataaaatactgtggaaattagtgtccagataacttcttatgttctttcagaccatatttctccatctctgaatggtgtttaattaataatcaattaatagtcaaagggaaaaggggaaatctgagggcctgtgataataaataataaatatagttaggttaattggtggaatctaatgaagaggaaaggtatactataatgaaagaaggcaataaataaaatctggaactaaaatagtaattgtaaatactatctatgaattccttagtgtcagatattttaaatatttagtcttgtttaaatttccaaccatcctggagtagctatactgtttcctgtttatacagaaaagtacatgagttaaacaggttaaaagaatagtttcttatggactccactgacaacctatggagagacaatgcttttgtactgggcccttataggtgttgagcttaatcttcagagcctcctgtcctggggtggggggaggggggagggatagcattaggtgaaatacctaatgtaaatgaccagttaatgggtgcagcacaccaacatggcacatgtatacatatgtaacaaacctgcatgttgtgcacacgtacccaagaacttaaagaataataataaaacaaagcaaaacaaaacaaataacaaccacaaccacaacaaaaggtttaaagtaagcatattcccattttatagctaaaaacctgagattccaaaaggttaaattaattgctcaacctgaggccatctggctcctcttccagtgcccattcctctacatactttattgcttccttaatctccacaggaatcatttccccttttctatcagccttcaaaagcttgttgattgctctctaattacaaatacttggagaaaagtgtgtaaattgatatgcaaatgatcttttccccttagcaaattagcactttacttccatctaattaagtagctttgtgaaggaaatggatttctgaaagaagaatggaaagtgtttggatttgttctgggggtgtttctggtttagcaagccttgtaaatgaggtatataaaaaggagtcaagagtaggagcaaacaatgaaagcagagaaaaaacgaagggggttggatgaaaaaatttaagtataatgactgacaaaccttcaggagaaagtaaactgcctttcatctttcattctttctccaataataacacttttttttaaagtaaaataaaactttaagaaagttctgatttctctcagacatcggtgttaacgctgacaatatatttatcaaaaatggatatattcaagcctaaactactaatttttgttgtatctagaatttacaggacattctcttaattgggaagaaattaattccttgagtatgttacaagaattttccttaggaaagagtcacttgttgcaataggaattaagatatggctttgccattatatatatttagtggaattaggggcaagacatgtatgtactagcttcttccataataggactgaagcagttgcctgaatgttatctttaattattgccagtgaatagtaattcggtactgaatatgtactgaattgaacatgtaactacctgaagtaaaaggtgtcaatttaaatttttcattgaaaatatggcaactgagattcacaataatatattaaatctttatcctctagcaatctgtttttatgaatttaacaaaatgtctgtatgtaagcagtttagttgtatgtgcttggggaaagcctttagtctttattaaattatactacccaggtccataaatagctagttcctataagttacacaatgccatattaagttatattagccattcttcttaataatgaaaacatatttaataataaaatattatttacccttctacctatgtttctttgccaggtattatactcttgtctataccaccaaattattttttggatttacaatgtttatttttatattttattcattaaaatgtaataaaaaataattgaaaactgatgctaattgaataccttaggaaggatcaactctgctgttggcaatttcacttatcttattctagttgccctttaagaaaaataaagagaaatcatattggctgttttccaggagattataacacattggagaagggagaatctttgtagcaaaaaataactagaaaaccattgggtgccagatacaaattatgatgtaaattataagaaccattttattataaacacttctatggaaaaagtgacaaatatcacatatcagagaaaaggtcagacattcagatcttaatttgtatacaaaaaatctttttactgttactgaatactgatatcccaagagtaattgaagaagtatgcaagtactataaattgcctccaagctacaatattcttttgaaggagaaaagattaaaagattataaattccatattcccaaccaccatcatccctccattatctagactgtgtcccttccagtgtattgtgaaaaatcttcgagagatcatgctgccaatatgtcaaggattctacttttttgtaacaggtgagggcctttgatatcaaacagttcaccacctttattcttacaggaagacactgaggcccagagaggtcacttgggtttgtcctgttgtgttcttagaggtgaagatttgataccaaatctgacatgtgatcctcaaccaagcaagggtttcaaccttgacttggtatcttcatgctctgaatagtcatcactttattgtgcaatttatctaataacacaattgtgtctgtaaagaaaatacaaatggagaaaagtttctgcaattattaagcagaatataaacctaaggatatataaagcatatatttatctcaatatttccatcttctctttctcaaatccaaggttttcttactctactttcaaagaacaatatatatgatgttttaaatttgaatataaagaagccatttaaatgtattttctgaaatgtgcaacaggctgcaagggttttttttttttttttttttttttttttttttttttttgatgaatacataattgtcctaggcatttttaatttgttgcatggcagatttcctgaatcaaatagcagctgtttggggaaagtagcaagcacattttctgcaggcccattggttgctgttttgctttcatattctctcaccattaactatacagcagctagagcagaggagttgttaacaaaatatactttcactgctagccaaactatatacatgacttagtggtaatatttgattttatgtcatttacttatgtctctgtatgtcttacaccaagggactaacacccaatgggagaaagaaaaaaagggaaaattaactaagtatctgtgaaccatcaaataggctcagataaaataatgagccttcaacaagctggaatataataacattaggactttggagttcagtgggcagttagatgcactaatggcactgctgtgctgggaaaacatatattttatttggaatttttgtgtggaggtgattgcacattatatgaatagctgtgctaaatgcatgaaggttttctgccagcataggaggcgattaaggccccctctgccagataacagctcactggagggaagtaatggtggcaaagtaaaatctgaaaacagatgatttcccatttaatagtccattgactctcctcctacagccactgtggtgatggtgctgctctttattttcatttcacaaagaagcacaaggtattctgagattttttaggtcatacattttctttcaaaaagaaagagagagaaaaaagatgagagagaaagagaaaaggagagaaaaaacaccaagtattgcattaaagaaaaatgcaattgattcactcattcattttaagaaaaaaagatacttatttttgtgtttattgaatgttcattgtagttcaggatgatttcgtttttttttctttctcccctgcaccccctcgtttgtgtcactcatcctctagggagctgtatcaaacttacaaaaaagggtactgcattttgaatgtatatccaacatgattatgagacagacccagcccacactgtcagaaaaaaataaaaaatgtgtttgtccgttcaaactgtgatttggatataaaatagccaatatacttttaccatttaaaacattttcccattaattattttttctcttctttatcttttatgtgttctatattctcataccatatatgttgaatatgcttatctcatttcaccatttgtttaagcatagcagttaatttgtttcttcttaaatattcatcaaacagaattttgattaatttagatttaaattaaaatgtgtaagtgtagtattgtctattaataattcctggtatttctgccataggtcttgaaagtaccttggtccattctggactatttgtctttatttactaacatcattttctgtcataccacatctatttttatgtacttttgaaaataagacaaataatgattcagtcatccaagatttgcttaggtatggaaatatcaattttcaaatagtcttacagtaaaacaaatttaaaaggtcctagaaggaaaaaaaaagttttagttaaactcacttatttgcaaactactaaaaaaataaaataaaatgcaaaactgtacttcacctttattttattgctggatgaaattttttgttttcagaattattttcagacaatactgtaaatttttatggccagaatcttagcatttgcattttttatgccagatatgcattattttgatgtctaggttccttcatcttaaaaatacagttcatgccaagttttgggagattgatcattaagcaagctggcgattaagcatagcaacactgaatgtatggatgtaaccattcagataggtggttctatctaatatgtccatttgttttttagaatgataaatttttaataatttttacaattcctttaatcaggcagcttcttctataggtactcaggacagtttagtttattgattgttgcttcactttttgctgtcagaacttgtggatgtctcttttctattctaaaaggcagtttttacagcaacaaatagcatgcaagtaaactataaaaatgtattcagcaaggtagggtgactcagcctgcaatcccaacattttgggaggccgagatgggcagatcacttgaacccaggagttcgaaaccagactgggcaacatagagagactctgttctctacaaaaataaaaataaaaattagctgggagtggtggtgtgttcctgtagtcccagctacttgggaggctgagatgggaggatcacctgagcccagggaggtagaggctacaatgagccatgattgtacccctgcactccagggatacataataccctgcagtgcactccaagtgcaccctgcagcctgggcaacagagtaagatcttgtctgaaaaatacataaataaataataaatatgtttttatttttactgcatattctcttctttaataagttgttctacatttcatttttctttattacctcttttaaaactataccactttctctggtctttctgttgtttgcatttcatgcctttgacttttcttaaccctatggaattctgacatacttacatggaacacatatattatttaattcactacatgtatatatcatttattttacttgcctttaagaaattacttctcacaaaaaaaagaaattacttcttaatttcaatatgtttcatgcttttcaaggaactcaatattttcacttaggcctttttttccgatttatttttgtaagaaagttaaatctatgtcaactctaaaaatactttaatccatttgtgctttaataacctcattaaagggggaaggagtaatgaagtgatgtttctacttcattaaatatactagtagtgagaactacatatggtggttttataattgttattattcacaactacatcctgaacatttctgaaagatttatagtgattagcaatattcttcttttcaagagagaaaaattatggtatgaagagattagtaattacctaaagattttattggttacttataccaggagtaggctagaactgatatctactaaatctttctattaggtagtccattaaaaacaaacaaacaacaacaaaaaaatttctgtaatttgaccttatagtgctatattgaattgtactaattatgatggctttatcttcctttgactttcagatccaagtaatacctgtgcatttgaatctacatgatctaattgtgtttatacttacgtctttcacaatttttactactattgaggttgtttgtataaatacggtaaatagatctgataacaactcatagctcaggaatttatatatggtgttaatgagcacaagattagtgattcaaactacattttagttccattttataaggcttcaccttcttctcaaccagacagtgtatctggactgtatacaaagagggatggatgccaactgtgaaacccagttttgaaatgtgtttttgttaggcaagatgaggaccaaaggaataaaatattatgagatggtggggaggagataaatgtctaattcctagtctaaggaaatatgtaagatggtggaaccagagtcagaatccaaggaagtctggggccaaagctgacagaagaaacaaataagatgcaaaagcaaaggatttaagatgtgatcagcatggaataatctgggagaggatgctgtcatttttactgccagtccttttaagggtccaatccttcttatcagggatacatctgcccattttaaaaacatcatatttagaaattgcattctgataccagacatcttatagaaagttgtgcttagtcatgcctggagtaggtgagacagaaagaatgagtagttagagtccatgctcacttttagaaaaaagaattcaaagcatatgcactactttgagtgagtcagtattgtcgtcttcaaatgcaaaggataacaagtaatttctccatggccagggttgataaaaagtgactcatgtcaaagatttatcttttttttctccaggcatagtgtttcacaaaaaataaatctatataaactgcaaaagtaaaatgttcatatatggacaactaaaagacagtgtttatccattccattatagacattgtacaactatgagtcatagtggcaaaatgacaagttttccactgtagcatctaagatttaaaaataaaagaaaattagaaatctcaaaaataatagtagattgcaaaataccttgcaacattttttgagtcagccaattactagaaactggaacatatgtttatctgagaaatacctttcagctgccttcctccatggctgtaagatacattttgcactacactgcaatacctataattataggactataattttaggattggaaggaaccttattgatcagttagttaatcccttcttttcacagctgaagaatctaacaactaaactggttaatgaataaatagtaagtgaagtctaataaaacatgtttgaaggctaatagcatctatataataaagactaaatagatacacattcaaaatatgacttcactgttgggcaacataagacagctagtggagaatttagatttctctctttctaactgattgtcatgtcttatggaggaaattctcaaagataatgttaacatatgttgggataaaccctttctgctttacctcttcttgttatctttttcttattttagattgtgtagtgttacagatatatttgtataaccagtggtatattttatgtactctatgaaatttctcttctctcaagaaagttgtagactagccatatttatcttaggttgaagatcatatgttctgttttgccctggacatttctggttgtcatagggtagtagttaataataccctctttcacttttcaaaatacctcagtttgaatgataagttatatgtccacccttgccttaggtatagtctttataaaaaaaaaaatttaacttttattttagattcagggggtacatggacaggtttgttatatgggaatattgtgtgatgctaaggtgtggagtttacgttatcccatcacccagatagtaaacatagtatccaataggtagtttttcagcccttgtgtccctccctctcttccccttctggtagtttcctgtatcgatcgtgcccatttttatgcccacgtgtacccaatgcttaactcccacttataagtgagaacatgtggtactcggttttctgtttttgagtaaatttgcttaggataatgacctctagctgcatcctgttgctccaaaggacatgattttgtcctttttcatggctatctaggattccatggtgtacatgtaacacattttgtttactccatccactattgatagacacctatgtacagtctttattcactatttaaaatagatttatgggattcatcaactgtgcataagagcatttgggtaggtgaggaggcattaatgaaagatggtccagacacaattccaatatttagaaattggtatctggttggggagagaataaatactttaaatgattaagacaacacctaattcagtgacagaataagtgatatgcctgaaaaatctaagagttctgagaaataggaggtttgagggctgaaatgatgagcattttccatcttctctccactctgtttaacatttccttaccccatgggtatctcactgaaggactcctgtgacctgaacctgccttttctgtctctttttcactttattgctctctgtaagttagtgtgtctgctatgttcccattgcctccaacattaaactctcataaaagttttattttcttttactttgtgaattcaataaatctactagttactttgccacagtgatccgggcttatggctttacacgggtaataatcattcatatattaagtggctgcccttatactcagcaaatctgttccttcaaagtgaacttttgcagctattgatttctttccctagttcttgtaccttttaccaaaaagttggatttcccaagagcaacaccattgggaaaacattttagtaattgattgcgatatattttgaaggctatgtgatcttagttctgtgggattccaaaaatgttaattatagagtcctctctattgtaatttctgaagtatcttctctaaactacctccactgaatctgaattcacattgtcttatagtagaagaagatattattcaaatgtttaggaaatttctcaggaaacgataatttaaccatctgtatttgccttgtatatctgtgggacaatagacacattgatttagtatttttcactgttttttgtatagaagacatttttcttttatgttcttgagtaaatcatctcagaaaagatgtaatatttttatgttacaggtagcatcaccataagaatggctcactgattagttttgacttaaatacatgtttaccttagctatgctaagattaagtgtacaattttaatcttcaatatctgtaggcttccaggtttctggacagaattcaagagagtatcattttgtactggtcactgacagtccaaagactgtcgttaactctgatgtttttcaaatgacatattgtgttcacctgaatgtttgacccaacaaggaaaatgaatatttattccatacatccttaaagaagggaatttttcttttgcttttcataatgtaaattacatgatgattgcataaagttttcattgagattagtttataacaatttttttctataaatttaattaataaaaatatctaaatcttaaagtcaaacaattaattttaaatacagccattgacttttcaggacttttaaaacctcataaagattaaaaactgcacttatatatataacagtgctaagataggtcttaggtaattgtaattttctctttataggagatttgaagaataatcttcctatgttggataacgctttatgcaaacagtgtccagagaaaagatataatcctcattaaaagtggttgtgcttgcttagcctctatgtttaatagaaaatcaagacttgctagtgcaaagatagtgtctgttgattcagaagattatagcagtgattttccagaagctaatgaaaggtactaaaatgaattgataatctaactggtgcattttaaaacgcttaaagagaacttaatatataatgtcttcatgaattgcttctagttctgttttaataataaactcgtaactcagatatgcatacaaacaggaatcaattgggacagcaatgagcataaacatttataatcacttgcttttataggaactaaacctatgacagttatatcgatgattagagtacctacacatgaagacaggtagaaagtagaacatacatccaaagtaacatactgtcaaaaatatccaagcaatgattgcatatttgaacaatgtatattaaaagattataaaattatgtgagcagtatgtatttttagcattttatatgcacaactatcttctgtttggtcaaattacgtgtcttttatacacgctaaaaactgaaaacaacatggacaatgcaaaagaataagtttatgtttctaaataaaaacctgtacttgttaatcattttgttttttataacatctccacaacataggaatcaagtcatgaaagcagacaaagtgatactatattctgaagttattatgctgttggcctgactgacatctgtagacataaactctctacctgtttgaaagtattacagatattaatttttaacaatatttgccctaacttgcatttttctctttgtttttagtatctgacattttatatgtctcagattaaatattattttgtggtggtaaaatgtaaacattatttttatgaattcattctcatatatatacaatcacttaaatatgtattgaataccaggaaataagctatatttaacaagtgaacacattaatttcccaggatatgtttattgaaccttatgagactattaattctgatttatgtgctccttatgtttgatacacagaaataggcaaccctttggagaacaaaaaattagaagaaaatagatgctataattcatatttcaagtagtactgtccccagtaatacagagctagtgaaaatagcgcaggatgcttgatactggagtgtactttaaacaataaattattggagggcatagaaacctcatcaagacagcaagtctgcaaagactccatgtgggcaacctggccttgctctcctgtgctgctggtcaacttcctacagctcagctggcattgctcaccagacaagtacatgataggcatatcacttgttgtacattatctttcaactttttatcttttaataattttctggctcattgttacatttcctgtgagaaaaatggagttatttgaaagtttagtttcagtggtttttcttgtggctataattagggtgcagtccacttcccattgatctgtgcacagaatacaaaatacataagagaagaggtgataatgtgaagtgagaagttaaggggaaaatggccatgcggcttctattatagaaatgagggcttaaacacatacaatgacatagcctatatataattgagagttatctatgtgcatgagaagcaatgtgtatgtatgcatatatattagcggtgggaactgtacacaggctaatgtttagcacaaaaaatgataaaataattatttttattaattaaatgcatcaaagcctaattaaggaatgactcatgtgcagatgattatgaataaattgccaaatagaacctgtccaaatgcagaaaaaattgattttaaaataattcatataattattttattgagataatcaaaaatatctaatttgaaagcaaaatgaagatatttgaaataatttggttaacttatcacatataattattttattgaggtaatagcaagtatttaatttggaagcaaaatgaagacatttgaaactagtttggttaacttatcacagctatggtataatttgagtcagaaaactgacatcaactaagtaacaatagtatatcaaaccattgagtatatactatgtgctaaataaaacatgtatgttatgtcattaaattctatcagtaacactgcatggtagatacttgcatttccgtttgatacaagagaaaacacaacttacccacatcacagtagagtgccacagccaaaatttgcagctgtatctctgacatcgtgacatttattttaaaaagagaaaatgaaattagttatttatttaacttaatagagtggttgaaagcatgggctctaaagaaaaccagatggttttaaattctgacaggcactcatatactagctgtgtagtcttggttacttaccttattggagcctggattatctaatttataacatggagataacaatacacagagtaagcactcagtgttgttattattaagatatacatgttgccttaattgactgaaatatctatgacaagtgtaattctgttgatatttatctggatattttaaggtatgttttatttgtcttccaatcaggaacatggtaaccataacctgcccaaccccaaactaataactgaggctataaaaagtaagagtcacttaccatttcattctatgcagtttcctgccttgaaataggtgtcttatggctttggttggcaatactgttaatggaatatagttgtattaaaagcaatttttttttgacaattctttgttagcagtcagcaactaaatatattaagaagccttgttttgcacactcttccaaccacagaacactaaagatgtatatgttataattacaattatcctttctcttcattgtcctgctgaggaatgcactgtaattctggcagctagagtagagttggcttgctttccttggattgcagatgtctaattgcaggcaaccatttcatttaaaatggctcattaaagtaaaaaccatttagcatcagtaacatggatcagcatccatgattatgcatttaattagagagaagtatgttttctcctcttttctaatttttctatctatagatctacctatgtatcaatctatgcatctacccacacacatacacatagatgcacacatgcagatttatacaaagcttgccttagacattaattttatcattttgccatcattgcaactccttggctaattgttccatggagtatgtatagaacgtactaattatgaaattatagaatatattgttactcaatattagtaaattgcatattgcacatataggaattttctgttttgtaggcttttctagatatgttatattttaccttagtaaatgtccttatttactaactgaaatattacttgtttattatcattccaaagaagcgtcatatcctgaacgctttagtttactgatcactgaaataagaccgtggtgtgggaagagagagagagagagagaattccaatttttctcattctcatgcataaaagatcaatcatagaagcatagttttgatgtgatgatatgtcctgttatttgtattgtgaaaatagatttgtctaacaatatttgttcggaaatagaacatttggactttttaagcattacttttaacaatatttttaaaaatagtcaaaaaccacaggcattatctatatcataattctactaaacagcagtgatgagtggcaattagttgtttattgagtcactgtttacataattatttgtaagttatttgtaaatggccttaggttttttagatctataaatttcagtgaataaaatataatttaaaggctttcataatattaaataagaatgaaccaggctgtcttttattagcttatttttcatttcattagagaaaaacacagtttactttggcagaatctagatatgttgatgtactttatcatgtccaaattcgaggcagtaaataattttctgtagagagcccctagtccttaaagagtagactaaatcaacaaaggatccagaagtaaaagtcagaagctaaagtatatttgtgcatttctgtgtcagtaagaaagaagttaagactgagatataaattaagaatacattatataaaacctgctccagtcctgtcctgtaagacagccaggggatagcctcaagagttcaaggttaatgggtctctatgggaagtatttactttctcactggatttttaaattacattcccttttttccccaccagtactactgaagtaaaaagagaaacaaatgaacaaaaacagtgctggcaggtatgctatttattgcccaatggaaaagttataaaatcattgttattactgctgtataataattgatacatactgcttgatatgtgccattgttttatgctggtcacctttcacccttttttgtttttttttgtcacattcttgatatagatcataagcaagaaaagagacaagtgaaagtggaaggggaggaaatagagaaaagataaagagataatagagaaaagaaagagagaggaacttcaagaagagagaaacatacttcacagctgggcaagattcagatttttttttaaaaatgagaggatcaaccatgatttgagagaataaggatacaaagttagtgtttaaaaagagtgaagagagaggggaaagagttgttttgagtttgaagtgttagtaaactatgcttctcacacactgcgatttacttgaatgttagtcgtcaaagtgatatcaaatcttatcactgcattgaaatgcaaaatagatgattgattactattcatagttcttcaactttctttctaagcaaattttcaagtacttctatgcagttgcagtccaagtagctaagtcttagaaattatctgagcagtgaagaaagtattactcatctttaggaaggaatacatttaaactgaaagtgaaattgtgtctctttgatcaatggacaattccaccctaacccagttgctaaagaaactgttttgatgcctttatttttcatgcctgccctcagttactctattgtttttatgctgagtgctacaaagggaacgaccatcaaaatctctttgtactaagaactttaggaaggagtgaaaataatgtataaacaaagcttctgccctagttcattataattgggaaaataaggtaaatgcgattatacaatttcaaagactatataatgaaatagagtgtaagttttagaataaaaacctggagaatcaaatgacaaaaacatttgcacatagggtttcttttagggagtttggaggcaaataacctataccatacctattatataaggcacagaatagataatagtgtttaaataaaaagctataaattgttactcttatacagatataaaaatgaacacattttaaatgttttatttaactcacatgggaaccaggaaaatgttgtaatctattcaaaaaagaatctaaggaacagacacatgtatagactaggaatatgcaaatggcatcaaaatattttccacaaaaaagagtatgaaagtcacttaaaacctctaacagacaagacagaattcataggtatgtcagttacctacaatttacagaatcttaaactgtatcccatagaaccataatcttggcctgccaagaccaagagtgctataaataatacatagttttcctaggaattacaaatcttttctcaaaaatagtaagggcaaaaacctagagaaccataataacactcatttcatcattttcaaatgagtagtgaacagcgtatcttgaacattacaaaagatagaaatcctaaacacaaaaattattatataatacatttgtcagttctttgtgtttatatgcacacacacacacaccttttttttcctagtgtgataattgctttatattttggttattccttttacatcaaacttaatatttcacataatctaatcaattgatctagtcctttgggatgatgtcttgtctttgttctacagatgagacaatcaacttcctatttggattttaaagaaatacgtaagggtttgattaatgatagagttcctgggtagaggaaatgatatttttaaaaaattaattagattatatttttaggaaacattactttattgagatttttacattaagtgataacaatcatattttttttagttttcaaaagagaaaagacttggttgttttctactactattttaagggttagttttttcatcaaagcaatatatatctttatttcatggttcatttttataaaactcgattacaaataatgcgctgtggaatttttcccaaggcaaaagatcaaatatagagaactggccaaatatttatactttgcctctgtgttttcattaatggaatttttattagaacttaatatttgtttatttttgcattttggaaagaagcgtgtctaaatccaaacctttctcttacattacccttttaaaaagccaagtaaatctgagcattcactttcctgctcaaaaccttgcaatcatctcctttactgaagtccaccagcctctgcttgatctgccctatgcagactcatcctccctatctcctcaccccactccttgctttcttcttggcttgcaaacagctgcctcttgctgggttctcccatactggagagaaagagagagcaaggtctctagaattgcctcttatgaggataataatcctatcatgagagtcccactctcaggatcatatataataaatcaaatgactttccaaagtccctaactctacatactaccacattgggaaattaaggcttcaacatatgaattttgagaagactcaagtcagtcaatagcattctgcccctgacaccccaaaattcatgtcctcacatacaaaatacgttcatttcacccaaatacccaaagtattaacttgttccagcagcaactctaaagttcagagtctcatctaaatactatctaaatcagatatgggtgagactcaaagtattactctttcctgagaaaaatttcctttttatatgaacctgtgaagtcagacaaattatatgctttcagaatacaatggtggaacaggtataggataaacatccccattccaaatagaaaaatagaaaagaataaaggggtgggagtcccaaacaagcccaaatcctaacaaggcaaatttaggcctccttcattctgtcttttttactatgttccttttagttcaaaactggcagtgttgctggcataatcctgtctttattcctggactctgctggaatggctgattaacttcatcacagtcattcatgatttctttattaaagttttagccacatctttaatgttctcttcagaacaagctttctctctctctctggtaatatgaataggctgagaattttccaaatcttcaaggtctggttcttttttgcttgacaaattcctgatttaattcctctttcttttttttttttttttttttttttgtattttattataagcagtcaggaggaatcaaattagctgcttcttcaatactttgcttagaaatctcctcagctaattatctagtttcattgttcgtagtccttccttccacaagacactaaaacatagttcagccaaatcccttgctaatttgtaacaagaatcacatttcctccagtttctgatatgtcctcatttccatctgacacatcaccagaattgcccttaacactcatatttttatgtttctttaaaatttgttttaacttcctattatcaccacttaattaatgcccatatttttagtatgcacttcaaattcctacagcctccacccactactgagttccaaagctgcttccacatatgcaggtatttgttacagcagcaccacactcttgttaccaaaatctgtattagtcaaagttccccaaagaaacagtaccaacagataatatagtacaagaaactgactcaagcaattatggagactaagaagttccaagatctgaagttggtatgctggagacccagaagagttaatgttatagttccagtctaaaagccagcagactcaaaacctaaaaagagacaatattgtagcttgagtcagaaagcaggaaaacattaatgtctaacctcagggcagtcaggcaggagaagttctctgttcagcacatgagggtcagccctttttctctatccaggccttcaaatgattggataaggcccacctataatacattagggaggacaattactcagtccactaattcaagtgttaatctcatataaagacatacccacagacacaccaagaatcatgtttgtcaaagtatttgggtacccatgaccctgtcaagttgacacatataattaaccatcacagggagcctagaggtaaagaccttgggtggggggaattatagaaagaggctggagcagatcctacagggccctgaaggacacattaaagaattgggaacttgtcctaaggaaaatgacaacccattggtgatttttaaggaggtaaataaggtaatctgattactattattattttttaaaaggacatgaggaagtttgggttgttgagaggaaaggcagagagaaaggtggtactgtagttagaaattgtggtttgatctcaacttgtcttcatggagaagaaagtggagttccagcttgatccagcttgtcttcattgagaatgggagagttttgaaatatagtgagagattgatttgatatgaggagagaataaaagggagggatcaataatggtggccagtggctagatttagcaaatatatttgtagtgtgtgatttaccacaaatgaagaaagaaggaagttttataggaagaggatgactttagttttaggtttatgaagtttaagtggtgcaggtctgaggtccagaggtgtagtctgggatagacttacatgttgtaacaggccaagatttcctaggtagagaatgtaaaaaatgtagcgataaaggatctgatgaaaaggcacccagtatttgatggatagaggaagggaagccctggaggtaccatcaacttttttttggctcctattgtattcaatatgttgacatttatacaatatctcagaaataacagggtttagaaaacatactgtattagtccgctttcaggctgctgataaaggcatatccaaaagtgggcaatttacaaaagaaagaagtgtaatggacttacagctctgcatggctggagaggcctcacaatcatggcagaaggcaaggaggagcaagtcacatcttaggtggatggcagcaggcagagagagagagcttgtgtagggaaacttccatttttaaaaacatcagacctcgtgagacttattcactatcatgaaaacaatatgtgaaagacccatccctattattcagttatctcccaccagattcctcctataacacatgggaattatgagagctataagatgagatttgagtgaggacacagagccaaaccatatcattcctccccaggcccctcctaaatctcatgccctcacatttcaaaaccaatcatgccttcccaacagtccctcaaagtcttaactcatttcagcactaactcaaaagttcacaatcgaaagtctcatctgagataaggcaagttctttaggcctatgagcctgtaacatcaaaagcaagtttgttacttcatagataaaatggtggtacaggcattgggtaaatacagtcattccaaaagggagaaatcggcccaaaacaaaggggctacaggccccatgcaagtccaaaatctggtggggcagtcaaagctccaaaatgatctttttttactccatgtctcacatccaggtcatgttgatgtaagatgtgggttcccatggtcttaggtagctctgcccctgtggctttgcagagtacagcctccctcatgactgctttcatgggctggtgttgaatgtctgcagcttttctaagtgcacagtacaaactgtcagtggatctatcattctggggtctggaggatggtggcccttttctcacagctccactaggcagtgccccagtaggggctctgtgtggatgttccgacccaacatctccctttcacactgccctagcagagtttctccacgagggccccatccctgcagcaaacttctgcttgggcatccaggtgtttccatacatcttctgaaatctaggcagaggttcccaaaccgcatttcctgacttctgtgcactcacaggcttaacaccacatggaagctgccaaggcttggggcttgcaccctctgaagccacagcctgagctctacattggcccctttcagccgtggctagagcagctgggatgcagggcacaatgtccctagactacacacagcatggggaccctgggcccggcccacaaaaccagtttttcttcctaggcctctgggcctgtgatgggagggactgctgcaaagacctctgacatgccctggaaacattttccccattgtcttggggattaatattcagctccttgttacttattcaaatttctgtagtcagcttgaatttatgctcagaatatggaattttcttttctattgcattgtcagactggctgcaaatttttcagacttttatgctctgcttcccttattaacagcaccccagtcacctcttgaatgctttgctgcttagaaatgtcttccaccagataccctaaatcatctctctcaagttcaaagttccacatatctttaggtcaggggcaaaatgccaccagtctctttgctaaaagaatcaccttttctccagttcccaacaagttccttatctccacccgagaccacctcagccttgatttcattgtccatatcattatcaggattttggttaaagccattcaacaagtctctagggagttccaaactttcccacattttcctgtcttcttctgagccctccaatctgttccaccctctgtctgttaccaagttccaaagttgcttccacattttcagtattttttcagcagcaccccactctactagttccaatttacagtattagtttgttttcatgttgctgataaagacatacctaaggctggtcaatttacaaaagaaagaagtgtaatggacttatagttccacatggctggggagcctcacaatcatggcagaaggcaaggaggagcaaatcatatcttatgtggatggtggcaggcaaaaagagagagcttgtgtagggaaacttaatttttgaagtcatcagatcttatgagacctattcactatcacaagaacagcaggagagagactcgccccaatgatttgatgatctctcaccaggtccctccacaacatgtggcaattatgggagctacaagatgagatttgggtggggacacagatccaaacaatatcacatggtatcatggtgaaaaatgtaatgaaaccatgactacatttgatctttaggtttgcactatgttttaatgagcgtttcaacttttattgcttttatgttgatttttacatctgtctacaaagtgattttttataggcttttggtttttttggctgtagatgtgaaagagaatggtgcattgtgaaagaaaaggttgaacaaaaatcaattcatgtcagaattgattaaaatcaggaaacattttcaatgtcaacaggatatttaggatgagaataattaaatgagctctggaggcaaatgaattattgactacttacaaatatcaggcctaagaagatagagattgagacatatgtcttcttttttttcttagtgaagagaaacagacaaaactcttctaatatgtaacttggtattaaaccattgtgaggaataattaggaaattatcctaacataggaaaaaatatacaattgacacattaaatgtcaattgtaattgacaattgtcaaatgtcaattgtaattgacaattgtcaaatgtcaattgtaattgacaattgtcaaatgtcaattgtaattgacaattgtcaaatgtcaattgtaattgtaattgtcaattgtaattgtaattgtcaactacatgtatatatgtatatatactcctgaaaataatctctctctttaattcttttcagaagcagcttaaagttacatggagaaaattcttaagtagttgatattacaatgtcaacttttgcctattttcagactttgtacttagatactatatgcaaattgcagttttgtatttttcccctgaggattgttctagtgttcccacctgccctatcttcacagctttttttatcccattcctactttatcctttgagacactggtctcattcattcactcatccattcattcatttatatggtaaatattaagcaagagtccctattttcacaaatctgacattgttgaccagggtttctcaaccttggcactactgacaatttggctagataactctttgctgtgggggactgtcctatgtaatgttggatgtttagtgacatccctgttctctacctaatatacgctgatagggcccaaataaatgtctcttgggtggcaaaatcaccctgtgtaaagaaccacagtttgagagagaagaaagacaataaagaaaaataacataacacaatattagtgatgataagtgctgtgaagtaaaatagaaaacgggactgtggtaagagtggcagcaggagcaagggttctaaagctttctcaaggacagcagtctgcatagcgcacagatgtagaagccttgtttctcttttaacagatgtctatcattcactctaaacctgtctatggaattgctaattaaggcaagagcctgatgtattacttacatgattaaattatttctggttcttgactatttacaaaatgtcacagtcacagtaagatttttttgaatatgtcaagtttctcaactgaatagaacattaataacttcaaatggactatcgcatgctattgattttactctcttgtttctgccactggagaacacgaacatcaataaatcacataggccctcagtgggtgattggagggtatatttatttaaaactcttccattaatttttgtttattacattattcaatctatcttatagctggtctgccatttttgtgggtttcagaattgtgaggactcttaatgggaaatgctgtgacactgtgataaatgaaagagcagtggacggtgagtagcacacttgggttctcgttcaggctctgttattgactggctcaaggaccctgggcaaagtacttcacctctgggcagcttctcttaaataaggactagtctaccttcttaatttatttcattgtttttaatgaagaaatgatatagcaaatgtaagataatcttttaaaatgttatattttttctttaaaaaattaggtaattataaggaagatttatatttctcagatattcttgaagttgaggagccacaattgtgactgtttccatcacttgatgtttcttctcctctaacctacttaaaaattgcaggcccctgtgctatcctggtaaatctccctccagtttgccagtatgtgtcatgtttcactgcaaacctcacacaattttctgtaagacatggcctaacccgaaaagtataaggaggctgttaaatctgtggttttggagcagggattttttttttcatgatcatcccccaccctcaaagagcctttatagacattgttttcgtagttgctcacctatgaaatgctaacatcacagatttatcccctgccctccgcagaatcaactttgctctctgggaatgatatggtggagaaagggaaagcgattgcctgagttgagaattcatgtttgactcaaagttaagttggagtctaaattcccagcagctttttggcagatccaacccagtccaaatctgctgtggctgtatagtgtgggacactggctcagctggccggatctggtgttaaatccctgctctctgcactggcttatccttcccaaatactccatgtttctgagtggttctttggctataaaatagcattgtatttcctgttcctgaggttgttgtgaggactaattgaagtaacatataggaaggttgttaacagtgcatggcagatgaaaaacagaaatgttcattattatttatacccaataacagcaatttttaaaaggaaaagggggagaggagaactaatgcttttaagtccacaactgcattctacatttgtgtagtggttattttcactttatttttaagctatgttcagaacgtaacttttgctcttgtttttctttgttaggtttgaccccatgtttaaacatacgtattagtctgttttgtgtttttataaaggaataccttaggctaggtaatttataaagaaaagaggcttctttggttcacagttctgcaggctgtacaagaagcttggctccagccagcctctgcttcttgtgaggacctctggaaactttcaatcatggcagaaaaggaaggggagccggctggcaagaaaggaagcaagagggggtggtgccaggttctttttaacctctagctctcctgttaactaatagagcaagaacttactcattagcatgggtaaagcacgaagccattcatgagggttctgcccactgacccaaacacctcccactagatcccactccaacattagggatcacatttcaccatgagatttttgaggggacaattatccaatctatatcagcctgacatctgcaaatttaattggcttttatgcttctcactcaaggtaaaaaacagaaacaataaacaaataaaatacaaccactactttgaggaggacaaggtcagggaaagccacaagcatgcaagtatgcaactaggaaatttccctgaggacactggttgtcaaccttgactgtataatttggactgaggtatggcctaagtgttggaattttaaataattcaccaaatgattctaatgggaaatagggtcaagaactaccaaatattcaataataaggaatccactcaaatagaccaactattactagagttttcttaagttctctgttgaaatccagatacacttgtctgcagaattcatctgttaggaagaaacttttcctctatgatcttaggttcaaatggttggggtcctgagagttaactgacgatagatagattagcagaataaaagacagtgtttatgtatatgtacattgcaaaccctcaggagtactcagtgatgagtaactcactgaatcctcaaaattaacattttatataccattttaacaaaatgtatttttttaaaagggcatcagtggaaacgtatggaaagtttattgggctttttgatgctaatgagaataggaagcctgtctccatggcagctgaattcacaggaaattccttgcaggggagttaatgggagctatattttcaggacattctgctttaatcagataagggatgttcagataagatttctttttcattttctgtagctcaaatgttttcacttgaaaataatctttatgctaaaccgtgatctctttacatgtgataactcttaaaatgagaaaatgacacacaactacaccaaaaaagcaaataatttaagcatggcattactgagtgctcattatgtcccagttttatttaccagggccaagtaatgtgtccaaagttaacagctaataaatagcaaagctgggagtatgcccaggtttacctgactccaaggtcaacactctgttataccacactgttcttaatatgccctagtggtaacagcctctctttagacttctactgaggttaataagctatcatacaattctgcttaagaagattatcagaatatacttttttctatttttggaaaaagcaaatgtatatctttttaatagtttttagcttcctagcagtgacagtgaaccaggcctggtgtgcctgttacgcagtatgccaatcactaaggtgacaagtttgcagcagagaaagagtttattcatgaggcagccaggtgaggaggtgagaggacaggtctcaaatctgcctcctgaagatgtggtttagggatatttgtgggataaagaatcagggtggactaaggtgtggggtaagatgattgaggtgtcaacaaaaagagtcagactctgtaaaatatttgcagagatttactctgagccaaatatgagtgactgtggcccatgacacagcccttaagaggtcctgagaacacgtcctcaaggtggtcggggtgcagcttggttttatacattttaaggaggcatgagacattaatcaaatacatttaagaaatgcattggtttggtccagaaaggcgggacaatttgaggcaagggcttccaggctatagataaattgaaacattttttagttgacaattggctgagtttgtctaaagacctgggatcaatagaaatgaatatctgggttaagataagtggttgtagagaccaaagttttaccatgcagatgaagcttttagctagcaggtttcaaagagaataggctgtaaaatgttttttatcatacttaaagtctgtgttgatgttaatgccggagaggtataatgaggcatgctagaccccccacttcccatcatggcctaaaaccgtctctcaggttaaattttaagagccctggctgaggacgaagtccattcacatggttgacagggggagattagaattttatttttggtttagagagattaaggaaaagtgaggtaactggcgatctatacgagcatagtcaagcttcgtggctctttacgggaatcatgtttacaaaatggtatttgttagcatgattttagggtggagtttttagtccctggacaacaaaaggtcacctattggacatttacaccagcccaactggagggttagtggtttcaaccagcttgcattggacaagagctgaccaagttcctgaaaaacaacttaaacaatcgttaccatggtgacctacacctcagcgatgttataagaaagttaggaaaagtttagtttatatcgcttagctatgtgacttttagctatataagttttaaaatcaactagaagcaagcagctaaaagcaagccagatgggttaagtttggtgggcctaatcaggtcagcccttgttttaagcagggtttaatccatcttatatgaaaaatttcttaacacgttgggatgcaattcacttctatatggaaacttatttagaccagctaatagctgtcttcctaatgcttctttatcttggcctttagaggcttccttccatagttttttccatagtcttttatctacaccttgttctccttaccacagagaaagtaatcaaaatggagttgtgtggtcttgtattctccttctggtctttaaaaataacatcaaccctcaatttcattcatgataacaagtgccctatgtagtatgtcctatcacttccatattttttcttactttaaaaataattaaaaatttcagatacttaaagcaagtgttaggtagccattatatttgcttaatatgagtattattaatttttaaaaaacgttaataggttttttgggaacaggtggtatttagttaaatgaacaagttctttagtggtgatttctgagattttggtgcatccattacctgagaagtgtacactgtagcaatatgtagtctttttttattttgagatggagtctcactctgttgcccaggctggagtgcagtggcatgatctcggctcactgaaagctccacctcccaggttcacaccattctcctgcttcagcctcctgagtagctgggactataggcgcccgccaccacgcccggctaattttttgtgtttttagtagagacggggtttcaacatgttggccaggatgttctcgatctcctgacctcatgatccgcccgcctcggcctcccaaagttctgggattacagacatgagccgtcgtgcccagccagcaatatgtagtcttttatcccttgccaaccgctatcctttcctctgagtctccaaagtccaatgtgtcattcttatgcctttggctcttcatagcttagctctcacatattagtgagaatatacgatgtttggttttccatttctgagttacttcacttaaaataatggtctccaattccacgattccatccaggttgctatgaatgccattatttcattctttattatggctgagtagtattccatggtgtgtgtgtgtgtgtgtgtgtgcgtgcgcgcatatatatatatatatatatatatatatatatatatcacaatttctttttctttttctttttttttttttttaagatggagtttcactcttgttgcccaggctggagtgcaatggcacgatctcagctcactgcaacctctgcctcctgggttcaagcgattcttctgcctcagcctcccgagtagctgagattacaggcacacaccactatgcctggctaatttttttgtatttttagtagagatggggtttctctatgttggtcaggatggtctcgaactcctgacctcaggtaatccgcccaccttggcctcccaaagtgctgggattacaggcaagagccactgcacctggcccacagtttcttaatccatttgttgattgatgggcatatgggctggttccatatgtttgcaactgcaaattgtgagcactgtttaattctaagcttccttgtaggtaaggcaaaaagcaagcaaagtattttaggcaattcccataactaaagggaaattatttattatatttgtccatttgaaaagatattttttcatgttgtaaaaaatttattaaatgaatgctaacataaggattaataaacaacatgatcttaacattcttcatggagtaatttagtttttttcaatttttgataaaaagctgaaggtatatcaacttgttattcagtgaaaggataactattggtagcgaaatataaacctgatctagatttggagatcaaaattttggatttatacactttagggaatatatcagaatgaataaccttcacatcacattgagtactctatgaagaatcagttacatgggctggacttttgatcagaccctcatagaaaacagctgagcatgatgggcctggcattctattgatgattaccaatacagtcatgtattgcttaaaaagcacctggccaagttatacatattataaaggctttttggtattctcgttgagatggattgagaaatattttatatatattttttgagaaacgttttatgtatgaataatagatgggcaatatgaaatcacagtataaaatttagttttctttcaactagtctcaaaatttcatgcccattacaaaattaaaactaagaaaaaaaattagccatgtttattttttctttttctgttgtcagtgttcttttaacaccttagctcttcagggtgctctccctgcagctatatttttagatgtttcccagtttctctcctcatcaggatcatttaatattgtaacacttcaatttttaaataactccattttaatattttgtgattgagctatttcaccatatgagaatcttaggtctttctgttttctgaaagttttgaaatatgacttaaagcttgaactaaatgtatggttatatcccacaattctcgtctcctaaccacccttccccaagattattcagaatgtcaagataacaaattatatttcgcggagtctcatcattccaacttcaccacgagtttttccttattgacccaaagtaactttactgctttctctgttgtctgaggcattaaattgccagccagctaggcaagtgaagaaattaatttatttagttgaataataattctaggagaattgagtactgttttttctgtctcctttctatcatttgtctaactaatctctctagcatttggtggtataaatacagaatagtcatctattttaatcatctaaccaggtagtgtatatcatcctcacaaatagtgcaacttagattccagtcttattgttaacatcctgctaccttcaaatattttatttatttattgagacagagtcttactttttgcccaggctggagtgcagtggcatgatctcggctcactgcaacctctgcctcctgggttcaattgattcttctgcctcagcctcctgagtagctgggataacaggcatgttccaccatgcctggctaatttttgtatttttagtagaggcagggtttcaccatgttggccaggctggtcttgaactcctgacctcaactaatcagctcacctcagcctcccaaagtgctgggattacaggagttagccactgcgcctggcctaccttcaaatttttgtctcagtggataagacagattttgttacccattttcttcttcaaattgacttgtttgttctattaagatatacattttcacttccactttctaatattgaatccctcagtttccctttgtaaatacatatgtgcatatgtgtatgcacacacacacacatatatactcccaaacacacccatatattctttattgtaataccccgcttgttgatatatagttatgggaggacaaaggtattttctgtaatatggttgtgttctcctatgaatgctttgggaaattccctaatgtttttctatctgtgtcatatctattatatttttataacccttgttaacattttaatattatttttattttcccataaattttatgtttaaatcttctgaattagatcagcagttcaccagagaaataagtcttccgtgtccctttgaaaatactttctaagtcacaaatccccaccaagtttggtatcttaaatcatgattctgccaccatctatataaccagctgctcagcatttttcctttcctaaatcacacattgaatgggaggaagaattttaacacttggaaccctttaaaggaaccctttagctttctgcctaggatgtcatgaattctaaaaatggtttgcatgtgtattatgatggcatcattcatacccacatgaatcagcaggcatggatagttgtcagcaggtgtgataaggcttggcagtttttccattatgtcctggatacatgctgcagaaaggcaatggcttttctgtttggccatgtcaagtctacataaaatttactcattctccttggtgaatgactagctttgttcaattagatagccttcattcttttctgaaaataaactgttatttcatcctaagtaattaatatctgaatttttgtatgttttggaatttctatgttttatatctgtaataaaattaagatatatgtacatcttaatttattgagtcaatattaatatatttctgaaataattcaaagattaatagcactattttataacaacattatagacaatattggtagatgcatcattcattgttatttggatgacttaaattatatcagaattactaaataagaattaaatattgataaaaatagagggaaagagtatcccatactgtgccatctttgaggtcacagctcatgaaagagagaaaactgcaaaacagactttatctttgggtattatttcacaacaatcttatcttactttgttctgtggttggcaggccgtgtgctatagaggccaacagccagagtctctgcaggaggatttcaaatagtgccaaatcagaaagagatagcagccaaagggaactgacattgcaattgctagaatttctcctgaaaatgttcatattttaggtaaaaataagcaaaattatgttactgcagtcactaccatgtaaaacaaggggcaatcttggttgggttaagttataacatgatgttaaaaatggaaagtacatatctgaaagatattcatgcagtcaaattaataaaaatgtcagaataagctatttcttattctggaggttgttagaaatgaagtagactaagatgcattctctgttagggaaagtcatgaaatacagtcataatttggttctataattcctttcatcaatttagcacaaaacagataattaaataaaaattatttagtagtgataaaatttgtattctgggagttaatcatccttgttaaattaaaggacaaattaatgttgggaaattctgggacagctaaaagacattaaaaaggacattaagtatattaattaaaccatatcaaattgccattttttggtaaaaaatggttgatatttataattacatatggttcaatttaggtagtatttaattcattatttacattataaatatttatataaatttatctttttccaccagactctgagtcctgctagtgcaggcttattgatttatgtatcaccagtatatatcacagtatctgatactctacagctgttgaaaaaatgttgaataagaaactgagactattcgccaggacaattgtctccagcagtttgattgactatcactcaaaatatatgtacatgtattgacttacaaattatgttctgattcattatacatgttacatcataaaacatatatatacatatattaaacatttttaaagataattttattttgtctaggaagaagacattggcttagaaaaactccaacattttagcctgacagtaaatactaaatttgcaattgcttggaaagaacaagtgcagtaatttaaatctggcttttcatctttcttattttaaaggaattgaattagggcaaagaaaaggaactaacttttattaagcacctggaataagaaaacaaatttatgtacattattaaatttacacttaacaaaggaagtattattttatttatatattgatttattttttgagacagagtctgcctctgtcacccaggttgaagtgcagtggtgcgatctcggctcactgcaacctctgccttctgggttcaagcgattctccggcctcagcctcccgagtaactgggattacaagtgcccaccactatgcctagataatttttgtatttttaatagacacaagatttcaccatgttggccaggctggtcttgaactcctgaccttgagtgatccatctgtctcggccccccagattgatggaattacaggcatgaaccaccacgcctggccagaagtattatttttgctaagcagaatttaaagctgaaaatctgagaagttagataaattgtccacagccattatccagttcctagttccagagcctggcctaaaacctggtctgaggtctggtaataaagcctgacatgtgcgtttccttcctaaaaatgatgatagtagtctatcaatgagggttaaaaaatggacatttttcataaatttatgcattttacttctgtatgacctgtatggagaaaagtgattttctctttttggtaaataagcaagactcctaaatcaaggcaactattcaatatttctaacttcttggtttcttttaatagcaacagcagtagcaacacaagctaactattgcttactgaaaacttgtgtgtgccagtttctttttttttttttttttttttttgtgtgagacagggtcttactctgatgcccaggctggagttcagtggctcaatctcggctcacctcaacctccgcctcccaggttcaactgattctcctgcctcagcctcccaagtagctgggattacagatgttcgccaccatgcctggctaatttttacttttttttggtagggacagggtttcaccatgttggccaggctggtcttgaattcctgaccttgagtgatccttctgcctaggcctcccaaggtgctaggattataggcatgagccactgcacccagcagtgtgtgccagtttctatgataaatatcgtacctaaagttgcctcatgtagccttcataattacccggttgaggtattatttttaccattttgctcttgtgaatactgaggcttaaagggaccaagttggccagtgttacacagaaggtaagtgacagggctaggatttgaacataagtttcttagactccaaagtcccttctctgtaatcacaataaatactgctgcccttctgaagagccagattttgtgatgtgtccatgatgcttcctttattttacccttctcaccgaggcccagataaatgtgtttgaaaaccattcaatcatactcattgggaatagtaaggtaaataaaagcatcaaaccttgtagaggaatcctttgtcctctcagtggcatagctagtatttcttccatggctagctgattaatggcagacaaagcagcatgcctattgcacatatctatagcacaagctatagtaacaagacttatcaatatctcaatgctatagcaagaaaaagcattcagggagaattatgcaattatttttctgtagtttctgactccttgatttgggaaagttagtagctgaatgctcagagagagagagaaagagaagggttgtaactatatagagggttaggttaagccttgtggattagctgcagttggacaggagcttggtagaggaataatagactttccatgttctttcattcaggcccactggctatttcattcaccgctttttaacttacatttcatgacttttctagaattaacagggcaaatggttcaaaatactgccagttaatttgtagataattttaaattctctcatcattgtgagatattgtggtacagtgaaaaaagtactatattttgaagcaaaacattgagaccctcttttaccatgtactaactgtaaatttgtaaggtcacctctattttctaaatttcttttttcttatttatgtatctatttcttctaaattttttgtagagatgggggtcccactatgttatccaggctggtctcaaacttgcgggctcaagtgattctctcaccttggcttccaaaagtgctgggatttcaggcatgagccaccacacctagctattttctaaatttcttttttttttatttttactttttattatggggaattttaaatatgtacaaaagtagacacaatagtaataacaaaccctcatgtattctacctagtttcaaaaattatgaactcactatggcatcttatttctttgtccttctcactttacttttccattttatatcatagtaaatccgagacatcacatcattttattgatacatattatgttttgtattactaaaaatatgggctttaaaaaccatatataaccaaaataccagaatactacctaaaataaactaataactttttaacatcatcaaatatacaatgatctaatttccaattgccttacaaacttcattttttcccccctaccattgggtttttggaatagggattcaaataaagtccatccattacaataggttgacattattttaccatctggattttgctgattgcaaccccatgataatcttcaacatgttcatctgtcctctatattttctgtaaattggtggttggttctagaggcttaatcacacttaacgttggatatgtttgtttgttctcgtgcaaaattacttcatagatgatactgtcttcttccctcagaaggttgttaatgtttgtgtctcttgtgatgttaggaaccagtgatgatcactatctagctttattaattcattaggggctaaatgaggagattctatttctttcactttctcctcacttattagctggaatatttctaaaagaaaaaccttccctatgtactatttagtttcccattcatacaatttcatgtagaaaagaaaaaaataaatgcttattttcctttatttaccacttttcaaaatgataaattggttctttatcatcttacaacaccttatatgttaatttttgtatcattacaaactataaataaatatatttattgtgcttcaattcttttccatgattgttctttttgagttttaattattttattttggtcattgtgaacctcctcaacgagcctcaaaataattttgactctgacctgtttctcattgatagtgtcttttgttgagtattaacacgattttccagaattatcttgtatatatttttgccccagccctaaattagcagtttatcaaagtagcttggtttctttcggtgggaattgttacatcaaaactgtaatacaggcactgtggtactcattgctttcgacttagtcacagttcataggcttctctgtagacaaagctggaaaatattttatttcatttcattttaaattataaaacccattaagagtttattttgataattccaactcaaatttagaactacaataatttaatcttctattttatgtctgtatctcctttccctgacagtgaaaaatctaggtttttagtgataacagaagtggtagaattagaatattatgtagtcatttgcgttattccaaaaacaaacataagagtctcagaataccaatactaacatgaacatatgttgtaactgtaataaatatgagcaataatattgcatatgtaagagtacacagtaaattcaaagctttgtacaaagttaagtagttttaaaatatcatcctgaaaatactgtagatgtatttccacaaatctccgaaagagaaaatattgttagacgtatgatacaaactgacaaaagaacttatattagaaggtaaactttgaattattggtctgcaatatggtaaaactgaatattttaaatcaagacaaaataagacgggctgggcgcggtggctcacgcttgtaatcccagcactttgggaggccgaggcgggaggatcacgaggtcaggaaatcgagaccacggtgaaacccagtctctactaaaaatacaaaaaattagcctggcgtggtggcgggcgcctgtagtcccagctacttggagaggctgaggcaggagaatggcgtgaacctgggaggcggagcttgcagtaagccgagatcttgccactgcactccagcctgggcggcagagcgagactccgtctcaaaaaaaaaaaaaaaaaaaagaaaataacacgatcaccatgtccaacttccaaaacacttttgctgcaatattcctatgaatataataagatttcctaagaagcaagggcattttaaaggaagaaatcattttgttctttcttaagatctagaatttaaactcacaatataatctgatgcattgtaagttatggagagtatgaagtctttgtggggaaaatgaactagatacgtaattatgaatacaatccatgaaaggtaactaactgtttccagatatacttaagaacactcattttatttctatgtctttacttttaaaggactctttgaacatcaataattactaaccagttaggttttatattaatattaatatgacaaaaaaagaaaaaaaaggaacagaatattagtgaaaatgtgggtcttctatttttgctgcatgataattgatagttttccaacatattaataaggcattgctggggttttctactgtgtatagtaatataaaatatttgtagcatagaatatattaaaataatagtacaaataaaatcaattgaaatacagtcttatgttactggatacaataatttgttaattaaaattatattaatttttaagactgttccacatattacatttaaaacttttaattaatgtttttgaattaattgaagctatccaatattgtaatttacatagatttagctatgggatgaagtataaagataaattactttttttaataaaaatggaagaaaatatccaattaatagttgctggagaagaaatatcacaatatttcttagataacttcttctcctataagtatatagtattgattacataaaatttatgttggtaaagtgattgatttatcttcttttattatgtattttcagaattcaagacttagttgtaaaagtattcatatgatgtaattagcttttacaaatgttaaacacaatcttattccaaaaggtatcttaatttgtatcaaagtaaatctcttttgaaaggcaatatgtgcctgagatatgtttgtgcataattagattgttctatctcaaagttgcttaaggaaacaaagctattatgttgtaggagacagtaaaatgatttaggatatgggttctggattctagttcagattttctgtcttacgtagctgtctgatttggggcatttcaattatctacttaatattttgtaagtgtttaccctacagtagacctatgctaaccaatcataatgtaaatgtaaccaaaagagctataatccttttccccacagaacattcagtctcacgagggaaatagacacacatgcaattactatccataaaatgtgatgagtgctatgtgaaggaggacagggtactaggttagcacatagctgaggctccttactcaaatcctggatgatcagggaggtgcagcctatgctaactaggaactggattatgggaacgagggatgagtgatccagatagcagaaacgatatgtgcaatggctcagaggtaagaaaacctggctcctgtgaggaaatgaaatgttactcggtatggatggatcatgggaatcagaggagtaagggatagcggaatgtaaacaaagacagatgaaaagaggctggactatgaagggcctcataatccacatgggagaatatgaacttgatcctttcagcgatgtaggcactcttgaagccttttaaaattaactctgcttgaattgtggccaatggccgacaccaacaggttgatcctgaaagcaaggaacaagaagaaaagacatgaaaacaagtcacttaaactcactgtcccttatgacaggattagcataaatcatttcttttcttttttctttttggtttttttttttttttttttttttgagacggagtcttgctctgtcatccagtctggagtgcagtggcacgatctcgactcactgcaagctccgcttcccgggttcacgccattctcctgcatcagcctcccgagtggctgggactacaggcgcccgccaccacgcccagctgattttttgtatttttagtagagatggggtttcaccatgttaagccaggatggtcttgatctcctgaccttgtgatccgcctgcctcggcctcccaaagtgctgggattataggcatgagccaccgtgcccggccgcataaatcatttctaaattcactcctagccatattatatgagttcaaaatcttttctacctagtctagactctagagagttttcgagaagatttttcctcatggagatataatgggagaaaatgagttccatcttccagataaactagtgtgttatctgccttagctcgtcagatacatgagaaatcagaccacacactaataaaaacctaatttaaaagtgtatctactaagtgtgtatgataagtttttgacatttggaacagagcagtatcagatgcagcactatagtaacattaatacaatatgacaaagtggtaactaaatattgtgaaatatattattctcttacagatgtgtctagtttattgacagaactgatttatatagtgcatttcatcctaggaaagcaattttatgaaacattattataatggaaattgtgttttttcaattagttgttgaacgccaagactttaactcctgggggaaaatgtttataaggaatactttctgttaagagtgggcatgtgggcacttcattagaaaggttttatactagaggacttttataggtggtataaaactccctcccccccaggttttgtgttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcttatctacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgctctctgaaaataatttctttaaatgaccatttgaaattaaaaataagatttatttttggtgttgaattaactgcaaatacaagagtactacaacttcttagacaagtaggctttaatgtactagtttaaaatacagagttgtcttgtctgccagtcaatatttatgaatttattcaattttcatgaagtttgataaaaaatttggcattttttgctattgcacttactaagaattaatcctcacacttcctaaatcaaatggatattcttaaaagcaaagacatcttattagatatgcatttaattttgaaaagcgaccttctgaaacttgtaagtaattactttgtaaaaactctagtggttgagattcacgttccagaaaaatcttgctttaaatagctttaaatgggacatatatggttagcatggaatgagaaaagaaaatatatgccctctcattgatattatattattggattattatgctttgtggcctttgaactggtgaatattagagccacttgttacattatctatcaaaagaaaaatatttttaaacatgaggattggggtttaggcaaccattttacaaataaatcaattaatatttatacagtacctaatgtatttaaatttttaagttcagtttaaatttaaaagttcagttcttcatggaaaacaatatagtaaggaagaaaaatcatgaatatgttaaattattaaaatgtaaacaaaattggacaattatacatagtgataataataactatgttttcctggatgtttagtctagtgaagcactctacatgcattatttcatttaaaagtttacagtgggaatacatttaacttcttttctcaacatgcagatgagataaatacaattatcattctatttcatagattggtatactgaggttcaaaggggatgagcgattcgcctaaggacatagagtccagcttcaaacaataaagtctggcttcctacatgagtaatttcacaaactgagttactaaggcctctctttcataaatccaggcatggagatcctgtgttaatggaattgagatccttccaggtacagtttgaaaagtctaccctagtggtctgcaaatggaaaataacattttcttcatttcttttaaaaaagcaatttctctaatgttttgtcttttacttacttcagtctgtccattttagtagtttttttctgcttagaattgatatctgaattataaatgctagctttatttttggcattaagaaataatcacaactgggtgcaatggcacaagcctacaataccagcactttgggaggctgaggcaggaagattgcttgagtccaggaattttgagaccagcatggacaacatggtgaaatcccaactttacaaaaaatactagcctggtgtgatggtgagcacctctagtcccagctacttgggaggctgaggtgggagggttgcttgagcctgggagagggaggttgcattgagccaagattgtaccactgcactctagcctgggcaacagaatgaggccctgccttaaaataaattaaaaattaaataaataaatgaatgaaggtaggttgagtataaagtatagtgtataaatgatgagttaaagcattttaatatttttttcagtgtatttcagtacttatcttgctataactaagccagaatgcatgatgtggggattattatccatttgatatattatcctccttaaaatatagtttatgtaattcaaagcatatgtggattattaagtgcacattgtttatagttaaataacttgctggtgttcatccattgctccctgttggaagatactccaatgttgaaagcaaaatctctgctgtttgtttaattgtgccccagggtacagttgggaatgtgtctatgagtgaaagaacaccagttttaataagaatacaatgtaatttaacagttcataaaacagtaaaatttaatcctgaactgagagatttattaaatttcactcagcagaatagagcatgggatataagagcaagtgagaattaagtgaaatgatttcaggggtaatagattttattacgtgataaactgggggaatcattctttttttgaaaagctatttattcttaattcattctttggaaataattgtcttacataggaaagctttttggagacaaaataaataaacttgaaactattaaaagcttttgtttaactttatttgtttaatttcaaaagagtaaaactatactactaaaatcatatcaccattatggctaaaatattttaaactgtaagtgaaagtattttgcattcagggaaaaaggaccagtcttctttttgtaatattcatttaaagtcctcccaaactaaatgatgcttgacaacatgctgtctcagagagtttcatttttgcatatcaagtagcatattaaaaaattcttaggcatattctctgcatctgtaatgattgattccattggagctttacctaaaatgggaaatattttaaaatttattttgtttttccctttcttttaaattatgtaaagaagtattaaacagtttgaacatgctattgaagattataatgagttacattagtaaaattttctcaactgtaagacctacaattgctattttttattttcctttttttgtaggggttgtaaaacaattttctgagtaaaagaaggaggctcccccaaagctagatgtctctttatttgcataacaaaacagcagcaactattgagtgtatagagatttagctgtgttttaatacacattgtatctattgagcttcattacacctagtggagaaagtagggcagatattattgcacctactttataccttggacaaatgaggtttggagaggttactgtttaccaggggacatatggctgttaagtgcagaacagattcagcaatggtcatttgagttcaagtcataaagacaccattaaggccctttgttgtgtattaaccagccaacatttaatattagtttttaatgatataaataattttattacagtcacaattgtgtttgtaattattcaaaatccatgaataatttcaataattgactgttttaaaataagattttaaaaaataaaaaaaggtttctttaataatcactagctagataaatgcagcattttattttttttatttttttatttatttttatttttatttttttttgagacggagtctcgctctgtcgcccaggccggactgcggactgcagtggcgcaatctcggctcacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagcattttattttttaaacaaaaatatgtatatgtaaaatgtttaacattgttgagtgatgaaatacctgtgaaagtttttataaactacctaaatatgaattcagtgatatttaattaaatgactgtgagattatggaattaaatatatatatttaattatatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattaattatatataattatatataattatatataattatatttaattatatgtttaattatatataattatatataattatatgtttaattatatataattatatatttaattatatataattatatataattatatatttaattatatttaattatataattatatatttaattatatataattatatataaatcaaggttaacacaaactatgcctcttaagctgtgtactattttatgttgagatttttgcttatcaagtacaatctatgaaaagttaacactgtcatacaaaattaatttttcatctcttgactttgacagctatgttttatatcatctacacagtgtctgtctcatatgagatacttaatacatgttaaatagtaataagaatcaaatgtcagctcttagttgatggacatgacatgaagtctcagtgattcttcagaaatgaatctgaacagaactatccaaagacagttaaatggttcaaagaactctaatattgagtgtcctcttttgactccatctagaaagatcatagcattcagggagaagaggactgctggatcacacattagtcttttcaagcatacctgtacacagaaatagtctctagggccactatctttgaattccatggctacaaatggaaacaatgtgaattgctgggtggcctttgtggtatgtctggtgctgagcaataataaaggaaaatgaagggaaagcaagaacacttaagtctgtgtgactctaatgatttttagtcatttcttctttttttttccccatgcagctattttaagttaatacaggttcccctaaaggcaaatataactgactcattaggaaatcagttgggaaaacaatattttgcaattgtggccccaccccttcatttctccagagctcatgatagcacacatgctctatctctgttggctatatttttagctttcccacattattttgcaatattcctttccagactaaaaaattaacaaaactccacactgaagcaacaaatcactatcttacacaataattcactaaaataggaccttaaggtattttgcctttcttcaaactcagactgaaagcttttctggtcacgatttttcaaggttatacttttataacaaaaccagatgcaaagattttacctaatcagattttacaataatgcccccatttccctccctccctccctccctcccttcctttcttccttccttccttcttttcttttcttcctttgtttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcctttccttccttcctcccttcctttccttcctccctcccttcctcttcctctgtctctgtctctgtctctctctctctctcttctttctcagacagggtgtcactctgttgcccaggctagagtagagtggcactatcataactcattgcagcctcaaactcctgtgctcgaatgatcctcccatctcagcctcccaagtagctgggactacaggtgggcatcatgaagcctggctaatttttttattttattattttttttaaagacagggtcttgctatgctgcccaagttggtttcaaacaatcctgcctgagcctcccaaaatgctgggttttgctttcctgacaccggtatctcctggttcaaataatcctgcctgagcctccccaagtgcagggattacacgtgtgagccaccatccagccccaatttctttctttcttttttaaaattaggttcttcctaattacttctgaatgacagtgaatgacttaggctcttaatttgcctttgaatccaggtattcagggtgacaagaccaacatttgcctggtctagtttgataaatgactctgtctaaaatggtgtcattaagtacgtgccttgacaggatttgaagtttttttctaattcaagatgctaattacagctttcttgtccagttaatattcagctaaaaagtacacatgtcaggcaggtcagtttcagatacccatgaggttaatctagaagcaaactaaagtgaccatcaaagtataatattttcagtacattttggatttttaaaaatgtatttgttttgctgagacacttctttgtgactgaatcatcagacttaagagctggcttttgattgtagatctcctagagtcagcccagacagactcaacagcaggtatagattccagggctgtctacaagaggccacagtgccaggacaaatcatgctgggcgttccttggagacgctcatgtacaaatgaaataatgtttcaaagaacatcaaggccatcctccagaggaacaagaaatgacaaaaggacaatgtacagattgagggtcttggcagaaaatcaaagtggctgtccctactgctttgatttgatgacaatgtggtaagaacattcgagtagcaggatttgtttttaacaactgagtgatttcctgggtgccaaagctctgggtcagtgtaatgtcctaatttattcaatcctgaaaaccactctgaatgtgaggtttctagaaatggcatataagtcttatttagtcactctttgttagttgctgatatctgattaaacaacacaaattaactagctgtttgaatgtgttatgaatgtctatgtctcccagaagacacacatttcttgtctgatttttcttactatgtggaagttagcatcttattcaatttattagccaatcaaaatcatctgtattttctactaaaatcaatccccttttgaattcatctcatgccattaaataagtaaccaggggaaattcttcttctttgttcactcaaggtttaagaaatttggccagatgaaatagtataaatcttttatgaaaaataacatattcctgttaattcatctaaacttagttgaaatttaaaatatgttagatatttttctggactagtttcataggtgtgtgatctatatagtcacatgggaccttatttaattcttaatattatttggaaaagaggccatgcgtttttttgtttttttgtttttttttcctgggccctgcaaattatgaagccagccttgtttgcttccagtatttaaatagtaccggtgtttgcacaaataagtctaagaacaaaaaccacttgaatgtattatctgatttgacaagaaaagagataaacgtttgtccttaaggaaggtgatcccaagatcagaaacttaaataaggttttaaatcctgtattttggcttccctgacaccagtatctcctggttctctgtattcactgtctctctctctcatgcttctcttccttcatcacttatatgtcagagaatctcagggctatcttctctcaatttacctttattcctgagtgtcatttgctcttgtggttccaatccttctcataaatttatgatttccaaatttataacccaggtccatacctctcctttgagccatgaactcatgtaccagacgcctccacttgcaagtttggaaactcaatatcatcttccgtgacatcttcctgaaacctcttgattactgatggggatacagcagtcaaatgaagtctctatacacatagagattatgttttagaagagggaaaagataaccagcactctgtgtgtgtgtatgtgtgagagagagagagatgagaaagtgaaaagtgctctgaagaaaagcaaggtgagagaatgaagaaatatgtgaaagtgtatttctaatagcatttatctgcattactttttatctcagtgaatattatgaccatcttccctttggcccaaacactaataaacctgggagttattgtagcctcccttctcttcattatcatcattgttattattttaaagttgaggtctcaccctgttacccaggctgaagtcactaggattatttttaatgagtttcctgaaggatctcctgcctctagtattataccaatgtgtctgtcattctccccactcaggaagtgctctttcctaaaagtaaatctgatcatttctgtcctctgaaaacactttaatatcttccactcatcctacagataaaatctacgctcctagccatggctgacgaaatcttcatttttctgtgtgtgtgtgtgttttgttgttaattattacttattaccttctccagcctcatccattatcactgcaaatccacaccttcactggtgcttcatctatgaggaacatttttcagcttctcaacactgtcttgttgtctctcatttctgagctgtcacatctttctccttctccacctaactcttagacttctttagtgtcaacatcactttcttctgaaagccttctctgagtcccccaagttaatttcagttagtgttttttgtatgtgcatgctatagcaccctgttcctcatttcagttttagcatttattcaccttaatttgtactgcatcttcaattgcctacattttactgggcgtgaactccataaaggcagaccctacatatatcttgcttatgtttatctctctagcattagcttagtgcctagcatagggcagctgagtactgaatgcgtgtgtgcttttttaatgtgtgtttcactctgaattccttctgaatctaaatgacattatgtatatgttaatgtagtaatatataaataacaatgataatggctattggacacatcatttttttttctaggaagaatagtggaatgattcaattatttcagattgcatttcagctttggagactgcatttattttgcaaaagctacttgtgttagtcccaaaattaatctgcctagcctggaggcaggtacctgctatgctgtctggagaagtcacatgaaaatagtcaagatatttttttccttcaaggagtgttttcttatgaaaccaatgcctctctctccctctccacgaagcggaaattaattttataactggtattcttgaaagtctgtataaatggaaggcactattttaaagtagggtttcatctgagtgcatgtgattaaaactactcttcatctagaaattagaaacatggcagatagcaaatttggattttcttatacatctacttaaacttaatttctccaaaaaagctatgagtcatttatttttgtggaatcctttttttattgtatcacaaagcctaaatttaaaaaatgttgcatatgagtttaatatcattaacatttaaactgttcttgattaaagtatgttaaaatgtctttgttttgcaagatgcattaattagaataaggatccaaacatcaagctaaagcattctctaatttgaagagattattttaagaaaatgatgaacaaagtccagcatcattggaacatatttgcctgatatattttatgcacttattccacttatgtttataataactattcggtatgtttgggcttttgttcaggttgcttttagagcaacctgaaaaaaaaaattgtaatatttactagaattttgtttaaagtgaagtagctatattattaagtgtatgtttctaatcatgacctcaatttttaaagaatcttgtgtttaaagatttaataattgaggatataaaaatgatatcctgaagagttcctgaaatatttgaagcattaaagtaatgtttgatataaatgagcacctgttgaagttctatagtattcaattggaagaataatatcttctacacttacctcaaattcttttttatgataaagttggatataaaacctaaaacaactattctagtttacaacatctagtcatgacagataattgtcaaactgtgttttagtttactacagcatgtctttatggccaaatgacttctgggagtgttgtcctctgaagttgagcttcctactcacaactctgctcaagacagaaagaaagcatattagtcctgttccaaatgagccccattcttagcaagtgctgctgtaatttaatttaggtttgggccttcacttgcaggaaatagacatgatgttaattaacagaacaatgcttgtggaaaagctttatgatactacttgattaaccacattccttttgatgttcatttttggaaaataattgtttatgtctcctgacacagtagataagatggcatgcatggctggtgtttgtaggtgtccaaagggattgtctttagactgatgtggcttttaggcaattctttttatgtaacctagcaatcttggtgcctaactcctacttctggttgactttacatatgaaaagaggggaaatttgtaaacttctgagaaattagaagtaactcaggtaaacattgaatactatctagaattcagaagaaataactgctacttttaattgaaattttaatttgcttttggtccattaattctgcggtttatcagcacaatacttttataattcttacatatcaatcatgagtaaaattgtgctttagttatttaattttcttccaaacagtaatcaattcacctttttttctccttaagagagtattcttctcacagaatgtagaaatataaaaaagaaaggtaaacttttctgtaatcccattaccattataaacattttggatttattatgatctctctttctttctttatgtatttatggagatagatggataagatatacttaatatgacagtcataagctatattttgttttacacctaaataatgtacattttaagaatatgcatagttgaaatacatttatttgttaaaataatgaggtatatctattaattctaacttggaaaaatatattcttagatttttttaaagcaaattattgtatatttgacttttgattaaaataataaaaataaacacaatatgtgtgtgactgggtctatgtaggcccacactgttgagaataattacctctgaggaagtcaggagcatgggtggtgggatctgaaatgttttactagatataattctgtactattacaatgcattataataggaatatattattttatgagtatggaaatgttaacatccatccttatgtcataaatataggtctagataattattttatttttatttttatttttttttgaaacagggtctgcctctgtcacccaggccggagtgcagtggtgcaatctcagctcactgttaacttgtaccacacaggctcaagtgatcctcacacctcagccttccaagtagctgggaccacaggcatgcgctaccatgcctggctaatttttgtatttttagtagaaatggggttttaccatgttgctctggctagtctcaaactcctgggctcaagtgatctacccatcttggcctcccaaagtgctgggattacaggcatgagccactacactcaccctgtataattttaatagtgttatttatttatagaaacacaacataaattgcttaaccttgttgagaaacattaaggctgctgcattttcaagtaatataagccatgttgtcatgcacacatctgtaaatgcatccatgtacatttttccttttttgttccatggaataagtttctcaagtcaaactacaatgtcccaactggtgtttgacatgcattttcagactgttctccccagtgatattaccacctttttctagcacctaatcatagctgctagcacatcattattcatctgtgtctggtgagcaaattatggtttctctcacctagaaatgttatggattctctctcacctctagatgaggaaagtaaatttttatcatcaagagaggacatagaatgaaagctgtcttccataatctttgtttcataatgcacattgtattatgttaatatgagggacactgaactctaaaatagatgcctaaatcatattgtttaggcacacagctatatatcacagtaatttctattatctaaacctcatggtttagatagaaaaaacccacaatctttggaatttaatagcctgggtttagattttaggtgtgcccattactcagtgctttgagccttggctccttggcatgtattgtttatatcatgagattgttaaagaaaattaagttaaataatatcttaaagtgcctactgcagtgccatgtggtaggtattatagaaagtaaccttgtggctaaataacttctttgtgaaatatttactatttttctgatttaaaaaaagacagattatcatttaggatatatagttaaaaactgacctaagaggctaaaattatagctgatatgcttattattgctctgatttttttatatctgtactaaacttcatgcttttaacttttggttaagggtattccttctggtttggttaatttcaaaagtataagaaaataaaagtaaactttaatcttctaccttgcatgatggatatgtgtaatatctttgtactgttttccttggaaaaaaaagtagatacaaatgcccaagtatacagtatgttgaattttgctcaccatttgacataaatgaaagtatctttgtagtaatttttctttcaaaatgcaatagaatgtgtatattcattgggtagcctttaagaggtcagaaagaaaagacactaaaggatatacaattgcagaagagggaagtggaggagtttagagtcaggaatgcagaggaagagaagaaatattatctgatgctgtgaaccctggaaatacagaagtctactcaatagttaagagccctttgctgagcttcattggacatactcaggtgctatgatagctatttgagtaaatgtatgctttataggagtctcttctcctggattctcaaatctagcccacaagataaactcaaggttaagattaaacaaattatgagtatctttttgagtttctttctaaataaatgtatatacttgtttgttccaaataacgaggaaagaatattttatgctatagcctgtcaacctaagtaacagtgagagaggccctctaaaagaaaaggtatttatttgaaaataaagcattgtaatgggaatatgcacgtcaaagtaaactatgcacatagttagggaggtaaaggaagacagaggttttcaaagagaaaaagcaggaagattatataattcttctgaaataattacctttggctacagagaccaataacaaggttatcgccagtccgaggttagacaggcagttgctgggcaaatgcccttgtagaaatatgtttttgtgtaaggttctgatggcctttgtgcaagattgtggattttgtatttttttgttatcagacatacaagaatggtaaccttctctttacagtgttctctggttctgccagggctttttgtttgttcattttttaacattagtgactcatttgattttgacacctttcacaagtctatcgttactgccttgttttttctgaaatgtcttttttgttttttctagtgatgattcttatgcttttaaaaacatttctaacatcctcctgttgcttatttatctgtggagttgctgttcattctggttttcctctgagtccttgcccatacgtcaccaccctgtcttaccttggctgcagctgttgctagtcatcagatgaagcaggtgaaggttatcaaactgttatttttcctgagtaaagtgtcatcacctcacctactgctctttgtcttctttgaattaatttcctaaatggcatacgattcagtgcaaaaaaattgttgttgtaatgaaagtcttttatgtcctggttggtgatttataattggtttcatcaagtataaaactcagaagtataaatgtcaagagttaactgatacagcttaattggtcatttccaattttgatgtcagtctattgacctaccggctaaaagggcattgtagagtattagttggcatttgtttttggagtcctttatgatttctttcttattagtgttcacagcagtgtaccattaaagtttttggcttcagtacacattctgattattcctgaacctgcatagtcacaataggaagggtagtgttgattcaaacaaaattcagatccatgtatttttggcaggtatagtgtgttcttctgcaccaactcacatattccattttgtgcctttacaaaactataggaatagtttagtgattgcctaaaattttcctagtaaattgaatgtttttctacaaaaatgtcttaaaaatcagaagataatatattcagtaaatttattttatgtacctattatattgtctagtactttaatatgtataattatttatggtttgattttatacacatctcattttccttaaatgtatattccaacttatatggagataaaagtaatgatatcactttgccttgaagaaactaaactctaagactgttatcatttgattctttcattttgagctgtctaaaattttataaaattagttaagagcaaaaagaagcatattagttatctttcttttttttcttttttcattaaaaatttttattcagtgcaacgggttgtataacttttatagacaaaaagtacaaatagctagtgtggtttgatttaaatttctatttgaattaaacatttgaatactttttcacttgcaatttatccttttagacaaatttctggaaccttcatttaaatgaacacagatgtaagaaataaagcggttatggaagcccagttctggactcattattaacccatttatgcctgaggttgcaattttttgaatttttattttgttttattttatttttatttattattattttttattattattatactttaagttttagggtacatgtgcacaatatgcaggtttgttacatatgtatacatgtgccatgttggtgtgctgcatccattaacttgtcatttacattaggtatatctcctaatgctatccctcccccctccccccaccccacaacagtccctgttgtgtgatgttccccttcctgtgtccatgtgttctcattgttcaattcccacctatgattgagaacatgcggtgtttggtttttttgtccttgcgatagtttgctgagaatgatggtttccagcttcatccatgtccctacaaaggacatgaactcatcattttttatggctgcatagtattccatgatgtatatgtgccacattttcttaatcccgtctatcattgttggacatttgggttggttccaagtctttgctattgtgaatagtgtcgcaataaacatacgtgtgcatgtgtgtttatagttatctttcttttaaagtacaggataatttgtcttcaaacatagctggatccaggtgcccaaagaaagtccttatcaacaggttcctcttctcccacttcctctcttttctctactggcttcattctcagagggagatataaaggtggcatcaaggtttataatccaccagtctgggaccccacaagaaagaaagtacctctttcctaatggcttcctcaaaaagcttgggtttaactaatgagctgagcttgtttcacttggccatgcctgaagcaatagctgtgacaaggcctgaaatatatgtttatacctggagctaggagattaaagcaggaaatggactgaagtggaagaggattctgctgcagtaagaagagatgttgagaaggcagaacaacagttcccactgaagatgccactgagttactaggaccatactcctggtcttctgagttccatattctactctttgagtctttcacatggatcagttctaagatgaagtaagaataaacttaaataaatcctttaatgtttatcctctaaaaggacaagaatattttaatagcctgaaagcagatgttgggaatctcagaaaatgaataaagtataatcttgaaaaaaactagtgaaacttctggtttgatctcttccctaatgccaccattcctctcaacttttgattctttagcttttttccactccttttattttttgaagctattgatgttgctagaaaaatctttgaagcaaagactactctctaacattaatagataggaactactccagatgaaattaagtacccttctattaccctgcatatggcattgcattaaaattttggtttacttgtttgtcccactcacatactgtaagtactccaaagaactaaatcatctttgatttccaagttttattgcccaaccacataattgtatttgttgtcagtaacacattaataacataagtgttgttgaatgaccaaatcaaactgtaatgcacttacagacacaggaaacaacacaatgagaaagtgtatgttcatatggggcagggatattcaagagaactaagaatgagcaagcagaggcatttcctcatggcaataaaacaataattagttaaagcaatatattttcaaaataggaaacatttatgttaattaaaatagtgaagagggccaggtgctgtggctcatgcctgtaatcccagcactttgggaggccgaggcgggcggatcacgaggtgaggagatcgagaccatcctggctaacatggtgaaaccccatctctactaaaaacacaaaaaattagccaggcaaggtggcacgcgcctatagtctcagctactcgggaggctcaggcaggagaatcgcttgaacccgggaggaggaggttgcagtgagccgagatcgtgccattgcactccagcctggcaacagagcaagactttgtctcaaaaaaaaaaaaaaaggaaaaaaaaaactagtgaagagatggaaggtcttcaagttaaggatctgaggtacactataaatatgagtgtagaaatcaattcttatttaaaaaacaaaaccaaaaactctgtcccatctaaattgatattatcagttgttaacatacttgagattttcagttaagttgttttataattatgacatatttaaaaagctttataattcatacttttataaatttatctaactttattcttacaacaactctgtgaggtagcttaccatattacttaaaggtgaggaaaatgaagctaagaaagataacatgacttcccattgccactaagaaattaaaaagctaaaactctaaatctcatattctttctatgaaaattgtactttttcaaaattttatgacaagttgctactacaattattgtagagtaatgagcacaagatagaaagctaaacacaataagaacataaaaagtcataaaagatgcatattgatatgttttgtttgcatatgtattgtttcatttttttcagaatatctctctaactttttaagtctttttcaaatcatgcttacagatggcctttgctataatttaatttttaggttatcagtttttattggcatttggaattaatacttacgtgaatatttgaactcatggacctaaatttctagtgtatttttggtttgcatacacctaggtcccaaatttagaaaaaaatcacagtctgttaacaccgtaaaaatctattttaattcatcatattgaaaaaggtaaatataaacaacattgatgaatataaatttttaaatgcaagtacctaatctgagctgcaaatatcaagataattggatgtattggagaccagctggaagtgcaaagaatacttccccttggtattgactcttctctaaatcaatagcggttccaaatgtagtaaaaagcggacaagatttaacaggttctaaattattaaggccagtgcattgttgctagagagttcattaacaatctcatcaatacaatgtggttcatggacattagtaagagctttgtgtaacattttaaaacagaatgagatatctcaatggactgatcttagtaaaaaaaatttaattaggtaagaataattacattagttaaatggaacttttaattgaaaacttgttggcattttcttacctgcttcacagctgtcctttaatcatttatatttaaaaagtgaagagtttctgtacatgatgtttgaaaattatctaaacatcttggactttttgtataaacgtttaaaggagtttagataatgtggcagtaaaaacaaataggattttctgcttgcggaatggtacatttaaaagatatatatatcagaaagaaaagttatagagaaaatatgtatggtaagtatatactattcttgggaaaaaggcaaagtagtcattttctgaagctttaacatttataactttaaaacttcatgtattgaacatcattccttatgaagctttaaaatcttacagggaaataatactgtttataaaattatcttgttaaagaaaatggtatccaacaagagtttttgaaagaatgaaagcccgtatttgtgtaagataaacataaagggccaatggaaactcttattgttaaaattagtgtcagccacattttaggctgtatttactggttgttgttcaaaataagctaattggcaatcactattttttggtagctttcagcttaagccagagagcactggtttggagagacatagacatttattcaaattcacaggaacactaaacaaatggatttgttaattattcatgacattaattctggccaagacagtttcttatctgaatctcagcaaccactatcactcagtgctgcctactttacttgatcttcagaacattgctgaatttgaatattcttcctaattcatcaatttgtctcttcctttcagccctcatgggtactcaatgacacacatgtagagacaaaaatctttatatatatatgtgtgtatatatatgtatatatatgtgtgtgagatatatatatacacacacacacattactgtatagtttatttataataaactataaattcatttagaaacaagacagaggctgtactcacattccccgccccggtctgagctgctgacagatttggctcattgtatttctaggaggtaatacattctagctgtatggcaaagtgtgaagatacagatttcttcatatatatatggaaacaatatatatatgtgtgtatatggaaattatatatgtgtatatatatggaatatagatatatatatatggagagagagagagagagatgtggtcttactttgccacccaggctggagtgcagtggcactatcttggctcactaaaaattcatatatttttaaaggtatttcatcatgcagtttctgaaattttctttaatgcatttaatttgtaataaaatctctctggtagttcaaaaacataagtcataagcagatttgtgttttcactgtgtaagaggaggcaaaaggaggtaaaatgctgtaatattggagaatgactttgggtaggaaagaaagaattttagttttcttcttcgaagaatgaggaggccaggctgagatttaatgtacatgagaagtttaacagcaatgaaggtgaaacaacaaagaaaagaccataatataaatattggcaggttttatttgttcaggcagtaatttgctaggatatgaacacagtcaatggcctaagaataattacttttgattacccttattaatttgtatgaaatgttcatacaatagtttgttaagcaagcacacaacattataaagaattatggagagagacagacatatgtagaatgtaaagagtaaataattatgcagagaagacagacaaataagggttatggttatattacaaaaccggtataaaatcagagtaaaatgtggattttctagtaatatgaatgttagccacaggatgccttaaaatccacctgattcaatcccctccttttatagatgaagaaactgaagactagaaaaaataatagtcatacttgtccaagtttacatgctgtagtgaaattatctgtgcaatagcagtccttcatttaatattaaatacaagacattataatattttaccactcatctttattcttgaattctaaatttgtcagtaacttatatgtactcaattttttattttttggcattctgagttcaactgaattgtagcgtcatgtacataacacattgtgtagggatcaggttattatatgttaatttcctccatgctcctttgccatctagaacctgatctgctgttttaaacagcatgaggcctgttctcccatttaggctaacagtgggtgcagaagggttgaagcattatactttctaaactggttccttgttctggagagtatccatctgaagagattaccgctcttctggtgatcatcgccatcatcgtccaacacctgcctatgcaccatgtgccaggaattgtgcgaactgctttaatgtattatctcatgcagtctgtgtagtccacgcagctgctggtaaagaactctgtttcagagtaatacaaagagccagcaacagagaaagcataatggcagctgcagtgtaactgggagaattgtctctgacaattggctcccgactgggtctgagggcatttcttcatcagtccctcagttcagctagcagccaccgcacacctgctctgtgctgggcagagtgctcagtgcagtgtgccagctgaatgagtgagcaccagcctgttctccatgtgtgaccccctccttcttgctcagaggggtgggcgattgtctgtcccatttaggcttgtgctgactgtgcaagggagatcccaaggtcaggatctacctctttgcccatcactgttaatatctgtattatctaactaaagaactaacatttgtattttttttcctgaaactatctgatttttaaagtaatttttcaagcaagaaaatctttagatcatcatatttaattttcaatgataaaatgaggaaacaaggcaatagggatttttttttattattttctttagtaaaaaggtcaagtcagtgaaagatccagaattcataaacttctattctatttattagaccatgcagctctttctgctatgcactgtacctcaaatgggaattcagaaatgagcaaaatctgagatgtaggagttccagaatggatctgccacctgccagctagcattcggatctcaaaggggacctgcctgcacttacttaatggaaagataaatgtgttcaaggaactgttactataaattcatttagaaacgggacagaggctttactcacattcctctccagtctgagctgctgacagatttggttcactgtacctctggggggtaatacattctagctaaatggcaaagtgtgattgttattcagagctcccaaatacctatttcttttattgtttaaatgaactttatggttgaattcatccatttattgaaaagtacttttatacacttactacaggcaaggcagtgtatggaatactatgtgaggtattaaaaagatagacattgttcttatccaaaagatgattgtgttataaaaggaaaaacaaaaggcaagaaaaatataaacagttttattaaaactagaatgtaaaaggaagaaagaagatacaaattagtgatgtttaatttgctaggattctagatagttctagaataaaatgaaatcaatggaccatcttccaagaaaaatggtgaatcactctttaacttctaatagatgtatgagagtaaaatgtacacattataaactacacatatttaaattactcttaagagtaattatatttagatataaattattgcattcaacattgaaagcatttgtagcccaggccacgagtgctaataaacaacaagtcttgagcaaagagtgaaatattatcacaaatataaccgtgcttggtacaacagacagaataacctggaaaatactaggttctaagttctcccagtcaaaattcaatggaggtatccaaaagtcattccaaaagaatgacttctcaccagaagaaaaaaataaacatttttgatggatttttgctgagaaaaatttttagtacatctgagaaatttgatatactaacgttctgttctgtatttgtacatagtttggaattgtttgtttctattgtcttcatacttttttcaaagaaaagctatgttttaatttttgtgtaactcttgaagcacctattttagacctttacaaaggaaatgtataatgtgataggaatcagaaacagaaataacatatgcattaaacctggacattggtagcttggtaattactgcttagtatcagattattttgtaaatgaaatctaagcacatataaatattttaactattcatagaatctattatttctgttttttatatttggagatattttaattatatatataagatcaaaatattaatgtcaatttttatttgaaactttttagaacatctaatttcttaaattcttcaattatttaaaaatatgtagtgaatttttccaaagtataaggaaaatgtaagcatacatagattttactgttttttttaataccttaaagactcatcagtcatgaggttagttgatggatggaatagtactgagtgactaagcctatttctgtggcaatggctcagccatagaaattagcatttgtcactcttctgcctgtttgtctgttacacattccattcttaaaagtaatttgactaggtataagatacaccaagcaataagctagtaagaaggttaatgaatatttaaatatatttgcagacatttcttatgttcttttcaagccagccatttggaaagatcactatagttttactaaaatgtgtaggacaatattgcacaattttaaaggtttgcaaaacaaaacaagtttttggctgaaaaacattttttgtaggttaactaacttattttggaaataaaaatagcttcaatctagtctgaagtaagctctgaaaggcagcccacattccagttgacaggcgtctgaactagcagtgaagcaggtagggctgcatttagctgtcacattagccctgtctggctggtacctacctaatttgagcttctttctgctgcactataccctcagagggaacagatattctcttctagctttccattaagtgtggcccatatatatgggggtatgtgtgtgtatgtataatatataatgtatataatccatatgcatatatacacatatataattatgcttggagagataaatctctctctctatatatatataaaattgtagttgaaagagagaaaatagaacagattatcttatcttcattattgatttactcccaacccctgcttagcttttgtcttgcctttgtagtttaggatgtaaatgaccacagatttatctaactatctcatatggattttaataaccaaattgtactgatatttttagtttacttggttaaattagagttatgttgaaccctgaagcattctttagaggtagctataatgtataagaaaaagacaagatttgacttagggactacaataacttttattggaatcccagctcagagatgtattctccatggtccgtggaaccatactagcctggtattcgtaagacaccccctaaactgtgagatcttctcccactagtttcccctcctttgcccatcatagtttcagtgggaatatggcctaggggaggcagggattataattgtttagacagtgattctaagggttaggatttgcccgaatcttatttctgccaatctttcatgagacctcgaaataattactttaaccttcctatcttcagtttcctgctctcaaaaatgtttgtagtaatatcatttagaacatacggtctttgtgagaattaaatgagataatgcatgtaaagaaatcagcacagttctgtggcacagagttaaggactcaatataacttgaattaaaataattattgttttgtaataataatattataaaaatgataatataatttaacctgtgtttcccctccacttctctcttcctctgttccacccctctcttcttttctcctgttttcttccattaagaaaagagtcaaggcaaggaattatagagtcaataagagaggatgaagatttagcaaaagcagataaatcaatctctaaatttgggtgtaagagacgcctcttaggccccagcgtgaaagatacactagggcctttgccctttgaaaacctcccgagcagcaactggatagaagcaaactagaatgttgaagagggctttaaaaagtgttatattgctaggggttataagaatgtcctttgacactcatgaaataaagactaaaattgctgctttttaaacttattttgtcctctgaactaatgtttgcatcctgctcagttcaggatttgttagaattatatgattctataatttctttttgtaatctaatttgtatttgtttattttgtttttttctatttactttatatgttattttttcagttatctttttctaggcattgttgggcctctatgtaattccatacttatattttatacaatcatttataggtacttctttcttatccttatagtgatcagatttcactaataattggtcacaatcagtgacattatgaacctctgaaaggagtgtggtggctccttccaggacaacgactggaaatgtgggttcctaacttgaccattcctgtccatacttgatgatttaaattatttgttttacctcaatgttccttgggacaaataatgtttaagcttgataacctttgatttgtagagatatgtatttgggggtatactatcaatttagtgttgcctacaagagtgcttaatatttttagaaaattctattcaccagtcaccataatgtgttctggctcctgtagtagatacatacatatacacatatgcatacatacacacatacccctctggtatatacatacatacatatacatacatacattatgtatatgtgtgcgtgcatgatatatgtttgtatatgtgtgtatgtatatttaccttttctgtttctaaatttttaaatattttaataatatagtttcctggatttatgctatcttatccttcatatgttcagaaatctatttttttcatgaaattgttcctagttaatattagtaactttttaacccacctattattgaaccatattcatacattagtttttttttttctaaaataaacaacagaaatttatttctcacaattctggaggttgaaagtctgagatcaaagtgccagtatgggttctgatgaaagccctctcctaggttttggacacccaacttctcgttccatcttcctatgacagaaagagggctagagagttctctggagtcccctttattttattttattgattcttaatgtatgtacatatttatggagtacatgtgatcatttgttacatccatagcatttgtaatgatcaagtcaggctatttaggatattcactacttctagcatgatcgagtcacggtatttgggatattcactatgtctagcatttactatttctctgtgatggaaacattgcaatcctctcttctagctattttaaaatatacaataaattgttgttaactctagttaccctactctgctatcaaatattagaacttatttcttctatctaactgtaagtttgtaaacattaaccaacttctcctcgtctgtccttctcatactcaggttcccttccaagttttcagtagctatcattctcctctctacttccatgagaccaacctttccatagcccctacacaggagtgagaacatgtgatcttactttctgcgcctcacttatttcacttaccataatgacctccaattccatccatgttgctgcaaatgacatgatttcatttctttttcatggtcaaatgatgttctattgtgtatatatcctacattttctttacctattcatgtgctgatgaacacttaggttgattccatattttggctattgcaaatagtgttaaataaacataggagtgcatgtatccctttgatatactgatttcctttcctttggatacatacccagtagtgagattgctagatcacatggtagttctatttttagtttattgagtgagcaccatgctattttccataatggctgtactaatttacattcccagtgatatggtttagctttgtgtccccactcaaatctctttttttttttttttttttgagatggagtctcactgtcgcccaggctggagtgcagtggtgcgatctcagctcactgcaagctccgcctcccgggttcacaccattctcctgcctcagcttcctgagtaggtgggactacaggcacccgccaccatgcccggctaattttttttgtatttttagtagagatggggtttcactgtgttagccaggatggtctcgatctcctgaccttgtgatccacccgcctcggcctctcaaagtgctgggattacaggcgtgaggcagtgcacccggcctcaaatctcattttgaattttaattcccacatgacaaaggagggacctagtgggagataattagatcatggggatggtttcacccatgttgttctcatgatagtgagggagttctcatgagatctgatgattttcaaagtgacagtttcccatttgcatgctctctctctctctcttgccaccatgtaagacatatcttgcttcccctttgccttctgccatgattgtaagtttcctgaggcctctccagtcatgcggaactgtgagtcaattaaatctcttttgtttctaaattacccagtctcaggtagtgtccttatagcagtgtgaaaaatggactaataaagagaattggtactgaaagtggggtaatgctataaagataacctgaaaatgtgaaagtgactttggaactgggtaacaggcaaaggttgtaacagtttggagagcttcaaagtacacaggaaagtggggaaaagtttggaacttcctagagacttgttgaatggctttgaccaaaatgttgatagtgatgtggacaatgaagtacaggttgaggtggtctcagatgcagatgaagaacttgctgggaactggagtataggtctgtcttgctaggctttagcaaagagactgcttgcattttgcccctgccctctgtggaactttgaacttgagatagattatttagggtatctggtgggaaaaaatgtctaagcagcaaaacattcaagatgtaacctggcttattctgaaagcattcagttatatacattcacaaatagatggtttgaaattggatcttatgtttaaaaatggaagcagagcataaaggtttgggaaatttgcaacttgaccatgtggtagaaaagaaaaacccgtcttctggggaggaattcaagccagctgcagaaatttgcataagtaacgaggagcggaatgttactagccaagaaaatggggaaaatgtctctaaggcatatcagagaccttcacagcagctccttccatcacaggcccagaggcctaggagggaaaaattggcttcatgggccaggcccagggccctgctactctatgcagctttgggacttggtgccctatgtccagctactccagttccagctccagcagtggctaaaagcagccaaggtacagctcgggctgttgctgggaacatttacccaatgcctgtacctgcattgtatcttggaagtaactaacatgcttatgattttacaggcttattggcggaagggacttgccttgtctcagaggagactttggacttggatttttaggttaatgctggaatgagttaagactttgagggactgtggggaaggcatgattggttttgaaaggtgaaaagtacatgagatttgtgagggaccaggattggaatgttatggcttggctctgtgttcccacccaaatctcatctcaaattgtaatcaccatgtttcaagggagagacctggtgggaggtgattggatcacggtgttctcatgatagtgagggaattctcatgagatctgatggttttataagtggcagttttccctgctatccctctctctctctcctgctaccatgtaagacatacctttcttcccctttgccttctgccatgattttaagtttcctgaggcctctctagccatgcagaactgattcaattaaacctcttttgtttataaattacccagtctcaggtagtatctttatagcagtgtgaaaacagactaatacactcagcagcagtgtataagagttcctttttctccatgtttttggtttgcatttgttattgtctttttgtttaagaactattcaaactcgggttagatgatatttcattgtggttttgacttgcatttccctgatgattagtgataatgagtgttttttatatatctgttgtctgtttttatgtctttttagagaaatgtctgttcacatcctctgcccactttttaatgggattttttatttatttattttttttactgttgagttgtttgagcttcttttatattctgaatattgatcccatgtgagacaaatagcttgcaaatattttctaccattcaacaggttatctcttcactctgttggttgtttgctttgctgtgcagaatctttttatgtcccatatggctttttgtgtcccatatgtctattttttgttaattgcctatgcttttgggtccttagccatagagtatttgcctagaccaatgtcctagagtgttagtctgtgtttccttctagtagttttatactttcagaacttatatttaagactttaattcattttgcaatattttttgtatatgatgagagataggagtctagtttcattcttttgcctatgggtatccagtttttttcagtaccatttattgaagaacctattctgtttccgacgtatattcttggctccttttcaaaaatcagtagactataaatatatggatttatttctggattgcccattttgtttcattggtctatgtgtctgtttttataccaataccatgctgttttagttattatagccttgtaacacattttaaggtcaggtattgtgatgccttcagctttttttctttttgctcaggattgctttggttattcaggctgttttggttccatatgaattttagaagttttttttcttttctatttctgtgaagaatgtcatgatatattggtggtaattgtgttgaatctgtagattgttttgggtagtatggccatttttacaacattaatccttcctatacatgagcatggtcttttcatctgcctgtgtcctcttcaatttctttaatcaattttttgtaggtttcattgtagagttcctcatctccttagttaaatttattcctaaggttttttactttttgttggtagtgtaaatgagattaccttcttgatagtttggctgattagttatttgtgtataaaaacatggctgatttttgtttgttgattttgtgttctacaactttactgaatttgccaaatagagtttttggtggagtctttaggttttttaaaacataagatcatgtcacctgcaaaagggacaatttgactttttttttttccagtttcagtgtcctttctttctgttgtctgattgctctgagtaggactttcagtactttgttgaataggagttgtaaaagtgggcatcattgtctggttcaagtttttagaggaaaggatttcagctttttcccatacattatgttatttgtaggtgtgtcatatatggcctgtgttatactgaggcatgttccttttatgcttagtctgttgagtttatattatgaaggaatgttgaattttatcaaatgtttttctgtgtctgttgagatcacatgatttttaccctttattctattggtgtgatgtattacatttattgttttatgcaggttgaaccatccttgagctcctggaataaattccacttgatcatgttgtagtaccttttggatgttctgttgaatttagcttgctactgttttgttgaggatttttacatctatgttcaccagggatgtttgcctgtgaacatagatacaaaacatagatgttcaccagttgttgttgctgttgtgtccttgtctgcttttggtatcataatactgacctcataaaatgagttaggaagaattatctcctcttgctttttaacaggtagtttgagtagaattggtattaattattttttaaaagttaggtagaatatggcagtgaagtcatctgatactgggcttttctttggtggaagccattttattattgattcaattttgttactcttattagcctgttcagtttttctacttctttctaattcaatgttggtagtaggttgtatgtgtctaaaaatttatccatttcctataaatttttgagtttgttagtacatagtttttcataacagtcttttaggatttttttgtatttcagtgttatctattgtaatgtccattttttaccttctgattttgtttatttgggtctttcatcttttttttcttagtttaactagaagtttgtcaattttttttaaagacttttcatttcaataatcctttgtattattttttaagtctctatttcatttatttcagttctgatctttattatttttttcttctactaatactaggtttgatttgttcttacttttctagttcttgaggtgcatcattaggttatttaaaatctttatattttcttgatgtagatacatattgctataaacttccctcttaacactgcttttcctgtatccggtgtgttttgatgtgttgtgtttccatttttatttgtttcaagaaacttttagattttctgcttaatttactccatgacctaatggtcattcaagagtatgctgtttagtgtccatatatttgtagagtttcaaaaattcttcttgttattgatttctatttttttgtttattgtggtctgataagatatttgacttttgcaccttttcaacttttaaaagtttgttgaaacattttgtggccttacattgtttttcctggactgttttgtgtgctgatgagaagaatgtatattctgcagttgttggatgaaaggttctgtaaatgtctgttaagtccctttggctaaactgcagttttaatctgatgtttgttgattttctacctagatgagctgttaaatgttgagagtggatattaaagtccttaactatttctgtattgtagtctgtctgtctctttagatcaaataaaatttgttttatatatttaggtgccctgctgatgggtgcataaatatttagaaatgtcctcttgctgaattgatccctttgtcattatataatgacctggtttgtctctttgtactgttttttgacttaaagtttgttttatttgatataagtatagctattccagctcacttttggctttcatttgcatagaatatctttttttcattcctttactttctgtctatatgtgtctttacgagtgagatgaatttctttctttttttttattattatactttaagttttagggtacatgtgcacaatgtgcaggttagttacatatgtatacatgtgccatgctggtgtgctgcacccattaactcgtcatttagcattaggtatatctcctaatgctatccctcccccctgcccccaccccacaatagtacccagagtgtgatgttccccttcctctgtccatgtgttctcattgttcaattcccatctatgagtgagaacatgcagtgtttggttttttgtccttgcaatagtttactgagagtgatgatttccaatttcatccatgtccctacaaaggacatgaactcatcatttttttatggctgcatagtattccatggtgtatatgtgccacattttcttaatcgggtctatcattgttggacatttgggttggatccaagtctttgctattgtgaatagtgctgcaataaacatacatgtgcatgtgtctttatagcagcatgatttatagtcctttgggcatatacccagtaatgggatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgactgtttaatgattgccattctaactggtgtgagatggtatctcattgtgattttgatttgcatatctctgatggccagtgatgatgagctttttttcatgtgtcttttgctgcataaatgtctttttttgagaagtgtgtgttcatatccttcgcccactttttgatggggttgtttttttcttgtcaatttgtttgagttcattgtagattctggatattagccctttgtcagatgagtaggttgcgaaaattttctcccattttgtaggttgcctgttcactctgatagtagtttcttttgctgtgcagaagctgtttagtttaattagatcccatttgtcaattttggcttttgttgccattgcttttggtgttttagacctgaagtccttgcccatgcctatgtcctgaatggcaatgcctagattttcttttgggtttttatggtttcaggtctaacatttaagtctttaatccatcttgaattaatttttgtataaggtgtaaggaagggatccagtttcagctttctacatatggctagccaattttcccagcaccatttattaaatagggaatcctttccccattgcttgtttttctcaggtttgtcaaagatcagatagttgtagatacatggcgttatttctgagggctctgttctgttccattgatctgtatctctgttttggtaccagtaccatgctgttttggttactgtagacttgtagtatagtttgaagtcaggtaatgtgatgcctccagctttgttcttttggcttaggattgacttggcgatgcgggctcttttttggtgccgtatgaactttaaagtagttttttccaattctgtgaagaaagtcattggtagattgatgggaatggcattgaatctataaattaccttgggcattatggccattttcatgatattgattcttcctacccatgagcatggaatgttcttccatttatttgtatcctcttttatttcattgagcagtggtttgtagttctccttgaagaggtccttcacgtcccttgtaagttggattcctaagtattttattctctttgaagcaattgtgaatgggagttcactcatgatttggctctctgtttgtttgttattggtgtataagaatgcttgtgatttttgtacattgattttgtatgctgagactttgctgaagttgcttaacagcttaaggagatatcgggctgagacaatggggttttctagatatacaatcatgtcatctgcaaacaaggacaatttgacttcctcttttcctaattgaataccctttatttccttctcctgcctaattgccctggccagaccttccaacactatattgaataggagtggtgagagagggcatccctgtcttgtgccagttttcaaagggaatgcttccagtttttgcccattcagtatgatattggctgtgggtttgtcatagatagctcttaatattttgagatacgtcacatcaattcctaatttattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgcgggcctcataaaatgagttagggaggattccctctttttctattgattggaatagtttcagaaggaatggtaccagttcctccttttacctctggtagaattcggctgtgaatccatctggtcctggactctttttggttggtaagctattgattattgccacaatttcagctcctgttattggtctattcagagattcaacttcttcctggtttagtcttgggagggtgtatatgtcgaggaatttatccatttcttctagattttctagtttatttgcatagaggtgtttgtagtattctctgatggtagtttgtatttctgtgggatcggtggtgatatcccttttatcattttttattgcgtctatttgattcttctctctttttttctttattagtcttgctagcagtctatcaattttgttgatcctttcaaaaaaccagctcctggattcattaatttgttgaagggttttttgtgtgtctatttccttcagttctgctctgattttagttgtttcttgccttctgctagcttttgaatgtgtttgctcttgcttttctggttcttttaattgtgatgttagggtgtcaattttggatctttcctgctttctcttgtgggcatttagtgctataaatttccctctacacactgctttgaatgtgtcccagcgattctggtatgttgtgtttttgttctcattggtgtcaaagaagatctttatttctgccttcatttcgttatgtacccagtagtcattcaggagcaggttgttcagtttccatgtagttgtgcggttttgagtgagtttcttaatcctgagttctagtttgattgcactgtggtctgagagacagtttgttataatttctttttttttacatttgctgaggagagctttacttcccagtatgtggtcaattttggaataggtgtggtgtggtgctgaaaaaatgtatattctgttgatttggggtggagagttctgtagatggctattaggtccgcttggtgcagagctgagttcaattcctgggtatccttgttaactttctgtctcgttgatctgtctaatgttgacagtgtggtgttaaagtctcccattattattgtgtgggagtctaagtctctttttaggtcactcaggacttgctttatgaatctgggtgctcctgtattgggtgcatatatatttaggatagttatctcttcttgttgaattgatccctttaccattatgtaatggccttctttgtctcttttgatctttgttggtttaaagtctgttttatcagagactaggattgcaacccctgcctttttttgttttccatttgcttggtcgatcttcctccatccttttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgatagctggttattttgctcattagttgatgcagtttcttcctagtctcgatggtctttacgttttggcatgattttgcagtggctggtcctggttgttcctttgcatgtttagtgcttccttcaggagctcttttagagcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgccgttaacattttttccttcatttcaactttggtaaatctgacaattatgtgtcttggagttgctcttctcgaggagtatctttgtggtgttctctgtatttcctgaatctgaatgttggcctgccttgctaggttggggaagttctcctggataatatcctgcagagttttttccaacttggttccattctccccgtctctttcaggtacaccaatcagatgtagatttggtcttttcacatagtcccatatttcttggaggctttgttcatttctttttattcttttttctctaaacttcccttctcgcttcatttcattcatttcatcttccatcactgataccctttcttccagttgatcgcatcggctcctgaggcttctgcattcttcacgcagttctcgagccttggctttcacctccgtcagctcctttaagcacttctctgtattgtttattctatttatacattcgtctaaatttttttcaaagttttcaactgctttgcctttggtttgaatttcctcctgtagctcggagtagtttgatcatctgaagccttcttctctcaacttgtcaacgtcattctccatccagctttgttctgttgctggtgaggaactgcgttcctttggaggaggagaggtgctctgctttttagagtttccagtttttctgctctgttttttccccatctttgtggtattatctacttttggtctttgatgatggtgatgtacagatgggttttggtgtggatgtcctttctgtttgttagttttccttctaacagacaggaccctcagctgcaggtctgttggagtttgctagaggaccactccagaccctgtttgcctgggtatcagcagcagtgtctgcagaactgcagattttcttgtaccgcgaatgctgctgtctgatcgttcctctggaagttttgtctcagaggagtatctcgccatgtgaggtgtcagtctgcccctactggggggtgcctcccagttaggctgctcgggggtcaggggtcagggacccagttgaggaggcagtctgcccgttctcagatctccagctgcctgctgggagaaccactgctctcttcaaagctgtcagacagggacattgaagtctgcagaggttactgctgtctttttgtttgtctgtgccctgcccccagaggtggagcctacagaggcaggcagacctccttgagctgtggtgggctccacccagttcaagcttcctggctgctttgtttacctaagtgagcctgggcaatggtgggcgcccctctcccagcctccctgccgcgttgcagtttgatctcagacttctgtgctagcaatcagcgagactccatgggcgtaggaccctccgagccaggtgcaggatataatctcctggtgcgccatttcctaagcccgtcagaaaagcgcagtattcgggtgggagtgacctggttttccaggtgctgtctgtcacccctttccttgaccaggaaagggaactccctgaccccttgcgcttcctgagtgaggcaatgcctcgccctgcttcggctcgcgcacagtgcactgcactgctgttctgtgcccactgtctggcactccctagtgagatgaacccggtacctcagatggaaatgcagaaatcacccctcttctgcgtcgctcacgctgggagctgtagaccggagctgttcctattcggtcatcttggcttctccccgagatgaatttcttgtaggcagtatatagttgggtcattaaaaaaatccattcagctagtcatatctttcaaatgaacaccttattgtgtttatatcaaaggttattattctttaattgtttttgtttgttttgtatatcgtttgttcccttctttctctcttattgtttatcattgcggtttagtggttttctgtagtggttccagaatttgtttggttcttttatatgatgtctatctctttatggaacttttcattaatatcctgatttttttttctttgtattgtttttctgtgttctctgtgtctcattgagcttctttgctataattattttgaatcttttttcaggcatttcatagatctatttttcactgaatattttgctgaataattattgtgctcctttagaggtgtcatacttcctggattttttatttcttgtgtccttttctgtccttatgttgatatctacacattttgtgtaatagttgcttgtttcaatttttttttttttttttgagacggagtctcactttgtcacccagtctggaatgcagtggcgccatcttggctgactgcaacttctgcctcccgggttcaagccattctcctgccttagcctcacaagtagctggaattacaggcccacagctaccatgacccactaacttttgtatttttagtagagaccaggtttcatcatgttgtttaggctggcctcaaactcctgacttcaggtgatccatccacctcggcctcccaaagtgttggaattacagatgtgagccaccatacccggccagcttttttcaatttttttggatggattttcataagggaaaatttttcctatggatttatctatggtattggttgagggggcactttcgctttgattatagggttagcagtagcatagtcctcatatgatttttacagcatcagtggtgtctgtgatttccgtttcttagactgtgattattagtggagactgtgttgaaattttactgggtgtaggagtgccaggtagttcagtcctgaggcccagtggtgttatcagtgggctaagtgtgcctgtctttaggctcctgtgtggcatacaagggcacgtgtgttagtgggctcaggtgggccaattgttgggcctccaggaagcttgcttcggttcagtagtggcagcagtgggcatgtgtgtggtgaattcctgggcccctaagcagtatgcatggcatgagaaatagcagtagtgatggtgggaccacccttggactctcaggcatcacatactggtgtttgcagtgcctgcaacaggctggatggaccagccctcaggagaagtgcacggacaccagcagtggtgaacaaggcagggctgttctcaggtccctgggtggcatgcttgggtacttgggggatagtgccaggggtgtgggcctgcccttagtgtcccctgatgggtgcatgggaataggctgtggtgaataggacagggcaatctccatgccccaggtataacaatgtatttcttttttacaaatatgcatttaccagttttctataatctctaccttttcttattttgcagtgcattttcattatgtatttatgaaaaaattatatagagatttatgcattcaagtgcttgttgacatttgttacattgtgtaactacaaaaccaccttcactactttgcttattaaccatagagtgttgagtgagaaacccagagaaaaggatataaactttggacagattatatggattaaatccagctctacgtctatatgctatggtttgttttttgagttacttagctgctgtctgccttggtttcctatttgacacatacttgatgggattgcacctgaataatggttatggaaattaaaggaattaatttaaggagagtgcctcacacacagatattgaatgaatgttggctattaatattattaatagaagacagattttcacatatttgtgagaataagagaaggcacatttttgtgagcattcttgtgagaataagagaaaccacatttctgaagcactagaattttcacacggtttttcaaaggaaggagatttatagacacacaattttacaaagaagacaatagtttaatctgacaagatattaaatataaatagaaaaatctacataatatcaccaaaacaactagtctaaaattaaaaccaaaaagtaccccaaactggagaaaatatcatagaaagtatttcagaagttctgtttattgatttataagtaaagatattttaaactgggaaatccagaagtagtttgatcagcgacttttagattacttgtacctttttctcaaggatttatattttattgttacagacagtagtctcaccattttgcccagactgggctcaaacttcagggctcaagtgatcctcttaccttacccttccaagtagctgggctacagatgtgtgccactgtgcccagctatatttatcttatagtttaataatattatctaatttttataattgtacttaaaataacagatttcaaagagttttattagcaactactgtgtcctgatcttgaaactgaaactatataccagaaaagattttttgatttttaattaggcaaaattattttctagcattgtcatattaaataaggttactactctaggatttttatgtatgtcctgttagattatctatatgtcagtaagtcatgaaaagcaattttcatgaaaacttggaattagaaatattatagattgtattcttttagttattttttccataatagatcaacatttttatcttggcaataactgctatagtttttgtaatcttcctcatacattacgtgttaatcttaaaaactgtggaaaatatgaaataaaaattttactcatgattaattcacaagagttaaacattattattttattgtgttttcttgtttttgttgtttatatagtatgtagtggtggccaaaagcattcctgaacagggagggtgggcttccccacttgttagctgtgtgatttcaattagttcttcacttttcccaaccttggttttgttatttataaaatgttaacaatagattttttattatactattattcagagaataaagtaaatatattaattacccatatataagtatacatgcatgtgtattttagatattctatttaatttataaatatatattgctttataaggtaatacttcatattactctataaatatatattatctgtacatatatttataaagtaaatatatattatgctgtatttccataataaaccattatatattttttttatgtatatattacatataatagtttatattatatataaaataatggttatatattaataatggttttatatattatatattatatattacatactatatataatatatgaaaccattatatattatatataaaaccattatttatacatttatatatataaaatgatttatgctggaaatgcagttctgtataatctaaatctaatttaacacaacaccatttaagatgtatttaatttccatctagttgagtatttttcaaaacatgattttttagtgcttatataagaaaacatcgtgaatttatttagaaatttccctattttggtcattcagtagatttccactctttttttttttttttctaaaaacaaaacaatggatatgtagccttcattcttagctccgattttcttaatgctaattccagaaagaggaattactgggttaaaataaacataaatatttttaaggctctcttacgttttgtgctgcaaaattaccctttctgttgacagttatatattttaaaacgctcaaaatgtatcttcccaattctgttgatgatttttgtgactacctgtgtaatatatgtaatatgtcctctgaatattaactcgggtcagagacaaatatcagtcaaatcctcaggctcaggatgtatgcctcaatgaacactactagttttcactatgcatccttcagggtatgtgaaaatagtcagtagaatttataaaatgaaggtttggaatctgagttattttcccaagagatttatgaactataaaataatattattatgttctcttattgcattgtgctctttagccatcttccattttatgtggtatagctccttaggatccatttggttgaaagctactgtgtatactcattttgtattgtattgtggcaaatgctgtaatctacagggttcctattcatttcacagctcactaattgtgtgaatgagaagaggaaatatatgcttttattctaaagcatgccaagcagatggccaaagttcattactaggagcattgtcagtgtggctgtcttttctaggtagtaagcctggcatcgatctgtcaaacacagagtgagggtccatttaacacagcacttgaaaatcactgagcctctgttttgttatgacttataaacattttatttttttatcatcaacctccaaagtggttggtcatttgagcaggtgcaaacacagtagaattcatatttgttttacctgagaagccaaatgaacttttattcatatggaaatcttggggaaaggaaaccgtacaagagattaagcttagtttcttgaaaagcgggtaatacagctattgagattcaaaactaccatcatttctgagattgaaacttttgaaaatttaagttgaagaaaaagatcagggtttatatctttttaaagctaaaagattaaaacaatgaaagaatttaaggttttaagtaagtctcccttaaaatcttggtttcttcctataaaaggaaactgtttacttacttttatatagaatatgtaatttatgtgaccattaaaaatgttagcaatgtactcattgtgtgtgtgtgtgtgtgtgtgtgtgtgtataagtgagacagagtaagaatcagagatagtgacaaaaaggaaataaagcctgtcttcatacatgtcctacttcaacggcagtactaggactatatgtaattgggttatttcaggaaaaggagggtaggtcaaattttcttatggagctgatgtagtaatttgatcataatgtcttgtttaagagaacgagagcatgttagagataacgttttcttctttatacaaagaaaaatgggatatatatttcccttacctcttccctcttcctccttgcaaaccatctaccacaagttctacaagttatattgactataaatttccctttcccttgcttttcagactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggtaagttaggagaagaacatctgccttgtctcttttgttgtcaagctgaatgaagtgagattattgtggtttttctagcaagtgtccttttactttatgtttaatttaaattttctctcttactccaaataagcaaaattaacatttttactaaataataccaaatgaaaggtgaggggaaacaaaatatctatcaaagtatctatgagggttagcatttacctttctgaatctttattacttttcctttatgtagagatatagattaataaaggaatgtttatattttaggcaacaaaatataaaatgcatttttaacataaatgtcatttgcactacagcaaaattatacctaatttgtgaggcttcaagtatagttattcagattaattgttcctaaatatgtctagttatttaaattatatttacaattaacaaaaatagaatgtatggattaatcaaagtgcaaaatttactccatgttatataatgcaaccattcttatgaccatatatcatttctgactatgtctgttatagatcaagaatattcatagtgagaaaaagtttttgaagatcatacatacatacatatatacatgcatatatatacaaatatgtatacgtatatatttttcctgtcaaaaaagaaagtcctttgttaacttagaatacttttcatagatgaaagtttaactgtgccttaatctttgcaatgaaatatcacaggtattattaccatatgaaattttttattaatggcttaaaataaatcatcagttcatcttgtaataaattattcatcatgaaaataaaagtgcaaataggatcataattaagtatctctgaatatccatgaattttctttgtctaattcttatcaaactctcaggtagatgaattaatagtttcgaagaatatgcagtttattagttgccccatattctaacatttacttctggtttaaaactgaaacttagtgagctgtagacacagtccacaggtctggcgagatgaagaattgatttttctgaactcagcactagattattgaaacaatgacgtgtcaagcagccctaaaagaagcagttgtatgacattccccattgtatttattgtagggtgtaattgagaatcttgtccactaaatcacacagtgtcccccttatgaggaccaacaggagaaatttctctcaggtctcagtgccaggaaaagctctttctcctgagcagctggtatgtcttaaattatagaccctgtatattgtgtttttatcatattttcttctttgttttggttgctaggaagttcagaattgaatttgtgataaaattacttgtgcaatttcacctggtatacatttctttatgctctctctaccccagatttgttcttctgttttacacttctattcttgtacttcttgatctttttgtttacttttatactattgtccattttggttagtcacttgaaagtttttctttggaagccattaggctaaaaatatttttttcttccttattccaaaccagtgaacacatgtttaactttagcaaagacatgttgcaatatgtttatgaatatgtattaaactttttctatttcatttgtaatttattagctgaaaactaagaatcttgcacataagtatccaaatatcatatggagcctcagaaatttagtaatattaatttcaaatccttattgaaatattacccttaatctactgatatttacttcttttgggtcttggttatattattttaaacattttagttgtgagtatacattttataattgaaaatttctgtatttaactactttttcctaagctatttccaaatgacaaacaatggaaaacatctaattgtggttctataaccaacagaatgggaaaactttttacgttaaaaaagtccagatatttactcaccttttagggttgaacatattatacagctagattattatattcccatctcctccatgaagtatatcttgatatgaagtaattataatacatttcccttgcccttacttagtggaaagctagggggaatgtatataattgagttagtataacatagcttttcctggattcagtttctcttattgtaataagttccttttcatgttattatgaatttagtagtgggattttataacagtagttctaactgtatttgccagtgagatatttaatatctcatacaccataaaaagtaactaaattcttctcactttagttaaagaggtacactacttaaaacataataatacaatgtctcctagacagaaaattgtaactggaaaatgcattgtataaaatgaaaaatttatagtaaattttctgctgaaactaggataatttatgtagaaaaacatttttcaaatttcagaagaaaattaaaatattttaaaaatctctagcaatgtaaactgaaaagtaatgaatataagtttcctacttttgtgaaaaaatgtttattccatctttcttcacttatttattatcaatgtttttctattcccataggcacattgggaaggcctcacaggcagaataactttcaacaaaaccaatggcttgagaacagattttgatttggatgtgatcagtctgaaggaagaaggtctagaaaaggtatttcagtgagcttatttgctttaattactaaatgaaacatatctcaaagaagacaaatattctctgttgtagtcacatttcattgacatttaactttattgagtaactctaaaaataaatagttaattcattatattgaatataataattgacaattaggattcaaggataaagggtatcttaagacaattttatattttattttctaactagagatttttctgatgcatataatgtttgaagtgcatataatgttaattagtcttaaggtttaatatagcaattagaaaatatttggtttaatatgggtctttatacatgcagcttataatcacttatggttgcatagactttccaacttggagcaggccattaagaaattaaatataaaagtatgtttctattttttgagtcatatttaagtgaaatatttgaattcatgtatgcacagtaactagggtatatacataaatgtaacataccacactggatctatcttacttgattttattgctagggattgtggtaaaacacccaaagaatgtgggtatgtgcctacttaatgaatattttagtgtgagttttcttaaatacataatgtatgtatttagatatttttctgatagattcattgataattgacaagagatattaaatctttttatatgttatttagatgttattaaatcttattagatcttattaaaataagaacttgagaaaaattatatgtgactgagataatattgctttgaagatagtaagctatcttatatttcacccagcaatgaaacatgcagctttatttctagacagaaactgaagaggaaagctgagacctacgaagggctttcttagtctggaagataacagcatatttgaatgctgattcaaaccatccaggacagagtaaaattgcatttttgatagtgtccccaagacagttttaaatacattatgaccaactgatgactcaaactgatagagctgttacctcctgccactgaggatttcaaactgtacactttgtgaagaccaagcaaagtcaggaatattttataataaactggaacccaaatattcatgagacagtcccttcctaactgtctcactctccagatgagaaaattagtctgtgtccaagactggagttgataatggtagaattcagtaagctcgtgaggagtttatcttactgtttactggagatgttattactttatttatttatttatgaaatatcgaaatcactaggaggaatttggaccattgctgacatttcaatacatctgcataaaatggcagtgctcttcatattaccatagatccattcctgtcttgaattcaaaataaatgaaacattacaaaattttctctgtgctccattgtggcttacagatacgcctgaatataatggttatcaagtacatatgatgatctatcacactgataagcaaggtaaaccagtgtgagttgttcaggttgctctgagatttcataaatattttatattattttctaaaatctgaaaattcattttgctgaattaattatgttcagtccttatcctcaaggggcttttcatgtacagtgataagataatacatatttgtaaataaatacaatcaaaagctatatgtttcaagctttcaaaagaccaataaaaatataatttctgataaaagatataattaatcaagagtcatagtcaattgagtacttagaattagcctttgaatatgttgaattattgattgttagaaaatcagtcattttagaaggaagtagaagtatggggaaacacaaacatagcgtttgattttatcattacacacatacacatacaaataaagctaaaatgctagattttagtcataacatagataccatgtccaagatatttgcagggtattagaacacaatgtgagtttaaagaaagaatagccctgaaggctatgggttacttgggaagataatatagtttagaataattttagtatgaggccatgaatttaaaaccattctaataggaagtggagatgagtaaacagtttgtgacagaaggcattaactgaaccatcagcaatgttgttagttcaaagactagcaaagcatttggactatgtttttaaggagaaatggaggagccaggtaggaaaagggagataccagggataaaagcataactcaaatattggaaaatgaattagcaagtaggggaattactagtagaaataaactggcataaaccttcccctgaaaagacagataaggtaccgaggatgggtggaggtaagttaaagagaaagggagcaaaaagttcacatcacatgttttcaatatccttgaaaatttgtacatgaactcatcagctaaaggacagcggtaaagtttagtcggttcttaagaaaaattgaaaattccattttgacagacttgattttgacttagaaggaacaaaatgctgctaagtagcaaaaagtcctcattttaaatttagtagaatagtttacagctcaaggtctagattcagagatattttggctcaaattctcactctgccctttactttttgtggacaaatttattaatctctctaaaacacagcgtcttacactgaatcatgaggcaacagcagttatctgcctcatgatgactgagtgttattgacttgactttttttctgcctagaaagtatagttaccaacccatagatggaaaagacagcatccctaccctgatggaattcacagtttagaagggccaatagatggtgatccaagaggcttgaatttcagttccaattctatcaaaactaagcatgtgaacttcatcctgccaccgaacttctctgtgccaaattcatcaccttaaaaaaaaaaaaaagtgcagggcaaagggctgccctcttggacagtctgaagtgagaatactatggcctctaaaagaacccggaagtaccatcttgaaataaattgatgctagaaattttaatcgttaaaatttaacaattatgttctatcatgactgagagacaaaaataaagaaggaaaacatgtaaagtgctaggtttatccctcttctcatgcctattgccttttcttcattctcattctgtcttggtcatcttagaccagcacacttcatttagtaggttaatcttctaacaaatatggaaggaatgtctgttttatgccctcatgaaggttataatctaatagaggaaacctgccaataataaatagactcattagacttataaaattataagattgggcagtaataagtgctgaaaagaaggtcattttgtttttatgtcactgacatgatagattttacataatgttcggaaacatgaacttcaggatgaaaacagttaacaggaaggaagtctatgcttctgttgtttacaactgtggagcagataaaccaggaagaaaccagtatgcttctgatgaatgggaaaaggtgggccatgctcaagtgtctgagcctggagtggagatgggcatcctttctacttagatggtgtccatagatcaaatgaattctttctactctattataacagaagccttaattggaacccagcccaattcactgtggtcccaaaaagatcaccgatactgtatacacagccagccacttctgtgcaaacaagctctctgggaccatggcagtgccttcaatggaggaggggagggcaagaagggggaaagacagtaggtactattacagactttgcctagttcaggcaatacttttgcttatgagaggctggtattgagcactcaggaacaggaaaaggaaaacagaataagtgattttccaagcttgaattcttctggtcagttcaaggatcatatagtgtattctactttcaaaatatgtttagaatccattcatctctcaccacatccgttgctgaatcataaccatagtacctttcaactgtacaactacattggaattcccacaagcctctctcttcaattctgttataatccattccctaaaccacagcagccaggcagatatttttaaaaggaaattgacccctgtcatccctctgtttaaatgctttcatagattctcattgtgttttgaataaaatccaaagcaccagtgacctctcatcatgtcatcatgttctcagatattttcttctgccctacctacagagggtttttttttttttctcatttcctcaagaaaacaaagttttcttatcactttggcatagagtaatagaaacagttttcccagccaggaatatccattcccagttcctttgcctggggaactcttactcatcctggtagtatcatcttaaatattacttccttagataggcctcctctaagtctctaatcaagtttaaatttctcctaatgctctgccctttttaatttctgactctatcaaagtacacaattatttattcacgtgaactttataaaagggctatctccctagccagagtgcaagacctactagatggaaaatatatgctcccttttccactactatatattaaggctttgcaaagtatcctttgtcttgaggacaaagtatgtactcaagaaatatttgttgactgttgaatgaataaagaatctttatggaaattatgagatacttcacacagaacgcttactcaagtgtctgatgcagagttattttcctgtagcacagtttgttgcttttcctagctttgctctatacctccaacatgaggacagggaaagacaatagtcaagggatcagtgggttggggtcatgggtcaatgtttcaagtgggtaaaggattttagattgcagaaggtcaccctgaagtcggaaattgtaaggatccacattgcttcagtggtaaatctggccccattcatggcacaattaaaaactctctgaccttccagtattacattaaacagtaaaactcaacattctatttataaatgttccttttttgtccttacaagttacagtatggaaataaacaaagctcacccaaatgagaacaagtggaagttactattcagaacttactacaggaagggagacagccttcatcacttgcattaaacagggattcaaaggcaagcaggggagtggaaaagtttcatagtggaaagaaatgaagacctcaggtgtgctgtgattggagattgctggcatgaggaaactggagttggtctaacaaagcagggcacctagataatgggttttggggggcacatttgactttctctggctggttctgatttggagggtggcaaaaaattgggaaactggaagtaataggatgaatcctgattgttttgggtagattgcctgctgagattgtgtttggcttcctgaggtgctcactccagagcttctgggtcatagtttgtcatcacacatggtttggtcattgtctatttgtgtattcagtctgtgagtggaattactgaagtaatttggagggagaagaatagcaaaaataaaaagaagcaggaaaaatttacttgtgaggaaatataaaaacatcatcaccaacaataaaattgtttttttggtttgttttgtttttgttgtttagaatgtgtaaccaggatgtaacttattgttggaagtggtttatccttattgttccatcacctgaagcttagctatgtgcttaggaaagaccagctctagagggaagaaaacacaaaactgatggcataagatgttacagaaatattcaggaagatcttagactgtaacttcaaaaggatatcatttacagcaaaaagagttggaagagttccacacaaaatgggtttagactgagttgatgacattatataaaatagtgcaatttcattgcaagatgagctacctagaagccatttttgggaaaacaaccacttaaatttagaaaagaatttcctataggaaactgtaatgcaataataaaatccctgaatcttaactcatgattgaattttcttttaaactctcctatgtgaccacaaagtacttcgtgtgttttccaagagaaaaaagtcagtcttttactgttacactttcctggttattcaaaataatttttattgtactacagaatatttgtttctaagtacaggtgtaaattaaaattattcttgtgtacttctcttatcctttttctagcatcaaattttgccaatctgattactttgtggatattctcctgtgtgatatttaaatgaaaatagacattggagaatagaattccctatctcctcagcagataggctctaataaaccattattaaaattggctttatgtattaatattatattaactttgaaaaatagaaaggataaaactgataaatttctttggacagaaatagtgctgagggaccttgaagcatttgggactataaaaaacaatcacaatgtgtttgccccagcgtaggtttgtaataaaatcagatttagtttgtgtatcctttgggaaaatcttaaaaaaaaatacagaaagacattttatgaaatatatgtttgtcaatttctatagttaataatataaatataaaaataatttgtaaatgtcttataaatagtatttataaataatataaagcaatatattgcacatttacacacctctaaaaggtttaaatttgtcatattttactttcatgtgaagcttcattttaacttttaacacttatgctttttaaatatttactgcttgcatccaccagtatagagactagtattaatccacagactttttgctaaaactcaactatcttgataatatatgaggaggataagaattgatagtgaaaccctgcctgcctgagtttacaggcttatgtgttctagaattagaacatgtttcaaagtgctttttgaatattttttgtaaagtatgtattttgaagaaaaagtggttatttctacagaaatctttactattgacctttcttttacttgttgactcctgccctcattaaacttcatatgaaaaaggtgcctgaatggaatttaaattttctgaacttatctaaatctgaaaatctacctcagataggtgaaatttacattaattatagatttctagaaccggatgcacggcagtttttatcttcctctctttggtggcatttgatacatatacccagtgcccatggcaacagtgacccccaacttgtccaggaactgagatttatcttgccttcctctacgaaagcaattttaatggtgatgttaactcgtaaactttaaattagtcaaaaagtgatgtttgcttctctaaaaacaaaaatacttcctgggcaggatccaagcctattgcctttctttggagatgttagccatttaatttgtctaactcttatatagaattcattataaaccctgtctcagaactgtaccgacatttttgtgtgtcagtgtgtatagttattattttgtttggcaactttacactttcaggacgataaaatatttcagaaaactatttatgaatgatgtttatgtttagaaatcaatcagattgccttatttgaggtcacagaatttattgttttggttcccaaaaagtcttattttggcccaccaatgaatattaaatattggcttttttcttttaaccactaaatttgaattaacatatatatatgtataaattacaattatgatatatataacataattgtaattgattgatttgatttcaaatcaaatcaaatctgacctacatttttatctgtggaaaaatggcttttaactgaatggtatcgtattttcatatttgggaacatgtaattcattaattcaaacattatttaaaaaatcaaaatcacaacctgtctgttaactctttaattgtgcttagcattaaattgccctaaactaaaataaaaatcttaaatgagaaaaatcagtgtttagttagattattaattcctttccatgagatgattatatacttactgatttattgtactcatattagcactatagttctcgaatggtaaaatccgagatcctatgcacactagttgagagtttcaggacgctgattacgaaagcgttctttgccctatccttataggccaattaacttatatctgaaggtcagccaatttccagacaattgctctggactcaaattctagctggcaggaagcacataggctttgctgtaaaatatttctttttgttttctagagctcaggtgccaatgcttaagtgctctcttttcaacacttagttcaatggaagtaaacagttattaaacttcggtgtcaagggttattagacggtaatgcaactaactatctctacttttcatttaactattcatcatttgaaggagtgaagtaaggaaaacaaaagtctctaatttcccactaatagtgagaaaactaatctgttgaaaaaaatttctgtacccaatattcatgcattgtattggcttgagaaacccaggttttcagaaataataggtatatgagttaatagagaaataaacagtccactagtgtatattcagtcaattgcaggaaacatctttcatacgtaaatcagcatttaatataaatctctttcttatgctttctatttctcaattccctcaaacagtactatcggggtgccaacttttttccaagggaagtagtcaatatacttcaaggaaaactatactttgtaggtcatatggttgggggcaactcattactggaaagaaatttctttaagcaaacatattctaagatggagagtctgcattgtgctaagactgttggaaacccatgtacagtgtggtttctcattatcatcacacaggatctctgtggaaaactatggcttatattctttattcaaggctgacacattctcctgacattaagtcaaaacaatgtacaatcaaataactttcttttttacatttttacattgttgtctaatggaaaactatattgcttctttttccatctaccaacatccagtgaatattttgtgagtcaatgccagtaagaaagtataaagagaattttgatagatttgtatcaggtattttttagtggagaatttaaattatttcttaatttaaaataaatttaactttatttggaactaatatttttaaaactaactgggaatgtttattttgttcctacttgaaaaatttcttgtatacatatcaagcaaattatttccataaatttcatagaaaataagaaatgtgtgacattgatccggtgtacacaaaacagagctaacatgcatctttagaagaaaagatgctactttcagaggttaacaattatatagcccaatagaggaaatagaaacattttttggatttaaagtagtaatatgagttacaaaacaaaatttgtactgagaaaactgtcaccaaaaataaacaaataaacaataaagaagcaactaattaataagataaataatttaaaaattattctgaaaactgttgttttctacctagaaaaaaatacacagaaaccaaagagaaaatatacttataaaacaaaattatatgaataatttacacattcctgaaaaacaaaacctatagtgtaaaatatttatttaaaatacttataaaatataattaggaaaaaatggaaattcatagtaaaggtatgtggcataatatttcaaacattaaatatgatattgagatagatcttaaaacattaagaataacacaaaaaacatgaagataaaatatggaaaacaaaatatgtaattataaaagaatagacacatatgtatgttcaacatttgccaaatgaatgaatgatattggaaagtcaaccaaaaaagtctgaaagtttttatcatggagtaattcactcacttactctatttatttattcaataaatattcattggatatttattatataatttaaagattgatgaaatgtttcgttttgtgaaggcacttagagtttaacacagcaggatcaataaaaatgaaatataatttggattcaaagcaatacataagtggcatttctgagatgaggaaaataaaacatttatttctgttcaataaatattattatttatgttcaataaataaaacgtttattggttatataaccagtatgttcagagatctcacatataaagcccgtaggatgtcctatattcaaaggccttggggtaaaaagatgagtatgccaaagtctccatccgtagggaattagtttttactagacagagataagtaaacagttaaaatataatatgatacttattgtagtaagtaaaagcataactaaattgctgtgtatggaagcgtaataaacgatcatccattactgcacagaggaggaattgttttacctatattttgaaacagtaattaagatacatgcataaggtagtgaaaagggaaagagtacaccttctatagaagacatgaggacacaaataattgagaactacaagatgcaacaaagtctatgttcagaaaatggagaaatgcattatatttctgacaatttaagaaaagaaccattgtttctctctctttctactcagtctttaggtaacatattttgcaaaaagttcatatatacatgatatacacatccgtatataacatatacataaatgctatgtatgcatatacataaatgtactatatatagagatacatgcatacatctacatagacatatgtaaacatccacatatacacacacacacacacacatatacacacacatatgtacttgttgagatttaatatttccaaatgataatactgaagactttcaagaaaaaatattcaccaatagcaaaatacatatgaggtagctctcagtctttttgagcaacattaatactagagaaaaatgaataaaacttagctctgaaggaagacggctctgatataataggtcttcatttagctaagttttctttatataagaaggcagcaaaaatacctttaagtctgcaaccataaaagtatgtcacataattatcttttataataaattatcttgtgtaagtacaatgataagtgaaaagcaaatactcagaagaaactgtggctagatatcctagtaaacatcaaattcagttaagcacaaaaaaagatagttttgaataatgactttacaaattatatcaaaattacaaccttttccttgtagcaaaataattcataatacacaaagcaaaataaagagaggcagtgtttacaaccccacattaaattaactaaaaccggctgggcacggtggctcatgcttgtaatttcaccactttgggaggccaaggcaggcagatcacctgaggtcaggagttcaagaccagcctggccaatatggtgaaacccatcttttctaaaaatataaaaattagctgggcatggtagtgggtgcctgtaatcccagctacttgggaggctgaggtggggagaattgcttgaacccaggaagtagaggttgcagtgagccgacattgtgccagtgcactccagcttgaaggacaaagcaagctccatctcaaaaaaaaaaaaaaatgttaactaaaactgtgaatcagtatgtgtggcagcagaatgggacaaagcatagataattttcgtagagtagatatttcaatttttatggctgaatattcgtttttcagcatgatagtaatatttcaaacagaagctgataatacacattagtagacttaaatgtattttatctcccaattaccataggaaaatttccaggagtagaaagtaaataataaacaccaaacaatgtgaaaggagcaaggctaaataaagataagattcagtaagagaaaaagttaggacattgaaaaaatctactaaggcactaattataaaaaaatccaacaaaatgagaaatatgttgaaagtgaaaatatatataatgatttatcagcaaatgcaaagaaacaaataatggaggtaaagtaagtgtgattaataatatatattgagagtttacgtaaaacaaagtaattgaaataaaaacagttatttttatcaataacaccatctacagttaaaagacttgacaattataaacctttataatataatctgatgttattcaaactattaaaagctaaattgttatacagttgtcttatggaaactaccatgaactgtaaagggaaagataacaagtagagaaattattttggaaagttatttggcaacatatagtaataatcttaacaactcagattatctgtgctcagtcattctaattctagaaatctgtttttaaaatgataaaatgtgtgaacaaatatttataaataaatgtgtttactaaggccttgtaacaatgatagttgaatcacgatatgttcatatgatcattttgtgtagtcattataattatggatttgattatctttggtgccaggagaaaatgctcacaatagtgtataaacagaatataattagtaattgtcataattatagcatacttataaacacactatgttgaatactttttcatttaatcacactatgttgaatactttttcatttaatcttcactatagtttatgaagtagatactattatttcccatttacagatgggagaattgtgacacaaagaaataatgtacccgagtcacctgatgttaagtggtggacataggatcctggcagtcaaatacgctgtccataaaagctgggccattaacaacaaggctatgatggaaactgtgcaaggaatgtgtgtggaaagacaaatgacaggaaaaaataggaccacaatattaaccatgattgactctgggtgtattcataggatcaaagtttaaattgatcttcttcttatatcttctgcatattttataatctcatgacaattaatatgcattctttttctgaccacaagaagaaatcaaagagccaatcagaacataaaataaaaatgaataaaatcataattttctatagctccttatgacttttgaagcactttcatatttcttgtatctaattgaatccttataattagaatggccctataatttattacacaaatcatgatattttttatttgtacaagagggtattattaatgaaaacagtacctgggcaaaccaggatgtagagtcaccatatataaaacaattctgtaaggtcaacagtgcttaagcatcttaattgcgtttcagagctaaaaaaaaaaaaaagtatttcaaaggcttgatcaagtcatatgacaaaatagtggttcccgaatagacaaaaatagattgctatcactttgtccatgttttttgccattaaaacaaaacaaaacctctggtgacaatttcctcaatggaagaaagttttgaatcatgtagttgacaatctaggaatatctaaaattttatttgacttaaaatattaaagccactgatatttctgaaatgtcataatattacgctaagaaagctgagatttacaaaagaggataactaatacttgtgaatataggaaattgtagattcatgtaatattcatctgtgtcagaactccaaaaaaactagaaaagcaactaaccaataatgaaactagagaagtattttcagatggtaagttgagtgaacatttagctaaattatttttataaaagtaataatggagggtggcattatgtgaaatgggaaattctttgtattagttacttggttagaaagttgaaaactttctaaggttttattagatagacgacagtgaacaaatgatgtttgtcagtggtttcactggtagcattacacatctgaaaatcttagctattttgccaatttatattaaaaaaaaaagtaaaatctaagggaacaaatgcatgataggtattaattatggaccaggtatagaaaagtgacagtcattcactgcaaaatactatctgcagatgtgtcttgtttagccaagagtatttgcaaatgattttaaatttgaaacactttggccgggcacagtggctcacgcctgtaatcccagcactttgggaggccaaggcaggcggaccatgaggtcaagagatcgagaccaaactggccaacatggtgaaactaaaaatacaaatacaaaatactaaaaatacaaaaattagccgagcgtgttggcgggcgcctgcagtcccagctactcgggaggctgaggcaggagaattgcttgaacccgggaggcagaggttgcagtgagcagagattgcaccattgcacttcagcctggtgacagagcaagactccatctcaaaaatagataaataaataaattaattaatttttaaaaaattaaatagtttaagcaggtcaacaggcattctagttttgacacccctccatccttccctacccaggtccccagcaggccctctactagccctggtggtgccttaccggaaactcaactaaagcacctgctctgggaacatgcagccccaaggcacacagctgttggaaaagcaggattgggattgtggcccctcctttctactgtgtcttgacattttgtgagatttaaaaattgcacatacttgcatagaaattcttactacggccctgtacattatcatgtttcacattgatatgaccggcttggctcctgaagcctttcattattgactctgaaatagaattaggctccatctttaggacattgtcataagcatagtctaatgtaaagaaatgtaaattggccagtaggtggtttagtttggaaagaatactgaattacttgactttttccttcctaacaccaacatcaggaatatacagaatttaatggtgagaggaaaattaactccatatgaggaaatatggcaaagagattatgctgatgggacctttgttagcatatttagttagaacagagtaaataatacctgctaaatcaatgccattttaaaaagacttaatttatatacaaagacttattttaaagataatttgatagttttccttttctttgagaaaaataagttggatacttgtctaggagagtatggaagacaaattttgttattgattactcctgggtatgagacagtgaggaaaaagaactgatttcacatcttcttttgcctctgctcttccttgctgctgatcattgttatatgatagtgcaatggtataagtgtcaataaaccatctaatgaatgcattttgtgacatcctgtgcttacgtgtttcttctggaggcttatctgcattatctcatagtctgtgttcagtgaatacaaaatgtctaaacactgtgagtatatgacctaatctatcagaagatattagttaaattaaaattcatattaaatggatcacagaagaaagtattggaatgtgttattcagatcagattttactgtcttctcctttcttgggagcactttaaaaggtgcaaagatgcgtttttaaatctccaaagataattctgggcatggtcttatcccaccaggggtagtgcaaaatactattcaatgcttcccttaagcctacctttacctattaatttatcttggatccctagattttgcgctgtcttttagctttgtctgtataatatggcatgttatctttatgagaggatgaaatagatccattacagtaaaagatgtatgccattaatgagtttctagccagctatcaaggtatcatcaaatgtggtttatcttggtgaatgaaagcttgaatggaaaattaagctcccacactgactggagaagttcagtggatcgttttgttctttaatgttacacttcactgaacacacttcacagagccgtgaatcatgctttaaacaagctgcctttactttaacggcagcagacaatgcagcaaaggtgaataataagtgttagcaatcttaactttcttttgcagtactctctaccacgtgcctgatggacaatttacaaagtacatatgctattttatagattggaacgtgggatccagccagtggcctgaatatgacagaaagtcaaaagggaaagccagcgaacatcacagattccttatccaatcgttctttgattgttaccaccattttggtaagtatttgcttttccattattcttagttaaatgtagatgaacacagaagtgcatagaaaaggacattataattggaacagcaatgaacagaatgtattttacagttatttagcaattactgtacaacagatgagtcaatgttaatttagtcacagttttgttagtcttaaatgatctaaattgtattaacgtttgggctgtttatgttgactaataatacagcttaatgtattactggaaatcttttcatttttccaaaattagttactattgaggaattgtcaatgtcaagacttgaaaaatacgtgcagctctataaatatagttaagtgatgagccaaaagtgaactttgcttctgcttttattttccgcaaatatatttcatagggcatggcacttatttttcagaattttttctcattataattatattttaactttattttcaattttattgttttcatcttggaaaattaattttactttatgaatttccctaatgtaaccaaatggcaagtgctttttaaagccagaaatattttcagcactgacagacttaatattgttaagctagatgtttttacccctcttatatttatttatatcttttaattagatcacacagtaatgttcgcttatgcccactatgtcatttgcaaaagggaattttaatttaggataagcaaatagctcttacattatttagtcagtacttttcacctaccaaataagcttatcaatgaccattcttattaatcctcaggtagtcagtaaaaattgagagtaatatctagaacaaactaccatgaacatttagcatttatataatttctaaatttgatttatggtgggaaatcaagctatgaggaatatatattcttgcccctttagtagcaacgagggatgtcagatctgtaggcatgtcaaaatgaagtagcttgggttaaagccttttgataatgaagcaaagctgataatcatgaagtgacagtgatgaaagtcataaagtttttaaccaatctgtggctaaggacctcagtggatactcgctctctctgtcacatccaaacgtctaagacacccttttacttaattttctatcttcctttcttttcaaagataactcccatacccaccaacctagccctcttcttcagtcaaaatgttctcacagtacaattacacatcctctttctgatctacatgccactatgttctggatctcattacttcctgttgggactattgcagtagccacgtaactatttcttctgcctgtggctttcctcctttgcagtgcacccaagtcccaccataaaagtctaattctgttccaggcaaatggtgactgcttgaacaaggacaacatcaacaacaacaacacaacaacgacaatctaatcctgtcatttctctacttctttgttatacagattgttagagaatccttattgaccattaaaaagccaacaaatttaaatttttatatatagggtcctctatggtcttactctctctcacctttttatcttcacttcccattattttctttcaggaaccgtgtgttttaattgaattgggataaccagttagcctgctacatagttttgtgaatgctcttcccttgctctgcaatatgcttatctcaatttctgagatatagtattcatcagtaatatatgacttaatattcatattatgctattcttatttcatgtgtgcattattttcccaaatatcactaaacattccttggaggaatagaattagattatgtcttctgtttctataccatatgtacctctgcaatgatcataggatcaataattctgggtagaaaacatctgtagccttcagtaatctggcccctacactcctttctatcatcttcctgatctagccaaattcctcaaaacatcacttattttatggctccaaatcttcgctcaattcttcttcttctcctcctccttcttcttcgatggagtcttgctctgttgccagtctggagtgcagactcatgatctcggctcactgcaaactccacctcccaggttcaaacgattctcctgcctcagcttcctgagtagctgggactacaggcgcgctaccactcctagctaatttttgtatttttagtagagatggggtttcaccatattggccaggatggtctcgatctcttgacctcgtgatccgcctgcctcagcctcccaaagtgttcggattataggcgtgagccactgcacccagcctgctcaattcttctttatgttctgcagtaaaaatcctattcattttcttgtatccatctcaaatgctacccacttcatgaaaatctttgacagctccattaagttgcctgtgtcttggggagaaggaggaagtttgtatactttatgtaccagaatactccatcatggcattatcatttttttaattaaaaaactatgtatgtttgtgtttccacttgacataagctctataatcaaattttacactttctgatttctcaatgtcggagaaaagtgccttgggtatagcaagagctcaataaatatttgtcaaattaaattaaataaatgatatttaattaaatgggaaattagacgaagtacagaactttcaaatgactatatttaaatatttttcaagtgtgcaggttattaaaattatctagtacaaataaagcaggtgattaagagtacccatataatttctcaatcttgcttcagtattcagtgttattttttgagaagtgttcagatattgcttctcaatcataatcaagtttatatctctctatgaagaagtggtatctaattttatcttcatatcagagtcagctctaaagctttaataaatacactaatgcctaaaacgtaccccataccatttgaaacagtatttctggactttgaatcttggacactttgatttttttaattttcacaggtaacacaaatctataaccatgattaagaactatagctcagattattactccatatgaataagatgtaagatcaactatggaagatgcactaagctctcattttaataaacaggttatttatattttagagtatgccaactacttgtttctaaaagatcctaatatttcctaaaaggataaaataaggcactttatttttataccttttagttaaaaaaaaattcctttttctgaatactctgacttcaacatatccatagtcaagtaaagaacagatttgaagagattatgtaccttatttatgtaagcttatttttgatgtaatttactggtattctatttgtatttttggagaaattatgattttttgattgatgttatgattattttgcccttttctcttgaaatatcttagaggaaattctggctacattatgaataatgacatttctcccatatccctatcatgggaaggagatacaaggagatgttaacttgtgcttcttgttcaacatttttattacgtgtctttaaaaaatgatgaggtattctggaattcagcactatccacaagctaattataatcagctctatttctcatgaattctattcattcacttatttaattttattcattattttatttgatgaatatgtattgaataataatgatatactaagcactgtatttaaagctaacaaaatagacatgatcgcttcccttattgaacttagaaaatggcaggaattcatatggagagttttacacacacacacacacacacacacacacacacacacaaacacatacaacttataattaagatataaaagaaaagtaaatgatacggtgccttaatatacagggtaattttgagttatactagatgtcaggagtggaagggcaagtcaggttaggactcacagtagaagaatagacagctgagactgagagtttgaggaggaattagcaaggtgaagaaagggcaagggagtattctaggcgaagagaacagcatattcaagcatcctaaagcgggaaagggcttggaaaattttgtggaattgaaagaccattatgactggtgctaatgcctcgatctgcttctcagctgcttccagtataaatgtatgaatatggtccactacaaaaaatcatagcagacatgtattacatgcctactgtgtcccagacatagtttgaaacactatccatggatttattcgtttacttgtaataataaacttttgaagtagacactattagcaccattacttatttatagtattatatatatattttttcttttttttaggttagaaagctgatgtttatacagcctaagtattttactcatggccatacaactagaaggtggagtagttgtagggtttcaaccaatctgtttatccaacctgagcagctgatactataaaatgaaaattctagtggtcaaatatagaaaaggctaacacttatagtttatgatcaaaatagcatcttgattgataattatttacctaaagcaatgtttctcatccagaagtcccacatatgctagaactttgtgatgcccttagagatgtgcctccaaatatctaaacattttttctctacggagaacattatttaggctactcttgcgtgaatatgttgggtttctagtctctgcactcccctcatttagtacttagttttcttttactctctttaaactataatctcagattctcctgggcaatcaagacggtataggagctcacttcattttttctcttaagaattgcaatgtttacacatgtttttactccactttaataacatgacctagacccagtacattgtacgggtacagtacatagttgtattatgcagtaaatttacatagagagcattaaacatttattttatatatttttttatttttgaattaagatttatgatataaaattggagatttatggatcgtcaactacaggtctatgcctaaagctcagctctatttatgccctaattttattgtttgtgattttccatattgcctctttcatctttgaatttcaagttcggttgttgttaaaattctctgtttttttgtgtttatcgttattaatggaactagaactattatctttcaaattatattttcatttatgatgattttatttattgcatagaggttgttaaaatatgagttcctaattgtcaaaaataataacaaaaatacaatttttgagcaagtagtagagagattttaaagtataacgtgctaaaccttcagtttgtaacctggtcttgttgctgctgctgttagctatgggaagtatcaggggactaagtattattttatttatttgtttgtttatttctatgggttttcgggggaacaggtgatgtttgtttacatgagtaagttctgtttttttttttttgtttttttttttgatggagtctcgctctgtcgcccaggctgcagtgcagtagcatgatctctgctcactgcaacctccgcctcccatgttcaagtgattctcctgcctcagcctcctgagtagctgggattacaagcactgccaccatgcctggctaattttttgtatttttgtggagatggtgttgtatttttgtagagacggtgaccatgttggtcaggctggtcttgaactcctgacttgtggtgatcttccagcctcggcctcccgaagtgctgggattacaggtgtgagccaccatgcccggccatgagttaactctttagtggtgatttgtgagattttggtgcactcatcacccaagcagtatataccgtacccaattttgcagtcttttatccctcacacccctcttgccctttcccctaagttcccaaattccattgtatcattcttatgtctttgcatcttcatagcttagctcccatttatgagtgacaacatacagtgtttggttttctattcctgagttacttcacttagaataatggtctccaattattcaagttaatataggaaatgcctactttttcctctaaattcttagttttcgatagacatttttcactcctgtctgactatgttgagtgtttctcattgtgctatgcctgtataataattaatttttgtccatcaaaagattagtagcatttaaatgctactgcacatgttccttcttttgttgactagtaacactttagcatacaaatgactatgcatttggttactttttcagaaaagcatttattgtcaaggagattccttctccccagtggctcagtgaatttaacaaatgtacttgctcctgaaaacttagtcgtattttttattttcccagtactttgtggaaggtattacagtatccactttacttgcttaagcttgtaaagcttttgtgtcacagcccacagatacggaaggcttactgggaagcaaatttccaatgacaattgaaaagtacacagtacaaaagagagaagtgaccgaattatcccctaagtggttctgtagcttcttctataatatcaacaaaagcagtttttttctaaggcttcaaatctgccactgcaataagttttccctctgattctcgtctttccattgtggtagaaggactgtcaagcatgaagttcttagagagttgcatagcatttgggcttggaaacccagacactgcaacttcacaaagaagaaaaatattttccttctcagcaatctcagtcacatattaaaatgcgagataagagtgactcattcaaactaaagtcttctccaaccccattcctacaatcagcttgttcagacaaccacactttttctcaccatattttttcttctatttcagagattgtgctggtactacatttctctctttcattcttgctctgataactcagtgtgttttatttcaaatgtattttatttctcatattttcagagacttccacaaagctagtcaaatataaaactattgatggtggtagagaaagaagaaataaagaaagtcatgagttttgatgtaaaattaggtataattttgaaaatcctagggtcttaatttctaaagccttctaagtgccagaacctcattttttacttcatatacacattctttttcctttgtcctttattaaatctgacttaaattaactaccatgatgaagacttataagcagttttgcctttatgttattttttattccaaacattattgtccatactataaaattgacaattttataattgtcaatactaaaatggttgaagactattttattatgatcagtatattaagttttgtataaaagaatgaatagaaaaatctgaattttgaattcagctcagccactagcaaaatatgtgaaaatgaaatatttttgccttaacattctcatttttttaggaagatgttatcacaataggaccatatacacttgtacaatctgaattttagctacaaccttgaactgagattcaaatgtaaatttgcaattacttactggacatatatccacttagatatacagtatcatgctccacatgcatcaaacctccttctttgattcaggactcacaatgctgattttgcctatattttcaatctctatttatgattccagtacctttctattcaccccagccagaggtgtgttttcttagattcctcagtccctttaaaacccatactcacaattcaagtacctaaaggagaaagagtagattattctaagaaagttcaacagagaagtaatcaagaacattttgaacaaatgagatatgatttgttcatgggtactactgaatgggtgattatttttagagtctgctttgagaggcactgtacttataggaaagaggaaagagatggcaacattaaaaactaagtataaggtttcttgggaatgcattagatagggcaaaaatctattgaggaatgtggatgaagacgtaaaggttaaaagcctagaagcagggatgatagcactgccacagcgtgtgatggggatggtgggaaaggagatgatgaatgatactcaagtatgtatggagatgttggcaatgacttttgagcagtcaaatcttgattatttatgtaaggggataataaattagattcagagatgaaatgctgtttggagattagctaataggtacagtctcctttcccatcaaaccttttactggaaccacaatgaaatagtacatttgattgattcaaacttcagctttttctttcttactatctttcccttgtaaattaaactacccaaaattttaatgaccaaaatagaaattatcagcagaaagatagtaacaaccaactgaaggaatttaatagcataccatttaaaaaaaatgacgttttttcttaatacaagcatgaatgatagtcactatgccgaatcctcccttaagatatattactctgacatcagtaaattcctttcttgaaacattggtgaacagcacaactagcaaaactcaccttttttttcttgaaagtcgagttcaactattacacaatcattatttccataagactcactacaatttccagtaagtaaatattacttttcagggagaaagaagttattctcatcttcccaaatcccagtagattttctatagttacaggataaaaacagaaacttttcttagaattataattatggccaacaagacttagatttttgtacattttgaaattctctaaagttatgtttctgaaataaggtaaatacagtttgcagaaactacgtatatgattatgcttgcatagtttatgaaagatttatgtgtgtgtaagtatgaaaatcactcctggcaaagattgcctttgcttaatagacttgaggaagaaagtagaaaagaagaaaataaaagaatttttctagattgcctcagaatgtacttgaattttgtttaaaaaagtaaataataagcatggtttattaaaaaacttattagggttattgctctataagcctggcatactatttgtttttgctttaaaacatagccccacattggattaaaaaaacaaaacaaaacaaaaaaaaaccaatatcagtctttctgctatcttcagaagaaccatttcacatgtaatgacacccatagactcaaaataaaaggatggagaaagatctgtcacacaggtggaaaacaaaaaaaggacagggattgctatttttgtattagataaaaagataaaatagacttcaaagcaacaatagtacaaaagtacaaagaatgacattacataatgataaagagttaaattcaacaagaagatttactactctaaatgcatatgtattcaatattggagctcccacgttcataaaaccttacttctagacccaagaaaagactttaacagctacacgatagtagtgaaggacttcaacacaccactgacagaattagagagacgattgaggcagaaaacaaagaaattctgcacttaaatttggcacttgaccaattggacctaataggcagctacagaatcttccatccaaaacccacagaatatacattcttctcatctgcacacataacatactctaagattgaccacaaacttcatcataaagcaagtctcaataagttttaaaaaactgaaatcacaccaagcatcttctcagagcacagtagaataaaaatagaaagcaacaccaagaggaactctcaaaaccacacaaatacatagaaactaaacaacctgctcttgaatgatttttgtgcaaacaatgaaattaagggagaaatttaaagaaatctttgaaatcggaaaatagacacacagtataccaaaacctctggaatgtgtgaaaagcagtgataagaagaaagtttatggtgctaaatgcctacatcaagaagatagaaagatctcaaattaacaacctaatctcaacctaaaggaactagaaaaacaagaacaaactaaatccagagctagcgtaaaaaagaaataactataatcagagcaaaactaaatggagacccagaaaacatataaaggatcgatgaaatgaaaagatgggtcttcgaaaggataacaacattgatatactgctagctagattaacaaagaatgaaaagagagaagatccaactaagcacaactgaacacaacatatgtgatattacaactgattccacagaaatacaaaagatcctgagactactatgaacatcactatggacacaaactagaaaatccagagaaactgaataaatatctagaaacacacaaccttccaagattgaaccaggacaaaacagaaatcctgaacagactaataatgagcaaaggaattgaatcattattgctgatcaacccaaaaagctgtggaccagatggactcacaactgaattctattatatgcacaaagaagagctggtgcagatcctactgagattattccaaaaatttgaggtggaaggactcttccctaactcattctataaagcagcataatcctgataccaaaatctggcaaagatacaacaaagaagaaaactataggccaatattcttgatgaacatagacacaaaaattctcaacaaaatgtaaccaaacaaaatccagcagcacatgaaaacattagttcaacatgatcaagtaggctttattcctggaatgcaaggatggttcaacatatgcaaataaataaatgtgattcaccacataaacagaattaagaaaaaaacatatggtcatctgaatagatgcagaaatgcattcaataaaatacaacatcatttcataataaaaatcctcaacaaaccaggcattgaagaaataagaactgtcaatgctaaacccacagccaacatcatactgactggggaaaggttggaagcatggcccttaagaactggaacaagacaaggatatccactctcaccagttctattcaacattttacttgaagttctagtcagagcattcaggcaacagaaagaaataaaaggcatccaaataggaaaagaggaagtaacattatttctcttcactgaatttatgattttatacctaaaaaaccctgaagattcctccaaggactcatagacctgataaatgacttcagcaaagtctcagaatacaaaattaacatacacaaatcagttgcatttttatacaccaatagcattcagactgagacccaaatcaagaatgcaatcccatttacaatagccataaaaatataaagaacctaggaatacacctaattaaaaaatgcgaaatgtctttatgaggagcactaaagacaaaacaacaacaacagcaacaacaaaatcacgctgaaagatgacacaaataaatggaaaagcattccatgctcatttcatgctcatgagttggatgaatcaatatcattatattgtccatactgcccaaagcaatctatagattccacactaatcctgtcaaattaccaatgtcatttttcatagaatttgaaaaagaaactattctaaaattcatattgaaacaaaaaagaggctgaatatctacggcaactctatacaaaaagagaaaagccagaggcatcacactacctgacttcaaataatactacaaggctacagtaaccaaaacagcatgggattggtataaatatagacacataaaccaatgtaacagaatagaaaactcagaaataaggctacactcctacaaccaactgatctttgacaaaatcgacaaaaacaaataatggaaaaggatatcttattcaatgaatggttctgggaaactggctaaccatatgcacaagaatgaaactggaccactacttttcactctatacaaaaagtaactgaagatatatcaaggaaattaaatctaaggcctcaaactgtaaaaatcctggaagaaaaccaaggaaatatttttctagacattggccaaaaatttatgactaagtcctcaaaagcaactgcagcaaaaccaaaaattgacaagtgtgacctacttaaagaagttctacatgcaaaaaaatatttgcaaactatgcatccaacaaaagattaatatccagaatctaaaaggaacttaaaaagaaaaggaaatatccccattaaaaagtgggcaaagaatatgaactggcacttctcaaaagaagacatacaagaagccaacaagcatatgaacaaatgctcagcattactaatcatcagagaaatgcaaatcaaaaccacagtgagatgccatctcacaccagtcagaatggctattattaaaaaagtaaaaaaaaaaacccacagatgctggtgaggtgggggaaaaaaggtaatgcttacattgttggtgggaatgctaattagttcagcccctgtagaaagcaatttggagatttctcaaagaattaaaaatagaattgccatgtgactcagcaatctaacacagaaacagaaaaccaaatactgtatgttctcacttataagtgggagctaaacattggtacacatggaaacaagatgggaacaatagatactggaaattccaaagagggagggagaaaaagagaaagaaagaaaggcttgaaaacatcctattggataccacattcttggttgacagggtcatgagaagcccaaacttcagcatcacttagcatatccatgtaacaaacctgcacatgtaacccctgaatctaaaataaaaaataatttaaaaataaaacacaaactctagattatgatagttattccttttatatgtagaaagttcatttgaaagtgattttttaatagtatcgagatatcaaaataggattttttttccagacaataaaacatatatgagcccatgtggagataattatcatcagtagtttttgattttcacaaaccagtcatctccagtgttgccttttcttgaaaacattgagttgtactgatggtagcttcgaggcttcttttcttgttcttcctggtattctcacttctaattttgataacctgtggtgcaccatggcttctgacatgaacactaattagggatggcagaattcaggcttgaagagccacagtgaataggaggaaattgaaagatggactcagacaatgacaagaaggttcttagctctacagaagtaagagtacatttgttggaatgacagatactgaaaaagaaataaaataatactgtcctgtcagtggaataatatcaatcaactgttattattatttatagttacctattattgttcttgttggtcatttcttgtgactgtgaattagaacttagtttttggcatgtccaattcaatttctgtgtattttttcctgtagcatttacgggagtatgagttattgatatgcaatgaaaatactagtagttaaggttattgtcaactaatattcttaaatatatgacccctttccaattttgagatcacagttttgctatgtacatttataaaacttaaaaaatttaactgagaacaaaataactgaagactattttagaatgcctaaaatatagtttagattagtggtggtatttattaaaataatttaaatcacaagcttggtatcatctgtaggctctggaaataaaagaagttatcagtctttataaatgttaatgatactagattcccattaaatctcatcaggttaaaaatacagttttaatgaatgaaaataaatgcagtataaaggaatcatttacaaataatgtaataatctttacttctgcatttctttttatataatttctgaaacttttctaaatgatcagctaaattagcacttaaatatattttgttttctaatcttgataaatttgaaactcttttaaaaattgttttacagttataagactcacaattttagtcacgctcattaacaaataattggctatctaagaaaaaaaccccaaaactcttttatttctcaccataataataaataattttatgaaatgttcttaaatagtaaaaaagaaacattttctgaagcaatttaggataaatgtaagaacaatcatttccaaccaataatcacaaattattaaaagttaggccataagaatattagctcttcattctgcttgacagtatttgagcatggcttggcttcttacttggcaggtggcctggcactcctatgccagctgtcaagctgaagacgtggctggacagatactttagaagagctacgtatgatgttctgagtgagatctaaagaaaaacagaaactgaagaaacaaaacataaagtttgcctgcattaagagcctgtttttctgtaatatacatttcatttttttaaaatcttgaacccactctttcaatacaggtgcccattattataaattctggttttggctttagagttcaaataattcaaattatctgcaaatctgtaatcaaagaactgtctagatgtccataatgaaagctatcctcattactactgtgaaatatttgcttcatctcaactttccgatgaaattctcatgaaaattcagaagaaacaacacaaatacaattttaaaagtgatattttaaaataacgttaaaggagaactatcacaatttcaatagaatacacaaatagactttattgggatagatttctgtggttgaatgtttttaatgctataaatatagaaaaatatcttatttttgaatttttttcttatcttgagtcaatttatggaaatgctcctgtatttaagagatttacaattaattgttcattaattatatgccctttggtgagaactttactcttcatgcctgatcttgtttttcgttgttgttgtttgtttgttttgttttgttttgagacggagtcttgctctgtcgcccaggctggagtgcagtggcatgatctcagctcactgcaaccttcgcctcccaggttcaagcaattccctgcctcatcttcctaaggagctggaattacaggtgcctaccaccatgcccggctaatttttttttgtatttgtagtagaaactgggtttcaccatcttggccaggctggtcttgaattcctgacctcgtgatccacccacctcggcctcccaaagtggcctgttcttgttttaacagcattttcttttattattcttaacaatgataatagatttatgctcaagaaaaccttttatttatactttttcaataaattatttttcaagaatgggcactaaatacaaatgaataacttgataatctacagagattgtcattaactttcaaattgtacttattatgattaatatattaattaatttttgaatggcaaaaatacttatattccagcaataagctattattggtaatggttaaaaaatattctcatgaactgctatattttgtttgctctattatatttaggtatattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctggaagaaatgcttcagtagctttcataatttattttatgcttattggccttttcattttattgtttctttttgaatcaattttatattgtgcactgatatataaccaggtattcaaatttattaacatagattttcacataatgtcaccatataaattttataatctcaatttactgaatctctttctcacataaaattctttgaggcttaaaatttctttcccttttttcttaatttggttgatgaagaaatttattttattactgttgcttttactaaaagacatgtttactgtttagccattttcttccttcctactttgtacttcactattttttcagcattttcttattatttttctttctgctatttgggtttttttggagcgtctatttcccagcctcttatgatttaagtactccatttatttatgttgattttaatcacttagtggtaagttcatatgaggctgaacttttctttcacaagtcttttgaagatatttataaattaaaagttgtatagctagtgattaccagagtgctttgaaatcaagcagaacactcatcgcttaaatcaaaccagactttggatttcagataacagttatttaataattcatttaaataatacactttaaaaaactacttttaacatctacacatttctttttatttagggaaatttagacaattttgtttattaaagctagtgttcatggtttttttaaatatcaccttccagggcagacatggtggttgggatgacttgacacctgaagttcaagagcagccagggcaacataggaagaccctattactacaaataataaaataaaaaaaaatagccaggaattttgacatgcacctgtggtcccagctactggagaggctgaagtgggagtactacctgagcttgggagatcaaggctagtgagccatgatcttatcactgcactccagcctgggtgacatagtgagaccctgtctctaaataaataaaaacttacatacatacataaagtcaacttccacattttttgtcccttaacttgactagtgccaataagtatctttaaatgaagtgtgtatgtttactaattttcattccattcatttattgcctggtgaagtgactgaaacattaaattttttcaattttcacatttcctcttgaaagcaattttgatatttttttcattggtttaactttggttttattctggctagccagttttattttaacttgtttaaagcttacaagactattctccactttatgtttgtaatttgtttttatacgttgatttttgtcaggctgggtttaagtaagggtgatttaaatttatttgacagttttctatgaaaatgtcattccttcatcctccaaaattcttaccaatctgaaaaaactacccattataaaaagaggtacagattacctatgagttccttttttttttttttttttttttttgagacaaaatctcactctgtcgcccaggcaggattgtagtggcatgacctcggctcactgcaacttccatcccccgggttcaagtgattctcatgcctcagccccccgagcagctaggattgcaggcacccgccaccacgcctggctaatttttgtattttagtagagatggggtttcaccatgtttgccaggctcaaactcctgatctcaggtgatccacccgcctcggcctcccaaagtgctgggattacagccgtgaaccatggcgcccagcctatgagtttcttttatgtctttggaagcataccctgaagttatatgttttcctgctgcaacatggctttgttttcctctagcctctgaagtagctaggactttttttcaccatactcctgggaattttctttaccgatcttctgtgctacagccccatttcctggatcttattcttgcatttttcttgaattattttctcattttgttaaaggctgtaatagcatcctgagaaaggttgctgagtacaaatttaagaccttatatgcccaaaaacattgagtcttccatgaagaattataggttgaatttttggggaggcattactccattgcctttttctgctgttgcagttgttcacaggtcattctgattcttaaccttttgtatgtggcctgtatttttccttcctatgaacaatttcaagattgtctctatttctgaagcttggaaacttcactaatgatatactcttgtgtatagaattaaaaatgaattttaaaaatttaaaaacttcattatgttgaacattctctagagtcttgatttgtgccgtccaatacggtagcttcgtcacatatgactattaaacacttgacacctggcttgattgaatggagatgactgttagtgtgaaataaatactggctttcaaagacatgatatttaaaaacgtaaaatatcttaaatttatattgattacatgttgaaatgatagtgataatattttgatatattaggttaaagaaaataactgatgaaattgaattcatctttaactttttaaaaatatggttattagcagaagctacattatatgtgtgctcctttttggggcttgttgctatatatatagttatatatatatatatatgtatgtgtatatatatatatatatattttttttttttttttttttttgagacagagtctcactctgtcacccaggctggagtgcagtggtgtgatcttggctcactgcaacctctgcctccagggtttaagtgattcttctgcctcagcctcccgagtagctgggactacaaatgcacgccaccacgcctggctaatttttgtatttttagtagagatggggtttcaccatattggccaggctggtcttgaactcctgaccctttgatctgccctcctcggcctcccaaagtgccaggattacaggtgtgagccaccatgcctggcctgttgcattatatttctattcagcagcactggtccagaatcttgttgggcatattcaatccagaaactcagttccttcagtcttgagatattttcttaacattagttaacatggtaatttcctttccatcatttctcattgtctgtatcactgagtattggtcatctgacggttagacttccaagtaccatgtaaacaatagatagattctgtttgttttaaacattgatgtccaggtctcacatccagacattcaggttgatgaaacccagacagtattgtctgaaatctccctacatgattctactgattgtctaacttgcagtcgtgtgatgagtaagttctggagatctaagctacaacatgatgagtattgctaatgatagtatattgcaaatttgaaacctgttgagagattagatcttaactattcttaccacacacactaagaggttaactgtgaggtgatggatatgttagtcaactttgattgtgttaatcatttcataatgtatatatataccaaacattgtttcataagccctaaatatatgcagtttttatctctgaattatacctcaataaagctggaaaaaaagaaaaagggaaaatagtctggggaattaattttaggctgatgcacatttttatttagtcttctagatttcaacatagtgcttaatctctgcgaatctagagccacttcaattcaattacttcttcagttttctgccagggtcaggacaaaaagaatgggtagttctccagaaatgggttgaaatttctacctaatttactacttggtacagattatggacctctgaacacggacttttgttggggagaagaatgaaatatttcttgtactgtctctggttaatcaaggattattggtttcctggggccttatatttagtgtcaattcttcaaaaatgataggtaaagttctttatggggttcaggacatgctacccccaaatgtgtctccgtggtattaagaaagtctaggaaggtcactttcttttccccttctcccccaaagcacgtcataagactctcatctgagaggtaccctccctacacttggaagaaaagaacatccttatctctgaaatcacagggacacagagaagaatatgaacaaacagttcttgctaagtttccctcagtttattactgttagatcctacccttttgttctcaaatcctatttccccttaactgtccattcttcatcaaacttaagcataaaagtacataagtttacttcattttggagagtcttcatttctgaaggtttccatgtcatgtaaaacttgtattaaataaatttgtatgttttgctcttgttaatctgtattttgttatagaggccacagccattaatctagtgatgggtgaaaaaagaaatcaacccaccaagattccttaatcaattgcctgtaactctatatattttcaatgtgtaacaaaaaggtcatggattccagccacatgtgtaagccaagttgaccaccctgctgtgccagtggaaacacactgtcacagtaagactgtggtattacctacgtatcaataagaccacagacggaattttgtatctgcaatttttccatttcaagagttcatttattttaaacataattcattaccaacagctaaccctctttttttcactctattaatacaacttttttttttttttgagacggagacttgctcttgttgcccaggctggagtgcaatggtgcgatctcggctcactgcaacctctgcctcctgggttccagcaattctcgtgcctcagcctcccaagtagctgggattacagctgcccaccaccacgcctggctaattttttgtatttttagtagagacgaggtttcaccattttggccaggctggtctcaaactcttgacctcaggtgaaccacctacgttggccttctgaagtgctgggattacaggcttgagccactgtgcccagaaatacagcttatttcttaaaaatagtctggaatatgcttttttttttaattgaatgaggctctttttgatgccaggttcatgctcctgcaccagttttgtttgtttgtttgtttgtttttacaagaatgcctacaacttaccagttaccttcaaacacaattttttgtacatatctgaattttgtgcctacaaacttttagcaagactccaggctactctgactttcactgttctgaatttgtatctttgctcataacctcacaactactttggttgggtgccagtagaggcaatgccagtgcttacttttcaccaatccttgagctgtatttggtttaggaatatgagtctattaggtgaagaaggaatgtaagatatttcagatagtggggaaaagtatatttgaaggcacagatgtgtgaaagagtttaggatatatgaataactctaagtagtctaccactgatgtagcacagaaaatgtaagggactggtgatggatgagtgtgaacagataggcaacatcaaagtagaaagcctttgtaagtttcctgaaggaatttagtttttatgatattaaagaaattttgaaggatttaaaatacatgaacagtatgatcaagttgggggttttaaagatcccttttagttttgaaggtggaattgttgttcactggacaagatttggtgagaacagccaaaaaatattgcaagaatacaagctgataagatctgaattatggaagactctaaagggatgagggaaagaaatcagatttgtaagatatatgggggaaaaatgaagaatatatcatttgcaaattggactttatgaagtcagaatttaggaagacatctttctgataaatatgactggaaatgggattgaggtaaaaaagcagaattgaaataatacaggatgaatttaattttgaacatattgcattttattttcttgtaatatattgatctagttggcagttagatatgtaattccagagctcaagagaatgttctggcttggagataacttttggagttaagatgatggttggtctcatgaataatggtgtgatagttcactcagggagcacatacgtgtttcagtacatttacactattggacatttctttcttctcctgacactatttcagtgattctgtcctaaaacttactgtattctgtttggtttgacaaacaattataaattatgggcttccaaagaaggtaaaaagcatctgggattaaaagaataaaatgtcctttgagtctggctcacaagttctttaagcatattgggaaatgatgattgtaagatgacagccatgagacattcaaaaccagtaaatcctgaatatgtcagatacctgcaacctaacttcatttcctgatacttatcggattcccaggtcctgatctctgtgttttcaactacaacttgagtacttgacattgatttctaattacttctcttcatttgagatttattggatactcttaatgacagactatatcctgactccaattaaccccactacagtgactcaaaaagaaagttacagacttcttcctctcatagaaaacacacatattttgtcttgctggcatcactggaatcagtgctttaacataaaaatccacaataacagatgagtccttggtttatccatttatcagtcaattattttattaggcatatttcttattaggtgtttatatatagtgacattaattaggtgcctaacctggaatgaatattcttaacttgaatcctataaattttatattctgagctctcttagctttagttctacatagtaattgattaaaaaaacaaacaaacaaaaagcatgaatttattttaactactttgagtaatctcatattggaaaagcaaacaaaacattttttcactacttcatcagaggattaataaaagaaagaaatgctttcgccatatagttgtttgaaaaacatttcatgttatatgaagaataccttatgctacattcaaatataattatagccaaaggcactaaaatatttattttcatgtatgtcacagctttatgtctttaaaaactcaaaatttgtatttgctgtttttaacttttaaatttacattgttggcaagtatgatactccctgaccttgaagagaaacaaaacagtaccttcaaagtgaagcacacactttttgtgccctcgagcaatagcattccgtgtttactatttgtttacatcagaatttcagtgtgctccacagttctgataggtataaatatataggcacaccctaaaactatcctgtacttaaatagattttagaggatactgggttaagcagcaaagtttgttaggttttgttatcactgaatgtttaacaaattcacgtgcattgtgaatatctcagaatgattttttttttttggtacggtttctctctctgttgcccaggctagagtgcagtggagcaatctcagcccactgcaaactctgccccccaggttcaagctactctcttgcctcagcctcccgagtagctgggattacaggcacccaccaccatgcccggctaagttttgtatttttagtagagatgggggtttgccatgttggccaggctggtctcgaactcctgacctcgagtgatccacctgcctgagcctcccaaagtgctgggattacaagcgtgagccaccccgcccagcctgcagaaagattttttgaaactaaaacttggggcataatttctcagaagaatacactgtggaaaacaataagttagactctgacgattttgaagcccttacaaatatttataatggaattcacttatacgtgcaaatctatgaactacataccctaccaataattagcagaagagcagaccatttctataattagttgacacttggtacctggatttaatatctaactgaaaagaagctttcagtaaggtctgcgagttgaatggaaaaatggaagtcagaatctggttttgaatcgtgagcctgccacttagtagttgatttactttaggtaagttgccataactggagtggggataataataatgaataacttgaagtttgtttctattagagataaaaatttataaattatataacatcattcctggcacaaaattgtcagtgagtgatcgtttttaacgaccacagggtaatctaaaattaaaacataataaatggtgttcttcgttgctatttccccccggactttctaatatgttttttaacattttctccttatgggccaccattcctcttcttcaggccatgtgttggtgaacttcttctctatatcctctctcaattcatttctcttgcttggaaattcatttatctccatttacctaattcatactcattctactcatacctttttctggtggtttttcctctgggatgatttaactgactgacttgggacatttttacttttcccttctctcacatctaatgatccttttttctataaaatgttatctttatgcatttaaatgcaaacttttagtattagtttatatttttctgtacaagttctctgtcctcaactagattaaaaggtgcttgagagaagcaactctgtcttaaagcagagtattttctttaaaatgataggtattcaaaaaacttttttttattttattgattacaaaaggcagcagctgaaagttaaactcactattcattatagaaaaagaactttcagtagacagatgtggctaactactactgatcattgaggaataattctcattgcacaagatctttttcatgtctgttttacatgcatattcagtgacattgaaggagttttccagtgtctgatcaacttttgagtgggatgtgggtagaaagcaagttagtattgagttctttattctaattcatttctctatcaatgtgtttccatttgttttggagaaacaaacagaagtagaggatggcaaacactggaatctcctttctaacaccagagggcctccaaacaaaatgttcagtgaattaaaagaaatagaattctagtcattgaaaactccaccttctaatctttggatgcaaaatgtcttcatttttcgattggctccatctttctttcatacattcaaatttattcgatctttaagtagtgaaaaatacataaagagaatattgaagaaaaaaaattcaacctcatttattacaccaaaattggttttaggtagatgctttaaaacaattttaggaaatggaatgccattctaagcaggatatgaattcaaagagtggtaatcagcaataattatatctggatagtttgtcagagtttgtgggggtaaagatttttcctaacttaggccttcatgtccttgtatccccctgtctttcttgctccacacttttcttcacttaagtcctacagaactatttatactttccatcatccacatgagtcattttccctcttcaaagtatttccatctacgccacttctttaactccatagttatctgtcttgactgcatatttgaccagctaaataatttctatcccatgtgcaaaatgaaaatgagggatctcttgttgaacaagtactaagaatttcaaaaggacactagcagagcagaaaacccaaaagcagagtcctttgaaacgttgggccctgtaccacagcacaggtcacgtccccatgaatctggcccaactgcacgttataatcacataggaagttgttttttgctttgtttcatttttaaataatgatgctaaggtagtgctcagatgcattagatcagaatttctgggggtaaggcccagacctcagttttgtaattttaattgcattttaattgtaaaaaatttaagtttattttaattttaatgtgtagccaaggctgggcaccaaattcaaaggctatttccttgtgacttggcatatacttacctatttacttttctatctctctcatgagaccattgagttccttaagagtagatatcatatctttttagccttttcatctttatgacatagaacaacacctggaacattttagatatctattaaatagattatactgaatgaatgattaaatagatactaatatgacctcatttttaattttacagggtgtaatcaagaaaaaaagaaagtaaaggcagacttattggatgataatttgaaagtgtaaagagaaaacatactcttagaaaaaatgtaataaaatatttgagaaattagatctaaatttactttttaaatgaagggtattgagagatacaatagtcccctcaattctgtgcttaaggggaaaattatcttatttacactattactcattaaactttcagagttgaggaaaagcaagaataaggaaaaaagatgggagaatgtttacagaattaaggaaatatgatgtttctcaatatgtgtgtaatacagttgaataataggagaataaatttgtggtagaagattccttctcaaagaacgacatggcttgtgaatggtactagaactggaaaataatgagccattattagcactagttttgtctgatcaaattaatagaataaatgtaattgctcataagcactagtaaagaacaatcttaagcatttgctagttttaaataatttggtccagattttaacatagcatacattttccattatatgattgtgctagatgtttacacataatgtaagagtatggcacatataaatagcccattattatgttgtgtttatagtatatcatagcaatttgaggacacatgacatgtctcatttttttctttttggtacagcgtttggcaaactaagttcagagggctagatacatgttttttgtattttctcttttatttaggtaaaacttacatgatgcaaaattcatcattttcaccaaagtatgtaattcagtggttttcagtatgttcacaatattgtgcagatatcaccactatctagttccagatcattttcataacccctaaagaaaactctgtatccattaatcatttattctgcgttcattgtttgtttgttgttgttgttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctcgctatgttgcccaagtgggtcctggcctcaaacagttctccctgcatagcatcccaaagcactgagattacaggtgttagctactgtgcccagccttgcatttgtttttacccatgaggccctggcaatagcctatctgctttctctttctatggtttgcgtactctggatatttctgggtgactagaatcatgtactgtgtggctttttgtgtctgcctgctttcacttagcataatattttcaaggttcatccatgctgtaacatgtatcaatacttcaatacttttatgattaaatgatattccattttatgcatattcatcatttagtttatctgtgaaaccactgattggcattcagtttatctccaaaatttggctattgtgaaaagttctgctatgcacattggttcacagtttttgtttaaacaccaatttttaatctttttgggtatatacctaagaatagcattgctgagttttatggtaattccatatttaactttttgaggagctgccaatattttttttatagcagctgcacaatttcactttctcactagcaaatgtatgaaggttctattttctctatatcctcaccaacttgttactttcatttttaaaattataaaacatcctggtaggtgtgaagtggtatcttactgcggtttagatttgcatttccctaatgactaatgatgttgagcatgtttctgtgtgcttgttgacatctatatgtcttctttggagaaatatctattcaagctctgtgcccatttttaaacagcattgttttttttttgttgttgttgttgtaggagttctttatatattctgaatagtagaatattatcagttatatgattcacaatattttctcccattctttagtttgtcttttcatttgtttgacaatgtcctttcatacacaaaagttttcacttatgataatgtccaatttatctatatattttttgttgattgtatttttggtgtcatatcaaaaaatccattgccaaatccaaaatcatgaagtcttacctatatattttattgtgagagttttatagttttatcttttacatttagatcatgataactttggattaattttttgtgtactatgtgaggtaagtatcaacttcattcatttacatgtagatttttagttgtcccaatgccctttgttcaagagatgattctcattattttgttgagaagttttacatctgtattcttaagggacattggtatgtagttttcttttattgtgaagtcttttctggtttagtatcagggtagtgttggcctgaaagaatggacaagaaggtgttccctcctgttttattatttggaagagtttgagaaggattggtgttgaattttctttaaatgatgatggaattcatcagtgaagttatttggttctgggattttctttggaggttctggatgactggttcaatctctttattttctctagatatattcagatttttatttctatttgaggaagttttgatagcagtgtctctgtagaaatttgtctatttcattggggtagtctaatttttgatgtgtaattatttctatgattctcttgtaaactttttatatctacaaaattggtagcaaaggccctcttttttcatctgattttttttgctattacttttttcttgattggtctagctaaagatttgttaattttgttcatcttttcaaataatcaaattttggttccattgcttctctctattttttttttctgttctctcttttattatctctgaggtaatctttcttcttttcttcctacctgcaggtttagtttgatcttattcttctaggtttctatggtgtaaatttatgttacttatttgagatttttcttcctttttaatgtagatatatacagctgtaaattccctttgagggactgctttcactgtatccattgagttttaatatgttctgcttttgttttcattcatcacagagcattttctaatttcccttctaatttcctctgcaactcattggtttctctcaaggccagtttctattaatttctttgttcctgtcaatgggctgtactttcttgtttgtatttttcacttttttttggttaaaaaatgggcattttaaacagtataatattgcaactctagaaataagatattcccctcacccagggttttttgtttactggttattgtagttctttgttgtttagtgaccttgctaaattaattttgtaaagtctgtattttttgttctgggtggccactgaaatgtgtgattgttaggttagtagtaccttagtaacttgacagagatttccttaaactcctggaacaaaacaacaagaaacaaaaccaaacttcccgtctttgtagtttggttgtatattggggcactcctttactgtttagccaggcagtttacaattctgccctattcttccttcctgcttgcatggagcctgaatctagccagaggtaagggcttagggtcttgtcaggtcctttctgagcatacatcccccactggttatgtgcatggactgctagattcccttgactatacgggagcttgtcccagctcttagtgcccccaagtatttcctccctagtctttctgtctcaggctttcaggtcaatctatttcttgcccctacttttccctcttacccaccaggtggcaggtaatatatttgcctttaaatgcttacaaaaaacaccacgtgtgaagcagcttcagccttagggaagctccttatgcagatgaaccaatggcaagtccttgagcccatccctctgggagccaccacacaggttaaaatacgtaacaattctgtaagaataaggtccatatggtttcctatggtgtgtatgacctgcatcaggaatgcaggctactatcttcaagactgttgtggagctgaggagtatcaaatagtatcaacagggtaaattaatatgccacagagctctccaaccaagattctgtagtttttcccttcactaaacatttccttgtcgttgtaagtttttattcaattctagagttatttaaaaattgattctgatggtttgccagtttatcaactgcttctatggctgctttcacactataatgacagaattgaatagttgtgactatatagttcataaagccaaaaatatttactatttggtctttaaaggaaaaaatttgaacctctagtctacatatctatattcagaatttacataaaaacatttgtttcatgaatgtattaatgactaaattggtggatgaatggatgaatgaatacatccaaaatatttatattttaacacgaggtattccaatatagatatctacatgcatcttgttaaacttcaaataaaaatttagaaaatcatggtaatttattgatcatctttggagttgctcttttcacttagaggttactatggaaatacaggagtggcggtagtcaattatcaataaacatgccaatcaaacacatatattactactggggatcattctcatggtgtttataagctgtcccccatcccttgatcaaatcatactgtatgtgtgctaaatctacccaagagtgttgcttattagagtaatgagttgataacatttttgtgagagaaaaatttatctttgctgaaaatcttcctttattctgcttgtatttctttgtaagcattagttatatttcttgggtgtttttcatcatttgagaagaataccttttacccataataaaagtaaacctatccatgaaaattttatctaataaaaatttttagtttagatgcctgaaatcaaataaaaataatattaaacagggttgaaaagaatgttaaaacaggtaactaaaacttgctgccttatactatctagtaaagcagactttccgaatgtttatcctctgtgcttggatgagaggactgcaagtgaagatttgggaaaattcaagtaaagcatggtctaggtagaaagggaaacaaagaaaaacccccaaaccaaaactaacccaacgaaaaagggcagagggttatcctttgttccatctccttaacattgctgtccatagtaatacctttcatccttaatctcccttttaaaagtgtgactgtcccctctgcattatcctgagcacctcttgagcccttagggggaaatatgttgaggtctgtttcattttattgttgttaaggtgtaagtctgatagttataatgaaccaactcaccttcctgaaaagcataattgttccactatttctgttgcccattcatcagccttctactttcaatcaacttaacatctgccttgatttccatactctataaaaactagattgccctcttactagttatgatttaatgccttcagtaagagggcagtaataagatatagagactgaacacactgctcagaaaatagaaggaaataaattattttcaggaaaatatgaactgctcagttttgtttcaattgccgtaatattactttaatcttagattatttttttgtaaccattatgtctttttcatttggcccatagggatgctatttaaaaaaaggagggttttttttttttttttttttttttttggtcaaccctatgttcattaaggaaaaaaaaaggcaccattaggtaatattttctaaatgcattgatatctttaagaaactggaatttcagctgttgccacaaataaactttacaagttttttagtcataaggataaattcaagaacaagactggggttacctgaatatacctgtctatttttcaaaataaatgatttgtgggctacagcatcctgtgttctgagattcaccacaatgctctaaaacaagacacatgtccctgtttctcaaaaacgtagcctgtgagaacattctgcattccacttctgataactaatgaagcaaagtagacgtgtaaataaatacaggataatatataattggtagggatttcaaattcaccactagattgggagtttcataagggcaggaatttttctatgttgttttgatttgtttttcattgttcagtgttgtatacctagcacctggaagagtgttgggacagagtaagagttcagtgtatgcttgggtaaatacattggtttatttattcttatcattgtaatagcaggggatattttatacatatcacattaaaattaatttacattttaatgtccctatgttttaagtagcatgagtaagacactgatatctcagggttaacatatgaaaaagataattgagccctagataagagctgagagatacatgagttatatgctttaaacattattaaaagttttattatatttaaataaaacatttttataccctcaaccttaaaatgtattttactttttcagaacttcattttggattcattctgtgccaactcccagtctaatgcagataaaaatatatgagttattgggttccttaaaactggggttgatagtagaaatgctgacaaatccttattacagatgccagtggaatgaagtgcctttacctctagcaaatgctgatgtggagatttaagactatatgagaaatcagttaagttgcccaggagagttttatcatattattcaatgaacttggtatgtgatgcagtaattgcttttggtaccatttttcttctcttacgtgaggttattatttatccttgtaccgtgtgaaacagagaaagagagcttaaaggagagtcataacttgatgtaaaactatcccatgacacagtgtagctggagataggaatcaaagcaagaaaactgcatcttacttatcagaattaaatatgggaagagtaatatttgacattgtggagatccataaatactaaaaagatgcactcagaccacaaatatttttttctagtgatgtgcaaacctgttgaagacatatatctaagtaggttttttaatctcagagggatcaacaaatttatttgcctatgacagaagttttcttattagctttaggtgaaggaaatcaaattaacaggtaggaggctagtaggacaagttagagtaataagatttaaatagcctaataacttttacaattatattgctgttttcacttattgcacacatatatccctcatatgcttcacagactcctaacaccaactttgattatattttatccagtgttcaagtcagtttctgtgaaaaataaataaaaagtacttaggaatataatttaatttaaaatagagacaattataatttaacaatgcaaacagaagaaaaagcatttttagatagtcatatgttgctacctaaatctgattagtttaatagatgttatttttataaattcttaaaatactttatgttaaaaaggtgtgcttttatttagaaatgagatgatttgtcaggtagaaaatgaattttgtgtattttatatttactatttattttcttccataaagttgtcttgatggcattgttcaataattaataccattttgcatacaatatagcccagtggctaatcccagttaactaaaaaaaaaaaaagtcatacaacaggtgtttaattatgtaatgaactatttacaattttatattcacatggagtttggaaatggtcagtaagaattatttaatcaaggaagtatgggagggatgggtaagtggtccagcagtcagcctggctgagttgtatactggctgttgactatgggcaaaaaaaaaaaaaaaaaatcttaacaccctttccctcagttttttcataatagatataatattactgacctcatgtagttgttatggagaatacaattgaaataatccaagtaaagcatttagaacagggtttggcacatagtaagtgcttgggaaatgttaaacattactattgcttagtcatggggattggcaaattgtcgatctttgttccttttaagtaaaacaaaacaaaacaaaacaaactctgtatttgaaaatcataacctaaatgaaacaaaagtatgaaatcaatagagctaatttactatacctacatgctttatttttttcccattccaccaaccctgtattctcagtctttcccctactctgcaagggaatatgatattctcctcaagtccttaaccctctacacatgggttagtgacttgaggatttgttaccatcatgcccgagcctcatagtggaacttacctgtctcaatttttttccttcaagttcaggtttccctggcttccccggttgaccagaacaattcgtttctattcaattcatttcagcagtcattttattggtaagcctgctatgagccaggggatgtttggtgcttttgaagcaaaattaagtaaccattttgccgagtaaatcgctcaagtctagttcagaaggcttacatataaatcatcacctactacttggtatgataaatgctatggtaaaagtattcaaaagttgttgcaggagcaccagaaaaagaaacacctaaatatgtctgaaaagtgaatactcagtaccagaaagctgtttcaccacagggcttcttccctttctaatataacaagggcatataaactatgatctatggaaatgtgttatctacttgaaagactagcaggccaggaagagtagtgaggcaaaagggtatgataacctcttgggtggaagggcactacatctgttacatttgcagtactttgtgtacccctggggaataaagtttatatgtgatcaaatgttacataaaaatcagacaagatcctaactgttcttttacttatgttaagctcaaatatgtagctttggatgtagttaacagattaatttctgattcccatctgattcaatttaaaaatccaacatatacggttttctcccagacgatattacgatgtagaaagcaacctaaaatagtgggaaaagtaggtattgtggaagttgaaaaacctaggttcaaacctcttattttgttgcctcttttagttgttctttacctcttcttagctatgtgacctgggaaaattatttaacctctttgaaaatttaaatgtcaaatgaaaatagtcccaataagactgcattgaaacatatgaaaaaatgcttaacatcatatggcattagggaattacaaattaaaacaacaatgagacatcaccgtataccctcaagaatggccaaaatccagaacactgacaacaccaaatgctaggaagaatgtggagcaacaaagcctctcatttcttattggtgggaatagaaaacagggctgccactttagaagacagtttggcagtttctttcaaaactaagcatactcttaccatatgatcttgcagtcatccaccttgatatttacccaaataaaccaaaaacttatgtccacacaaaaaccagcacatggatgtttatagcaactttatttataattgcccagacttggaagccaccaaaattttctccagtgggtgagtggacaaataaactgtggtatattcacactatgtaatattattcagcagaaaacagaaatgagctatcaagccatgaaaatacatggaggaaacttaaatgcttattaccaagtgaaagaaaacaatctgaaaaggccacattccaactatgtgacattctggaaaaggcgaaactctggagctactaaaaagattaacggttgccaggagttagagtggggaaaggaatgaatatgtaaaagcacagagaatatttagggcattgaaactattttgtattgatactacaatggtggatgcatgccattatacatttgtcaaaactcataaaatagacaacaccaagaatgtgcccataaggtaaactatggactgggagtggtaatgatgtgccagtgaatgttcgtctgttgtgaacatgtactgatttggtgctggatgttgatagtagggtaaactaggcctctaggaggggtagggagatatgtgaaatgtctgtaccttctgctcagttttgctgtgaacctaaaattgctagaaaaattaagtctattaattaattaattaatttgagacagtcttgttctgttgcctaggctggagtgcaatggcacaatctcggctcactgcaacctccacctcccaggttcaagagcttcttctgcctcagtgtcccaagtagctgggactacaggcacctgccaccacacccggctaagttttatatttttagtagagatggagtttcaccatgttggccaggctggtctcaaacttctgacctcatgtgattcacccacctcgacctcccaaactgttgtgattacaggtgtaagctgtgccgcccagcctaagtctatcacttaaaaaaaaagaatcatgaaaaattattgggaagctgaaataatgaaattatgttaagaagctgatttttgccaggatttttttaattaattcccctaacaactttaaatgtattgttaaatatatttagaaattagaaaattgagttatagaagtaactaatttatcaataatttatccaatcagtatttactgggcacctactatatgctaggcattgtattaggcatggaagatattataatgagttcatataaatgttatattttaggagagtgagacaaaaacccaatagtaagccaacaagtaaaacaattgaaaatgacttaagtactgtgagaaaataaataatgagatagataataacagagaagattctctttagatagaaccaaaggaaagattttatatttaacttgagccttaaaggaagcaaaagagctcaccatttgaagagcattatagacagataaaacaacaggtaaagggctttgagatggaaaatagctttgtatttttgaatctgggagaaaacaggatatctagaccttaaggaaaagaaaatagagttggagagagaaaggtaagttttaagcctttatgatgaatattttattcatttaacacatgtgccttgagcaccaacggcttgccagtcattttcttctatgcactgagataaattaatgaacataatctctaattcctctatactcatgggtttatgtcataataggggaagaaagaattgcacatacatcaaaagataaataaacaaaacttcagatgggatgagtgctatgagcaaaacaaagcagggtagaataatggagagtaccttagaggaaagaggtaacatatatatgcggtttctttgaagtggtgaatcttgagcatagggttaaatgacgagaaaacaaccatgtgaagatcttaagatagatcttccctgtcagaaaaatcaatcaatcaatcaatcaataaaaaggcagtgcaaagagccaagacgtggagttagaaacaaatctggcaagtttgaagaccaaaatgaaggccaatgcctggaataaaatgagaaagagagggaatagaagctaagttcaaagagaataggccttgaagaccagcataaacagtttttattttattccagttttaatgaaaagccactgttgggttttaagcaaatgcacaataaaagcagatttagtttttacaagattgctacgactttctggggagaatggactgagggggggcagaaatggaaagtaaaagatgtagttacaataggaattcagataagaaataaaggctacatgagccatgattctagcaggggacagtgtaaagaaattagtagaatcagtatatattttgaggggagaatttgcaggatttacaaaggataaaacagaatttgagaatgattgcctggctttggacttaatcagttttgtgagttgtgaagcctttcaccaagatgagagcaagtggtagaacaacaggttttagggcccatggcaatgatgttgaatgttattctaaacacattgggaatctatgtgatgatttcaagtagtagtggggaggtaattcaatgtatccttcagtaagatcccttgtgtttctctgtatcaaatgagctaaaagaaagggaagcaaagatgatgactcacaaatcagtttgagtagcagagtaaacgatggtgccattttctaaaagcagagaaaactgaaaacatgtaaaagttttggggaaaacaagaattatatttgggacatgttaaatgtgagctgtaatataatgtctatgagacataaaatcatgctgacaagtgctattggatacgtgtgcctaagacttgcaagaagtgtgggcctaatatataaattttgaggtcatcaggataaagatgttattgaatttgatgtgtgtggatcagaaaaaagtaggaataaaatttaagaaaaaaggttagagctcataactaattttaggaacataaacatttaactgaggaattataataatggaccatggaatttggggccagataatgaagtgaagtcaggagaggattgagaaatagtagggaaacgtgagttcactgaattgggggtctttatgtgatcgaagagcacaggcgtgggtgtgattaaacaatgagttggatgagtgggttgttagaaatcctaactaattttctgacaaatgcaggctgcagttttgaccatgcggaagagagactagacttcaatgagggaaataatttggtaatgagtaaataaaagaattaagagatcagctgtattggatacttcatgtaggtggattttgaatataccgagaataataagaatttgaaaaaagagcaaaattaccatccagtagtcaaatatttgaaaagtaaaggcttctcttcctacttaataaaacttttgaaccagatttcattgaatgacagcaattgtagagagagagagcctggtctagcagggtggaatgagtctcagaggagcagtagttactgcacaaggcaggggaaaaaatggtgtggggacagcaatgaggggcagggaaaacaccaaatgtgcctctgtctccaagggatgtggaggtaaatgaaaatagtctgtaggaaagagagctgaaggctaagcaatgtcatcagggtacagtccagcagagcagggagataaaatggtcattctaaaaatcaggtgaagatacgaaacaacgtgccaatctctgaccaggacttctctaacacacagtggcagtgtttagaaagggtcagaataacaggaggtgaggctgcagggtgcatacaactgtatagagataaggtaagtccacagagatgggaaggaagatgaaaataatcttgattatttcttagttgagtgtgggcaagctgacacatggctgtcatgtctaaaactcctttaggatagctctcatgggatgactgttgttctccaggggttggggaagagggtgagcacattcctaggtggactggcatgggagtatcctaacttttctcactctgtaatagcttcctctaagataacaggggctttgcccataagcaaatagtgaatagcagaaccaattgttgcaccttggtttattcatagcagcacagtctgccataccatgtgcaagtgccttcgataaaatgtgctaatgcatggaatctttttgcacttagttaaacatacaaatttctcatagggcctaatttgcagagcctcacaaaaattggctcctcaccccttttttattcagatcttgttcaaccaactcactcacttactggatgtgacttctgtcacactgttgccaattatcctcttcctgaaacactccaatattatgttggtctcagggctttttaccatgctgtgtccttggcttgaaatactctgttttcagagtttcaagtgtctagactctttctcatctgttggattatacttcgtctcttaccttctctgaaaagactttcaggaaattacttaattttgtcttctcttatcttaccgagtaccttgcagttgttttcttttctattgacctattttatgtttttataccacttaggaggatctgataatatgtgttgtatttgtttaggcatttgttaactgttttcttctctttatcatgaacttcatggctcaaggatttctatttatatagaggagggctggctcacaataggtgctccataaaattatgttggatgaatgcataagcacttgataaagatcactttcttcctctctctctctctatttttttttctttttttttttttttttttgagacggagtctcactctgtcacccagacttgagtgcagtgagcaatcttggctcagtgcaagctccgcctcccgggttcacgccattctcctgcctcagcctcctgaatagctgggactacaggcgcccgccactacgcccagctaattttttttgtattttttagtagagatggggtttcaccgtgttagccaggatggtcttgatctcctgacctcgtgatctgcccgccttggcctcccaaagtgctgggattacaggtgcaagccatggtgcctggccttcttcatctatattttaaagtaaactactactttttaaactataattaaatatagtagttgtaattttcatggttgttgggacaaaatgtgattatatatataaaaagtccacactccagttctttgcacatagtaggcaattagtcagcaatttttttcattaattttatccatagatcccatggaaacagcataccagatattgattaaatgatataattcaaattgaggtattataatcatggtgaaattagatgtcggatatgatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatgagaaaatttctgtcttctaagaaaagcaataattctgatgatgagtttcatgattaactgttacctcttttcttctttttcaatgttttcaggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcatgtaagtcccttccctcatgatttattagtttgttatgttgctacaaggtttactcttttgttgatgtatatgaaataactacaaagagtagtgatatatttcaagcatgtatttccttcaataattttatttaagctagatagtatttgtcactaaatgtaaagaatctaagagggatatatagccctatatatgtaaacagattaaattttccacaggaactgagagatggaacattatctctcttgattattacatttcaaagagatacttcccaggtccttgagaaaggctttcctgggccataaagttggcaagaggcttaattagcttttaaaggagttatatacatttttaaacagagagggagaaatgacctatgagtttttaaagtaagtattctaagaaaaaggggtgaggaggggtgtttctttccttattttcagttggaagaatcaggcctttttttagaatttagtatttaattagtatttagtatttttaattagctcttgcaattgcaagtctttgttattttagaaataacatgtttgtcaccttcttattctccatccctctttcttaagaggaccttaagcatacagggtttggtatgatctttcaaattcattatgatctaaacaagatggttcttggtggtacaatatgaagatgcaacttcagatagacatcttaacttttaaaaagtataatttataaatttagaagaggagactttgtttcttacaaagggttgcagcatgcacggtggccattcagacaggttgggaagcatagtctctggttggaagccaaaagcagatactttgagggaggggcaaaaggaacaggaatttatgctaagcaagatggctgaatatatatattatattttccccaatgggatataggagaagtcatgaatatttatgaaaggagaaacttgtgcatgaacatgaacatgcctctccatggattccatgtacaaaaatggtggcattagcatggtgtgagggtggagttttcagccctatggcatcaaaaagtgaagcacaggacatgaaaatccttactaagcattctctgaagatggctatagccattcaatggtcgtggtctaacaggcaaaataaggaaaggcagcatcaaggttggttgatatcactggtgaagtctttcgaaagggctgttttctgttttcagtggtgaagtcttctgaaagggctgtcttctttagggaaaaaagtctaaaggcagttagtgagaggttggtgtataatgaggcctcctgtcatggctgagaatacagttttcaaggttactatggggttccctgggcagggaaaaggtccattcagttgttttaggggctttggatttatttttatttctcagatattaggagaaagtgaatttctgaggcattaggtattgttagtccttgaaaaaagaccttttccctgaaaacatcatcctctcttctccactttcccatactcggtagggctccataaaatagtgtgctcgtgagcacttggtaaggcaaaggtgagttcaaatcctaattcttcaactatgcagttgcatgccttgaaaacactgccttaaacactttgaaacttaactttctgaaacataagatagagataagttatatcattttaataattaggaatgatatataggaattttctaacacagcgtctgacatatagtagataatcaataaatagagatgtaactaataagcccaaacttagtgtcttcttacttgttctgtcttctactatagtatttatgagtgtttgtgttgagggctaaaacataaacatttagatggtattacaatgagaaatctgtagggactatagcactataattattaaatttgaatttaatcatagtcagtgagatcagtattaagttttagtagtgaagtttattaactggatcctttgctgtcacaaatataccagtgctttcctacctaaatgacctatatgttgtgaatggcagttttatattaagattaattaaacatagagaagcattagtagagagtcaaattcactgttcgatcaacaataggcaagataaagaaaaacaaaacaaataatatttagggtacaacaaagcagggacacccttatttttttgaaaattactcttaatattaaaacaaactcaaaatagtcattatagataaaatcaaaacatttttggaccttcttatacttagagtttgatatttcgcaaatttgaattacacatacaggggacaaagctcttgacccctaaagttttgatgaaaatcactgataatgaggctgattaattaataagagaaaatacatacaaatttatttaacttgtatatacaggacccttcagaatgaaaactcaacttcccaaagaagtacagaagcttatattactatcttgaggttacaacgagaatgggggcttggatcctggtaaaatagtttatgagaaggcaaagagaataaattttatggaggggcaataaatgattacaacggaacagaaattaagttgtaaacagtttcctttttttagaacttaaatgatgcttgaagacaatgattatcttgcaaaagggtctgttcagatgtggttagattttttgttttctttcctgtaatggataatgagattacagggagggaaacaagaacacttgttctcctaggcaggtaaattctgactttttgtagataggaaaaaaagtctctcctagtgatcatcgattcccaagaatttttaacttaaaatactcattataccaggaagccatattttggggtgaaatattttgatttccttcacatgtaagactgaaagtgaagagattcattttctttcttaaatctttgaggatcttactccagcatttctcaaatacattttattctccttatatttatatatttttaagagacggaatctttctgtgacttagactagggttcagtggcataatcatagttcattgcagccttgaagcccttggctcaagcagtccttctgcctcagccttgtgggtagacatgctaacatccctagctaattatttattattattattattattttagatatgtggtcttgctatgttgctcatgctagtctcaaacttttggactccagggatcctcctgccttagcctctggagtaactgggattatcgacatgagccactgtgcctggcttcaaatacacttgaaaaaataaattttgtggaaactcatagtttgatacattttaaaatgttaataatatatgtcctactacagaaaaaatatggaagcaaacaatctattttgtttttcctttatgtactaataatctactctttcagtcctagcagattttccattgggctgatcatcttttgagtttttatgatgattggtgattgatgacttgaaattttttggttagctataaaaagttgataacttttgaaagttatcaaactgatttgaatctaaattaggatgctattttatcatatcagtttgctgcattcataatcttctgtaggggcaggttgaaaataaatctcagatctgtcccatctttagtttttcaccgcccatgtagctcatacgtttgccattttattatgtctctattatatacttcctgcctttaatatcatctccaggaatgcatatatacattttagtcagattttcatttaatcagcaatgttatctcaaagctttctcactgaaatcattgcagagatactgaaagattacagtatataatttcaagtactcatgttggcctttaatttctttttcatagtcccctgacacctgatggtttgcacagtcctcagttctttcctcttgtcaactgtttaatgtccatccccagagttctctgctggggctgtactccaaaaagctttttgtgccattttattcttctgaaaagcctactttcttcgacacctataaaactactacctctggcacttaatcatagacattccttattacttgaaattctttgtcctttcatctttcacacagactaatcccagctggaggcaaaatttcagaatatccttaagccagtgttctgctggtgaatctctgacctactgtcataatgctgataaaatgtgtgagggaatactgagtactcacattcaacagatctacagttacttcttaactgtgcaaatttgggcaccgtgtgtctaacttttctctttctcttactctcctgtgtagctttgggaaagtttcttactctgtcttgagtgacttatatcatttatacaatgggaataatgatactcacttcattgaatgaagatgtggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagatgtggattaaatgttaatatctgagaatagagcaggactatagccttctttaacttagttaaatacatcagtgagacagcagagtttgggtatatttggaggagacacaacagaaggaaaaacgtaatgacaggaagtaggaaaaatttaaatgcttcaggacagtgatgcagatccctctgtagatattaggcccctcatgcttcagtgtatgaaaagctcctggcactgatggataatctcatgcctataaatacaaatttttcctttttaaaacctgagccctagtcaaaaaactgctacttaacctgggttgcaactaaagaaacagcatacaaacagttctaagactgagctacttaatgggttttcaaatcagatttgagaagtaaactctaagttgggacatgaatgcattgcataggccttaatgtgctgagtggcaaataggaaatactcaagaaaagtagttattattattattactattaaaattattattatggttaatgtatccaaaaaggtgccaatgtttttgaatgttgctatattttgtctattcaaccccatgagctagtttacaggattactgttgaaccatgattatatttaaaacaaataattgactaaatgtgtgctataatgttatcagagaaaaggggcatttaaaaacagatttttaaagccacattatccattcctttaccccattagaattgtgtggactatgagaagttatctaaatagtaacatttaaagtttagctcttttataagtgccaaacatctttacaacttctttgtctttaaagagatttgtgttttaatataattaaccatttgatgtaggtaaaagagtgcatcgggcaataaatgcttactttttaaattatgttcatttttgtagcttcaattgtgaaatttgagaagtaaacaaaacttgatcatttgacaggttttcttaaaaaaccggaatgagaaagaaattctgtttcagcttagaaaacaactatagtaaaatgggaagtctgttggaatctaattcagtattttacattatttttaagaagactcacgatgccacagatttccagctgtctgaatgcttcccagcttgctgccttggcattgcaattggtatttaatattatcaagccttttatgattcataaatgagccttggaggacctcactacactttgcttttgcctcctgattgctcttttattatatgttggaaaggaaatcaaatatttgtttttcagggaacttaaaaaggctccaggtattatcacaaaaatggaaacactaaatcaaaagcagtttattctaaatgggaattgacttgcacagccatagctttaaattttgacagcacattgtttaattttgcatcctagttgaggaactctagtacttcttgtgaaaataaacaaaaaggctaggcgtcgtgactcacacctgtaatcccagcactttgggtggccaaggtgggcagatcacctgaggttaggagttcaagaccagcctggccaacatggtgaaaacccgtctctactaaaaatacaaaaaagttagctgggtgtgctggtgcactcccgtaatcccagctacttgggaggctgaggcacaagaatcacttgaacttgggaggcagaggttgcagtgagctgagatcacgccactaaactccagcctgggcaacacagtgagaccccgtctcaaaaaaaaagaaaaaaaaaaaagaaagaaatacaaataataaaaaaaaattacaaccaacaacaacaaataaaaactgttggggagtagaaacactattattattgtatttttaaaatgttggcaaaaacaactaaaatcacaagtataaatttataatttcctatgaccccaaagtgacaactattaacatatttgttaactttgcttcaagtgtctcttttaatgtaaaagttataaaatattacagataatgttgaagtgccttcctcaccataattgtcttgatttagtattttccacatcagtcataaaatataaaactacattttcctcatccctctccaggtgtaaccaaaattgttcaatagtaccatgtaacaggattatatcatttttatttagtcttctactgataaacattcaaaatgctataattgaagatgcacatcttatcttccatagcacctatgcaaaagcttttccataatatatgcttatttcacattgcatgcctgtagtaaaacatctcatgtaccccataaatatgtgaaatatatgaacaaggaattgtttatcatagttcatgtattttctttccaattttgttagcaacctcatccgaaaaacaaatttcattagatattaaaaagatttttctccaaaaaatttttactaatttacatttctaccaatagtttataagaatttctattcctctgcaaaatcattagtacttgagattagacatttagactagactattagagtacattagactatttgaatttggtcaaatagtctggggacaaatagaatcaaattgctttaattttcagatactcataactagccattctttttctccatatttataggctttttaatttccccttctttgaattccccatttacttcattccttcttattaacatatagtaatttattatattttctgaatgcctataatgcaaatattttccccagctaagactttatctcttaatttcattgtgtgtgtgtgtgtgtgaatgtgtgtgtgtgtgttttcatatagaagttttaaagttttagtttgtcacatttagtcattttttaaatggcttgtgatgtttgtgatttgttggaaaaattcttttttaactgaagctcaaaaagatattttcctattttttaatattcttaatgtttttgtttctcagatttagttctttcatccacttgtggtttgtttattaagtccatactgattggacctcaacttaagtgaaagcctgaattccttttacgccctttctgaagcagtacctccccccaacacaccaaattctgctacaacatgtatgccagtaattttctcttctttgtaaaaaagcaacttgaaaagcaagtaatttttacttttaaggagacattctgtgattataatctcagacgatagagacattaggaattatgaaaagtatataacattttttaaaagggctaatatatttttaaactttttttctcaacgtgaatttaaacagtgagctgttgaagatataaacaaactggtttcagtgacaaggatattttgaaatttaatccagaaacatggtctatcacagatcagtgtaattctgatttatgctatactagattatgattcattagaaattatcccaggatagagcctcaacaaccatttattgaatatatattctgagaaacacacagtaaccacagcagtaataatagttctcaaatataaatgactatattttattaaaaaaggtatgttaagtgtttaatttttctttcagtactaatataataaagaatgtcttctcatgcagttccaaaattaatattatgtttagaaatatttatatatatttttaaatttaaatttttttttgctgtgatgtattctgagaatacttaaaagaaattgtttccctaataacaatcttctgctaatttgctattaattgcaaaattatagcaaaaaccagagctaaggattattttatttggcaattgtatcatgaattattgaataaatacccccaatgtacactattaagttcctttaaatatgacttctgaacttaagctacttaaaatgtctgtaaaaaatgttttggtcataatttgaagattgagagaaagtaaaatactaaattgacattatagagacctctataaatggagacttctggacactcctatccatcctattaataattttgcccctacaaactggaagcaactaatttgttatgcagtacagagcattgaaacttttccttactgtagtcaggaaatgcttcttaaaaaaaaaaaaagcttcaatgtcttcttaaataaagaaaaacagtttggagtagaagaggcgtgaaattgggaatttcatcgctcaaacaaaatgtatgtaaaaatgaaaatagaaatataaattaagggcaagggaattctgtgaggaagcatgtccaaaatctagtattatttaaagtcagtaataaaaattttgtatgtaatttaaatagtaaatttacaatgacactattgaagcagtgggccgaaaaatttgtttatctgtggtatatggaacatctgtgtgttattaaataataaatactgatttgcatctattactaccataacagcagaataaatgtaactgaaaacagatataaaaaagtggcttttttaaaggtgatattttctttagagcatagagcaaatctaaacagaaagacaaaaaagccccacaaaactttaaaaaattaaaaaaaggaaaatcatagcatgaaatgtattaatgctatagaaatttgttcagtgtgactggattttcctttcacattaaattgcataaagtttcttttcaaagtaaatttgagtaatagaaatttcagaaaaaaattgctcaaataagatattcttcatgatattcccatgtggaaaaaaattcagtattattcattaagcatttttgtgccattcacatttttaggtactgagaaacatacaaaccctgggtgagatgaacattaaatacattttatatactttagatagtacaacaatagagatattctgaaaatattttgggaaacatgagggagtatatctaattttgtcaagggaaagggtcagggaagtctttaagcttgaattatgaaaaaaatgacagatgctttttcaaatacactatttttagtgctgcagttcatttaattgaagcacgtattctacctgagggatgttatcttatgtaacaccacacgtgaccaaaacggtgtacttggtcaggtttatttaaatattttgaaagccaattcaatttaaaatgaactgatatgattcagacaatttgcggagggagaattaacataaagaaagttttcacatcttttctcctaagaagaaaatagatctagttttctcaattaagaagaatttattgaaaatgtattggtatgctaatatgtaattacactaacattaaccactgttgttttgtgccaaaatcatgtgccttcatccatataatttcctgatcacatctaattgcattttaaggttttgtggctcttctaggaaattcagtttgcaaaagatatggccactgaactggagtttattttttacgtattttattatgatagtcatctgatcaagtcttttgtattttttaaacattatccaatttggatcattgaaaatcagaagtaatgtctgtgggaccattatagagcaaatagtctcactgtccagtgtgcacaaaacactggcttttgaggaaaaaagggctttatttgccttttttcgaataggcaagtagtcagcaaggagacaggagtggattcaaatctgtctcctcaagttagggaccccttgcttctgaaagagttttagtattcaggttccagtcatgtcccagttttaccggtatagaggggaatattgattggttttgggtgttgttagagatcaaagctttttctattgtgcatgcctaggctacatgaactgcagattttggttttattatatctgaaaggtaactcaacattttgttaccaactaagcaggcccaatttgggctagtccagtaggtacaggacttattcaactaaaaattcaattatgaatttatgtgacagtatttagtttaatattaaacagcattaaactatcctttatgtccttatattttcacttccatgaaaatgaatgattttgataccttgtaatctactaaactatctttgttcactgtagattaatttgcttttaccaacatttagatttaaaatattctcattttactttgtggctttcaatacatacatcattaaggtcctttcctagttagaatataagctgtgggagggcagtaactatatctctaggacttagcatgatgcttaatacacagtagaaaatgagtgtttgttgaatgcataaatcctgtttttccatccaggccagtttgtccaattcaatgtataaaactacttataatcaggaatatgccacaaatggattttcccaagcattatattttattgatgtacatgttttgtttcctctgtgtaggtgtcaatgtcttgtttgaggcaggaatgatttgattttcttggtatctttcatagcacttgccacaatgctttacacgtagtcaagatggtcaataaatatctaccaaataaatgggtagatataaattatccacctaccctttttttctttccacactaaaggagtgcaattaactttacattgtacgtgtgattacttgaaaccatagctataatattatcacactttccttcagaaaaaaaaattgggtaaagttggtaaacttattaacagagttttgaagtagagcactatgtcatagctatcgaataatagataaaggcattctgaaacacataatatttaaaacatagactcataaaaagtcattttcaagtatttcttaagcagatactgtcagatatattggacgatgagataatttgagagcacgtgttctgaaaaacagggtaagacacttggacaaagaagttttatctttaaatcctgcaaaataaacatacacaaaaatcagaatttttaccaattatattggcgtacttcaaatgagatttgattacctatatacactatcaaaaatagcatttttgtcaggcaggagcagaaaggaaatatagtacatgctgtaataaaagtataatcaatataaaagtaaagattttagcatcagcatgtgaagaaaaagtcatcctgggcaacacatggtttatcttttaaacatcttaataaaatctttttggatggatcatttctagaatgtattacatgtatttactctttgaaaggacagtgagaataaaccaaactctagatgaaaatttcatgtctgttttgatgctttcataatcattctatttatatatttatttttttaaaagtatttcatgaagtgtcttctttttctaacttttattttaaattcaggggttacatgtgcagatttattagatggctatgttgtgtgatgctgaagtttggagtgtgcatgatcccataaccccgatagtgagcatcacacacagtaggtagtttttcaacatttgccccctttgccccaactctagtaatccccagtgtctattgtactcatctttatttccatgtgtacccaatgtttagctcccattataagtgagaacatctaatatttggttttcttttttggccattagttcgcttaggataatggcctccatctacacacttgttgccacaaaaggcatgattttgtccttttttatggctacgtagagttccatagtgtaaatgtaccacattttctttatccaatccattgttgatgagcacctgggttgattccttgtctttgctattgtgaatagttctgtgatgaacatacaggtgaatgtatctctttggtagaacaatttattttcctttgggtgtaaatccaaaggatttggtgagtcaaatgatagttcaactcagttctttgagaaatctctaaaatgctcttcacagcagctggactaactgacattcccaccaacagtttataagtgttcctttttcttcacagccttgccaatatcagttattttttgttgttgttgactttttaacaatggccactctgactgatgtgagatggtatctcaatgtggttttcataataattgtatacttcacattgcaatcacccaggaatataaaattcgtgtctatccaatttcttattcatggtttgacctagaaatgtggccaacattaacccagtaaccatttactgtattagtccattctcacagtgctataaagaactgtttgagactgggtgatttatgaagaaaagaagtttaatcgactcacagttccacatggctggggaggcatcaggagacttacaatcctagtggaggggaagcaaacatgtccttcttcacatggcagcagcagggaaaaatgctgagtaaagcagggaaaagtcccttataaaaccatcagatcatgagaactcactcactatcatgagaatagcatgagggtaaccacccccatgattgaattacctaccatctggtcccactcaccgaacatgggcattataggaaccacaattcaagattagatttgggtggggacacagccaaaccatattaccatcagttttattctttcacctctttgtaggttcaaatgagcactcatcaataattcccccttcccatcccctctgaatagcatgtactcacctcacattgtatctcatctttttcatcttattccctattatcatttacttactccataattcctcacataaattatgtttgttttctacacaaatattaaatagattaagtaattttatgtctgttttcaatgagaatttaaatcctttgaaagtcagaattttaaattataggttgataataagctgatttatgagccgagctttatgaactgagaaaaacattgaacatatttaaagcagggttcactccttagcagagctgcaaatgacagtgataccatagtgaagatttcttgattctggttctgaatcttagttatataggtccccaatgcttattatgcatttatttaggaagtattgaggtagttaaacacaagtgatttttaaactggacattaattttttttaaattatacattaagttctagggtacatgtgcacaacgtgcaggtttgttatacatgtatacatgtgccacgttggtgtgctgcacccattaactcctcatttacattaggtatatctcctaatgctatccctcccccctccccccaccccacaataagccccagtgtgtgatgttccccttcctgtgtccaagtgttctcattgttcaattcccacctatgagtgagaacatgtggtgtttggttttttgtccttgtaatagtttgctgagaatgatggtttccagcttcatccatgtccctacaaaggacatgaactcatccttttttatggctgcatagtattccatggtgtatatgtgccacaatttcttaatccagtctatcattgatggacatttgagttggttcctagtctttgctattgtgaatagtgccacaataaacatacatgtgcatgtttctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcatcttttcatgtgtcttttggctgcataaatgtcttctttggagaagtgtctgttcatatcctttgcccacttgttgatggggttgtttgtttttttcttgtcaatttgtttgagttcattgtagattctggatattagccctttgtcagatgagtagattgcaaaaattttctcccattctgaaggttgcctgttcactctgatagtagtttcttttgctgtgcagaagctctttagtttaattagatcccatttgtcaattttggcttctgttgccattgcttttggtgttttagacatgaagtccttgcctatgcctatgtcctgaatggtattgcctaggttttcttctagagtttttatggttttaggtctaacatttaagtctttaatccatcgtgaattaatttttgtataaggtgtaaggaagggatccagtttcagctttctacatatggctagccagttttcccagcaccatttattaaatagggaatcctttccccatttcttgtttttgtcaggtttgtcaaagatcaaatggttgttgatgtgtggtattatttgtgcgggctgcgttctgttccattggtctatatctctgttttggtaccagtaccatgctgttttggttactgtagccttgtaatatagtttgaagtcaggtagcatgatgcctccagctttgttcttttggcttaggattgtcttggcaatgcaggctcttttttggtgccatatgaattttaaagtagttttttccagttctgtgaagaaagtcattggtagcttgatggggatggcattgaatctataaattaccttgggcagtatggccattttcacgatattgattcttcctatccatgagcatggagtgttcttccatttgtttgtctcctcttttatttcgttgggaagtggtttgtagttctccttgaagaggtccttcacgttccttgtaagttggattcctcagtattttattctcttagaagcaattgtgaatgggagttcactcatgatttggctctctgtttgtctgttattggtgtataagaatgcttgtgatttttgcacattgattttgtatcctgagactttgctgaagttgcttaacagcttaaggaaattttgggctgagatgatggggttttctagatatacaatcatgtcactgcaaacagggacaatttgatttccttttttcctaattgaatacctttatttctttctcctgcctgattgccctggccagaacttccaacactatgttgaataggagtggtgagagagggcatccctgccttgtgtaaactggacattaatttttaatctgagtgtaacaaggatgagtgtttcccattcctcttaatccttgttgataggtgcaattagaagccaatttacaaatcggtggacaagaaaccaaggacaaaacctcaataagagatctcttgtcctttatcttgggggtatttctttttaagtactatcgctagtcatttagaatcggagcatcctttcttagagataataatctacacatactattttttctttcattttgcttggtagaccatcatatatctgctcagccaaaacagaaatgtctcaaagatgttacagtgcaattgagtaggctattttttttttacagaaataactacttttcctaacttaagaaagtagtaacacagtaattatttatttctgatgaaaatttcatttctgttttctaaatttgctttcttcttgtttttctctttacttcttttacattgaatgagttttcttttgactcattgttttttcccctccattaattggaagttataagctttatttctctttattctttaggggtttttatggaaattttaaccagcaaagttaacaagatattgataaccaatattttacccttcttccaaacaatacaaggaccttaggaagcttagactgatcaaccattctgctgacatctgctattatattagttctaatctgattctttcgtgtttagattgaacatattttacacacttgtttgctttacttgccatttattatttatttcttcttatagacagtcttctgtggagtcctgttttcttctagaattacatatatattgtgtgtttatgtgtttgtgtgtgtgtgtgtgtgtgtgtaaagatctctcatcttgggatcaacattacaaataaaaacttaatttgagttcacataaaatcagaagcctgtatttaggaagtcaaaatttaagaagaaaacatgtttaggtgagcctgttaattatgtaaatagtaaaattagtttgaaacacgaaattgtcatttttgtaggctaaaatgaagtgttacacatttcatataacctaacctgtacatttttcctccttataatgtctttaaaatgtttgcagaagcttttcttaccttaggacctaaatatacaacattaaagattaatctaaaaaagaatctggatccttttttataaataataattgtgatagattcctttctggtatttcacaagttttcttaagaacccagatctaattagaaatgaaaacaagtctaaatgattaaaatatggtttccttagaaaacaaaaacaaacacacacacacacacacacacacacacacacacaaaacctcatccctgcagcaccattcagggcccacttattctgaaagtgccagaggcctgtcaccattgttggaagcttagcaaagttcaaagagagcttatcaatgcacagtgagatttaatgtgcactactcattatcctggtgagaccctttgttaaaatagtcaatttctatgctgtttgtaaggttgtgcagttgtaattcctggatgactgccagaaatagccttagtaacaaaacacccagcatccttctgttctcaaatcaatcagtcattgtgtaaagaactttttgatttataatgaatcttgtggccagtatttttaggttatttcactacactaagtcaacagtatgttacttctaggtatgttattataaatggactcattcccctacatctctatacataagcttcttatgttatggtttgtcataacaggtgaagttgaatttgttaattaaaagagtatgtaatatgcatacaaataataatactagcattctgatatgcttttgtattccctctatacaaattatgggccacttaagaaacaaatgagcttcatagttttcctaaagtaattggtgcaatgttacaactaaacacagacgaacacacacacacatatatatatgtttatgtttatgtttttatacttcacatatatatgtagagtatatatgcatatagatgtttatgaatacatacagttggccagttggccctctttatccttgggttccagattcaatcaactagggatcgaaaataccagggctagggaaggatagttgtgtctgtactgaacatgcagactattttttgcttttcattccctaagcaatgcagtataacaactatttacatagcatttacattgacttaattattataagcaatctagagatgatttaaagtatacaggaggatgtgcataggttatatgcaaatactatatacttcatataaaggatttgagcaccgatgaattttggtattcgacaggggccctgaaacccatttcccctggatatcaacagatgactatacaaatatgacatttatgtgtgtatatgtacgttaaaaatagttttaaaagaataaaaacatctgagtacaaaataagtatttgaatagactaagattcagtattttgtcaaggacaacaactcatgtttaaatgtcaatattaactttgataacttagcaaggaactgatacatctatgtttgctttttttgttgagctctatttttcaattcattgttccttaatacattttcattctatgtggagagataaacagtccatcaaatgtattttgttttttaaaaggctttgtaactgtaacctgtagaatgacttgggaatcagccaagttttcaaatctccctccactctttatttgaagtgtgatcttagacaacttggttatgttctctgagcctcacttctctcacttaaaaaagggcattgatgaaagcacacacttcatagtaatgattaaatgacctaaaatgtatgaagtgcttagaatcgtgccaggtatattatattatattatattatattatattatattatattatattatattatattatattaatgtactgaataaatgttagctgtcatttgtatttttttcttgatggaaataatagcaaaatttctgatataaatgaaaacataaactcaggcatctcacttcctcaaccatttacccaatttcccatggaaattatcaatagagtaaacaaataagtaaaagtttgcattctcaatggaatctagggatggagccttcaaagtgtcaagtttttttttctatttagtctagtgcatataaaattagagtgaaggaagaatagaaggttggtaactgatccccttcataaaatatcagtgtgtctgagaattacatgggaggccatgagaaattgccatttgtattcccagtagtgttttgttttaaacattaaaagattctgtgttaatctaaacacaatatacctcacaaatttattactattagatattttaaacaattttgagactctctggtctgtttaactctctctgtatttttatttccagaacacattgagctctgttgactttctgacttatcacgctttctcttacaagtcattcgttatcgtctctgaattctcagtgtcctccattatgagtaatctcccttcattcctaatctttcttcattatttgctatcttgtttcacttctcttctattcaaactgctcattccgtagctctgccagtgctggctgctctgtctctcacactccacttattttaagagtctggttcagattcttttgactacctggatcaagcagtatgtactgattattttactgttataaactcaaaaatcttagtagtttatacctacagagattgtttctcattaacactgcttataaagcataggtcagctgaaggctctgttccatattttctcactcaaggactcaggctgatggagccactaccacgtggtgtgcttttacttctgggaagcgaaatgagagaacatggtgaactgcagaccgtctctcaaaagtttctttgcagaagtgaaagtacacaacttctgcttacattccttgatcaaggtaaaccatattactgtgctcaacttaaaggtaagaaaagagtacaatattccatgtacacaaagaaagacaaagtggaatgtagttaaatagccctaatgcttaacctatttcccattgctgttttaattcatggtttctctagaacccagaaaaaaatacatgcttctttgaggctcatttctctggatataccattcctttcattcttatgttatcacctactcactttctgatcacaattacatatgcaccatttattttgggaatggactcatagcctttcactttaagagagccaatttcatagttttatttgaattcagtgtccttacggaagactcatccattaccctggactctatgcttcttgggttcttgaacctctcagccacctagtcctaaagtcacatcatagtcatgatcataacctaaaggacagcgacaattatatcaataatctgaaaattcaaatcatttctgcttgcttgttaatttggttgatctcactacatttttttttttttaccccatccaacccctgagttgggcaactggaagaagctgtattagcatgaaaataagtagccccagaactccagaaactgtgtgcctttatgggctgatactcctatttcggggtaggtaaacttggaccacagaagttcactttcaaatggaaagtgaggtctcacgatttcaagcagtgaaactcaaaaactcagccagacaggcatcagtgacgttttgactttacaagaaattggaggaaattttgtccaccaacccatagcctaaaaataaaactgctgactcaatagggccctagattcatatggcttattttaaataaccgacaagttgaaacatcatgttgtcccttggactactgtggctatctagtgtcagagccaactacacaaaaactaaactgaatgtgatcattctggttagtgggcagaactcaaggctattcttatgtctagctatgatccttgagttgtttccagtgacctgaatatttggtttgctcatcagactagcagattaaatatacccttctttggggtaaccaaatatagaaaaacattgtggctgctaattggacagtttgggtcactaatgagttcagaatctgtgtttatttactgctatattgctctttctcactcataagttatctcaaatattccataaatcttctcctaaccactccactgatctcttgcttatataatttattgtgttcttatagtttctctgggtatttcttgcttcaaagagttgtgtataagctctgggagggatcatgtttaaatatcttgacattcttactctgccaagtctatcagtggatactgattaatagattctgtcatattatttcacagtcgagaaaatagaaatttactgtattttactatgagatatatttatatgaactcttttaactagtgaagggatgataattaccttctgaaattagggatatttaacatttttataattttgtcttagttccaagtcttatttttatatctaaacagaagagtaatttgattgattattacttcattttattcctggaaaaactgcatgaacatatgagaataataagaattggtagcattcaaacatagtagctaacaacatcccacaacatattactttatatttgatatcagagattccatctgaattgtttcaattaaaatatatttataaaaagagagcttagttttccttgtcctcaaaatatgcaacatattgtcttcatttcagcaactaaaaataaagcaaaacaatcactaaactatttactcatttcatgtcttagtagtttattttcagaaaagagttgtatttgtactgaagtcactctacaaacttaggccaaataaaactttttatatatgcatctcaatcttcaaagtcttaaatttaataaccataaaaaattttgtggacttactttattgtttatagttgtgttttatttgattaatgtttttcaagtacttgtttgataaatatataataacattacattttaagtaatagccttgttttggttttatgtatgtttaaatataataattatagaatgtaacaccatattttatatataggtaattatctttggcagaataacttttttcacttaaattgtgatttcaaaagatgctaattacttcagaatcaagaaatcagtaatagctaaatcagaaacagaaaatattagaaacattgtttagtgcagcactatgctcatgaacaataaaaatgacagacatagtaatatctattataataatagaaataatacatatttggagtattgatatgcaagatctcagattatttttaaataaaagtttagtcttttaggaattatcactgtgaagaaaacaggaaatttctgcgtactgatatttttctagggaacaaaagtaacttgtctagtgcattaaatataaattccagctagcctgtgcaacattatcagaacacatctctaaaaaaaaaaaaaatagaaaaattggccagatgtggtggtgcatggctgtagtctgacctacccaagaggttgaggtgggaggatcccttgagcccaggattttaaggctgcaatgagctatgattgagccactgcaccctaccctgggtgacagagcaagaccctgtccctaaaaaataaataaataagtaaataaatttgtcttagtccattttcacgctgttgataaagacatacctgagactgggtaattcataaagaaaaagtagtttaatgaattcagttccatgtggctggggaggcctcacagtcatgggggaaggcaaaaggcatgtctcacatggtggcagacaagagagaatgagagccaagtgaaaggggaaaccccttataaaatcttcagatctcatgagacttattcattactatgagaacagtatgggggaaaccactcccatgattcaattatcttccactgggtccctcccacaacacctgtatattaagggagctacaattaaaaagagatttgggtggggacacagccaaaccatatcaacatttattccatggaaatattataataattctagtatagagaaatattaatatttatgaagcatacaattgagagtgcacaacaaaatcagatttgggtggggaataaaacaaaactaaactaaaacaattaatatcctcccccaaaactctagaaacattttagacccatagttattctgaagacatcagttaagtttatttttcattgtcattaatggcaagtttgataagtttactcaatattatttgaaattattagcaggcttatttcaccattagcaagaaggaggtgctgaagcagcagctaaatctattactttttttttttaaatgatttcctattcatgccctacaagtgtgagggaaatctctgaattttataactcaattgcccactttactttctttctgttgggcactgtgtggtaactacttggtttggtgaaaatgaactaaattaatatttctaaaacataagtttatgtttttgtaaactgcaaatacatattagattttgtatagtatgggaaatatacaatttaaacaagtttaatttttttatattttaaacttacgtagctttaatctcatcagttttttcttaaacaatacctagtgagtgctgacataaccatatgcggtaacttgtttatggtaataactaaaacagttaatcacagagatatttatgaaacattttagcagttattgactattatttatcatagcaaaaattaaaaatcatgcacataaaaaatctcattttttaaaattattttttatccttttatatgatcccagtattaaccatataatccagcatttctcattcatgctgccagagatggagacctcaacagaaacagtgggctgaagttgttggagagatgggagggttgaagtacaaggacgtttttattaaatatccctacctttactactatgcggtctttacaacaaaaatgacccaacagctaatctaaaagaagtatttgggtgaaaaaaaatcaatgaaaatacaaacctcaagagtattctctttggcaaataataataataataataataataataataatataataaagggggtcctgagggtagaattaccatgtgcaatagtgatagttttattcattcaaaaaatagttgtttagtgactactttgtgccagtcactgtactagacactggagttacagaattgggcaaaacagtgaaactccttactcaaaaggaacttacattctaatagaaaaagactgacaagtgacaatgtctgtttatggcacatttcatgaagaaaattaaagtactgtatggagataaagagtgatagaatgagtgttcaggaaagacccctttgagtaattgtcaggcaaatgtgataaccactatgctctggaaaccccattgcgaaagtgacatcaaagcaagcacatgaatgaaatgaaagaataagccatttgtgtgtataaagggacgagctttccagggagagggaatagcaagcgtaaggcctggaaaaaggaatgtgtacactcacttgaggattagcaaggcagacagagttgttgaaacaacagtgagaaagaccagaagaatgatggaactaatgttgataaagccatatcttgcaatgctttgtaggcaaacatgttctataagtcattggaggatactgagcagaaagtggtaatctggtatgtgttttagaaagaaccttctggagttaggatagaaaagagattctagttgggcaagaatgaaaataggggaccagttggagtccattgtaagagttcaggcaatgtgactaggttggtagtggcagagatggtgtgccatgtgtacagaagttgagttgtgttttctttcaagtgtacacagagacaaattatttgttcacattatgcattgtggagagtttaggaatgcgtggtattacttacatgtgacattatattgaatatggataattaactagcttaagtgtcttagttagaataaatattaccaatttattcgtatgaacttactactttaattattttacccattttattaagcatttaacaacatcatggaaaagaaaacaacgtttagaactgattttccagcgttaaactgcaagaacctttagaagtatgcataagatgtttcactgatgagatcatgtattataaaaataagatcattatgttctttgatttctgaaacttcataaagaagaaagcttcacaacatattcaaatttggagtcattgtgccattcatgaagatatgctttgttatctaatttttggtttaagtttccagaaattagaccaataatttttaccattgctttataagatataatcagtagattgctattagttatgtaactctgtaaaaagaattaatctgttctatctagatggttagttcaattgaaattatattattgtacaaataaattttatttctagagtaagactagaaaaaagtttcaattaaaaattctctgagtggttttctttgaaaattttagtaagttaaattgaaactgtattcagcaaacatttactaagcagttccttggtgtcaaattttatcctatgccttagggatgttaggttcattatgatcacaaagatgaataagacaatttggaagagtttcacatagaatggtggaatattaaattagtgcttattaagttaataagatagctgctgtgtaggtgtctttgttagatttccagggagggaaactttaccattccctcagtttagagttacatgctttgatcgaagggtatgcctgccggctttcaagtgtttttactctcacaggaactgagacaatacagttacaataatatgtgcattcaaatttctcatatcttattggttgacttatatgtgaaataaccagaaataacacaacataaattattgctacatgttaaattacatgattctgtttataaattatatacaaattcactgaagagaaattaatgtggatagagtattcaggaggaaaagaaccagagatgtgtcttatagaattcgaatactagagaaaaaagaatatcattttgggcagggaaataacaaagccagtaaaacaacagaaatggatatgatatatttgaatggttgtacagaaaaatagtgggaaatgagcattgttaagtcatctttggagccatactttccttaagatctcaggtttcgggttagctattctggttttgtttttcatttgtaaaaaggaaatcacactacaaattttgtagggttgtagtgagtatcaatagaggtgaaaatcttccaaataatatagcacatttttccctcataatagacacattaatgctagctattactatgatattcatttttctttccccttccaccttcccagtccagggctgcaaacacagcaaagttgttttaacacaatatatctactaactgaggatatggtaaaaacaacatattgttatttaaaaatatataatttattttttagtgaaatttgaggtttacagatgaattgtgcagaaagtagactttcctggaccccctccctttccatttccatacacattttcccctattattaacaacttccattagtgtagtacatttgttacagttgatgatttattattgatacatttatgattaaagtccatagtttacattagagttctctctttgtgttgtacaattttaatgagttttgataaatgcataatgtgtatccaccattatagcatcctacacaatggtttcaccaccctaaaatccttctgtgctccacatattcagcactatctcaattcttttgaatccttggcaaccactgatcttttactgtctctataattttgccttttcctggatgtcatataattggaatcataaagtacatggccttttcagaggctctgaacttgaccctctaaattctctggtgtctttcacttagcaatatgcatacaagtttcccccatgctttttcatggcttgaaagctcatttatttttataaatgaataatactattccattgtatggatgtaatacagtctgtttgtatattaaacttttaatgaaatgtctgaatgtgtctatctgtatccttttttttaagtggctaatatctttcataattaaaagtattatagtattacataatttctatttttctctttcatatttggaatagaatttttattttaagcaatgctaaataaattttaaaatttaatatatgactattcaatcctattaatatattcctatattacaacttttttggaataatgtagctgtgttcttttaatatgtgttatttgaatttttttctaacttttttgctgtatatgaattagaaatattttaccatttttcaagaatgcaatatattattacctataataatcattttatacaatagatctcttgaacctatttctcctatccaactgaagttttatttcctttgaccagcatcttgacaacctttcccgctacccctataatcagcccatcccctagtaaccaccattcttctttctacctttttttttttttttttttttttggagacagagtctccctctgttgcctggctggagtgcagtgttgcgatctcggctcactgcaacctccacctcctgggttcaagtgattcccctgcttcagcctcccgagtagctgggactacaggcgtgtgccaccacacctgggtatttttttttttgtattttagtagagatggagtttcaccatgttggccaggatggtctcgatctcctgacctcatgatcagctcacctcagcctcccaaagtgttgggattacaggtgtgagccagcgtgcctggcctcttctctctacttctatgaaattaattttttaatattctatataagaagagagtggatgtagtattttcaccataaaaatgataactatgtgaggtaatgcatatgttaattagctagactagtcatttcacaatgtatatgtacttcaaaacatcctgttgtgtacgataaatacataaaattttatctgtcaattaaaaaataaaaagttaccactttatagcatattcgcttatatggtttgtatgtgacaaaattttgcttttcatgtgcctaagagaaaggaggttacagaatgaagtaacacatacataaattgtgctgtgtagtcaaccctccaaacacagacaaactactactttatgttcattttttacctgaagtctatatttcttaaaataccactgcattagtccattctcacactgctataaagaactacctgagactgggtaatttatgaagaaaagaggttcaattgacttacagttctgtaagctgtataggaagcatggctatggaagcctcaggaaacttacaatcctggcggaaggagaggggaagcaagcaccctcctcacgtggcagagcatgggagagggggaagggggaagggagaagtgctacacacttttaaacaaccaggtctcctgagaactctatcaggagacagcagtagaagactggtgctaaaccatcagaaaccacctccatgatgcaatcacctcccgccaagcccgaccttcaacacgtgcagattaaaattcaatgtgagatttgggtgaagacatagagccaaaccatatcaactactttatttctgttaacaaagttgttcactttttcaaacaatttttagtttctcccttacgtcttagaggaagtgctgtttccttcctgcagaaaatactccctctgtctgcactctacacctgaacctctagattctgaaagactgtaatctatcaatcactagagttgtttctatatatttccctttccatctgtacaaattattgaatgaatgaatgaatgactcttctatgattccattgttggtttttgagatgcatgtcatggttacactctaggtatagattcccacaccttgactttatatcctggttccaatgattaattaactctatgaaaatgaacaagttttctaacttcgcaaggtttcattttccttatctgaaacaggaaataatagtaggattatgtaagttttatggggaatgtgacaattcctgtgaagttcttaacatagtgctgttgtacagcagctacctaaagaatattagcaattattgttttaaattgatattttatttgatttatgaatatgaaatgtgatgatgctctcccccagaatttttaaaacctttttcttcctagtttttagagaaatatctttctccgtagcccctctcaaagatactctttccaagcatttcaatgttctttctctgcacaccaccaacacacaaatgcacaaaaacacacacagagaataatattgtcaacaaacttttctaagtttcttcgttaagtcctttgacattgcctgagacaagaaaacatggagggataatttcatttttttatgtctttctctaactcttgacggtgaacattttgttctttactctttgaaagtttttacatttattaataataaaatgaatgtagcaatatagcttctcatcacagatgctttcattattttaaaatattgtaattatttcttacaatatattagagcttaagttcatctttgacagatgattataacctggtgagtgaaaagcattactaattcaacatatttaagctactgtggaaaattagcaactttgtgaaaatggaaaaactcatttcctaatgcgatttaggcaaggctgcaaggattttcattaaataatataaaacaaattagagggatagaaacaaaattcagaggtagtaaacagaatcacactgagagatgtttcaaacaatattttaactatttaaagactaaaatcttttaactgtattctatattttaaaatcagaaatgtctgttaattctcagctatataatttgatgtagttattattactattataatttgaccaatgtattaagaaaataattaatattaaatagatttttaaagtttaaaataaaagcaattttgaaaagtctagtagcataattcatgtactgagtgtacaatagtttcttcagttttttaattctatgaagtttttttttctatatctacttccaataaatgctgatttgctaatctagaagaacatagaaatgattagtgcaataaatcagattctttacttcagagtaaggaatgctttaaattttaacataatcgttactgaggcaattaagtgtaaagcctttgttttatttaatttgattactgattttttcttgtgactgaaaatcaattttttctctctttctttctttcttttttttttttttttgtttgtttctgtctacagaaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtaacatgctcacttttgtgatttttttggcaattgttacctcctttatctaactaataattgtcaaaagtcacaatcaattttactttttctgttctttattttccatggggtgctgagaaataatgaaattttaagaatcacattcatttattaaaatgtactgtcctgtctttgtgggcagagagcatgctggttgtgtcagtaagctataagtgttatagggattactgttttcttaaccagaatataaaagctttttaaatcaatatgataaatgaatcattgcctcacttcgaagatttctgaagaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaagtactttattgtcattgacatgtagggtatgtttcaagtcataggatcagaagataaaatgccaagctggcaaggtggctgatgcctataatccaaacactttgggagcccaagataggaggattgccttgaggtcaggggtttgagaccagcctggtcaacatagggagactctatctctataaataataaaaattaagaaaaaatgcctaaatgaaaaatatataaattttatattttaatagtggcctttaaaatctgtgatacagatcaatctatgttgatggtattactttattttactctcggaggtgtaaatttataatcatgtttatttatgcctacctcactatcaaactttcaactgatagattgtgtcaatatgatttaatttaacttttgctttaattaagaagattagtattgtgcctcaggactgatgactctattgacatggagttaagccacatattcattatattctttgaatttttacgtttttttaaatatcaaaaagataactctgaattaaaaatcaattagaattctacacataatttttcatggagataaaaatacctataaagtgtacatatatatatatatatatatatatatatgttttgtgctgtataaacaaaattaaatatgcagtgccttttcaattacattacatggattcttttgataaatttatcagtaagggtatttgtaaataatcgaactcatttttcaataaggaattaaacttttttttttccaatgaagtaatgtattttttttctagccataaaaatctttagttcattcagttaaaaattgatttaaatcaattagaagtagcataatattggccgggtgtggttgctcacgcctgtaatcccagcactttgggaggccaaggcgggcggatcacaaagtcaggagattgagaccatcctggccaaaatggtgaaaccccgtctttactaaaaatacaaaaattaactgggcgtggtggtgtgcacctgtagtcccagatacttgggaggctgaggcaggagaatcgcttgaacctgggaggtggaggttgcagtaagccgagatcgtgccactgcactccagcctgggagatatagcaggactccatctcaaaaaaaaaaaaaaaaaaaaaggtggattatatttttatatatttgcacacagataattttttacatatttatatgtaattattttacaaatgcattatttttacctaattagttagatattaagaattgtgttcttcagataattattatttgcatttgcctaaaactatgtattggaagcatattgccatatagcatttgaagctgtacagtagagcttattaaaattttatgtgacttttggggttctccccacagtaatgagaatttgaagtatgaagttcctaacattttagctccagctttttctaccttctgtgaaaataaaacagccttcacattttttatcatctttagaccaactgcatcttttttatagtgacagacacagccactctagtttatgtgttcagagaaataagtgcaagagtttcagattaagcaattcagtgcctagaaaactcttcagccagcccacaggtcaaacagaaaaataaatactccaaaatatacaaaaagtcttccttaatgtttgcatgtacccttgtttttttttaaattaacaaatttcccaggaggatagaaataaagcctagacgaaagtgtcatgagacaacttcgaggtaactgtgtgggcattagtcaagctgaattaggtctaacagtacttttctggaggtcttagacacagagttttgggttacttcaaatttgtattaggaaatttagttattcctaattttccaagcccacggcttttgaagttagattcaaagcaaatactgaaacatctggtttcctttctagcttaaaaaagtacatttgcaaatagaggcatatggatggatatgcacttatctaacttttcaaaatatttctgtaactcacttgataaaccatcatagacagcatctgtataattatggtaatctgtactgattttacgtgaaagaaattcaagtatgtcatcctatttgagaacataaagtcagctaatgtaccagttttttttttactgctactgcttttatattttgaaatgttactgttatattttgtcatagtttttaagtgaacagataggaaaatgatactatttcagcttcttattccacaatttcaaaacaaattgcctcataaaaaaataagtttaaatcatcatttatgggtgaattaatagatattgcattaagtaataatggtagacaaactgtattaagcaatatataatattagagattcttggtaaagtaataacacaaggataaatattttctggattttctcagaatattttgttcaattttcaatcttaaaataatcttgtttaaaatatttctgaatttgaaaaaataaaactgaaaaatcagattaaaagcaaagtctgaatatggtcaatttaaattttaaattctgaacatccaaaaatcaaatgaatttgtttaattaaaatatactctgacatagtattgaacttttactataaaagaagtttgtgacatgcaaaggcaaataaaatgttcaagtttaaactgtataatttaattgcctttgtaatttaaatggaatcactatctgttagaatttaaaatacatttattttaatgcttcctttagcatttttattttacctatcgaaaaaattatgtcttatgtcatatagaggtcactgatatactcattgacataattgttgatatcataattaatatggtattttaagtatattctttgtctccataacaattatagataaaagaaagatcatgtttcaaaaaattcttaagtatgtattttattttcattgaaggtcacagaaacaaaggcataaaataactaccactttaataacagatttcgtatttattaattattggaatctacataatattaactgttagggaattatgtaatacttaggaataaaaacgctgtatctcaaaactaaattataatgagtgatttaaatattgtcaaaatttctcaacattattaattttacttttgttttggtcattatctgatgtcatttctgttattattattacaattaacctgctatatcttcttagctaccaaaccacacctttgattggttttgtttcctcttttgtttaattattctatcaactgctcactcaattagtcaaatatttgttgagcctctagtaagcactaattagatcccataaaatattaaacatttatttctcatttattcatttatttattcaacaatatctattggctacccgtaagtactaagagttgtgccaaatgcttgaatcccagaatgaacccaactgaatatgttattttcactaataactcacaatcagtgcatatatctggcaatatatatctattacccttgaataaatttataataatacttaaatcatcttaaattctgtaagaatgccatgtattttaaatacgcttttctgaaaaatatcttgtaatatatattttgctggagagaaacatacaactagaaaggaaatatgaggaagattgttatgttgtcattagactactagattagaagcttattgaatatctgctctactatcatattaataatattaattttattacaaattaagatctaataataattgttagaatttatgtttttaaaattggatttaaaagtagattattttgtcaatgccttttaaaaatttcccctcacatgttaagaaaaaatatctaagaatacttaataaatgttttaaatatatttaaccaatactgagaaggagatgtatggtgttggtttttgtctccatatagttttatattttatgatctcctgtaagcagttatattattatttatagcataatgacataatcagcatgcttatctgaattagctctgaatgttaattaagagtaaggattagcctgggatagtgctttctagacatagaatgaccttatcccaaaattctaatggtagctctttgctgacagagaattaggaagaaatcttgtccgggatgggttcatgcttactcagattttcccctaaatgttttctcctcctttttctttctcttttctttcacctaggcatatgattatagagatggcagttagtcatataaaaagtctggttagggcacccaccccttacattaataataaaatatatttttcaccttgcttcaaatatttattttattaaactaaagctactattgatataatagaaaatgtttataaaatgactccattaaaattcccatatatgttaggttttttttcctcttaaccatatatatctccaagaaaattgagctgttctgaaattcattattggtctagggttcttagcagtttgatgtacagagatgaataactgaagaccaaacctaaaagaaaggaataatggtacacacatatccctccaacaggattgatgtaaccttaataattattcactaagtctttaatagtgcatatcttattttgaaattggcatttacaaatacaaataaactttggagaataaattactataccaaattttgcaatatgagtactattacataaaaatgcattaggctatttaaatgaacaaatgattagggtcaaatagaggagaaagtgtaaaggaaggcaaacagtattaagtaacctggacttcttagctagaagagtaaatcaaagaatattcaatgtgttacatgcataacatttttctaagttaaaagaatataggaattttttgtgcatttctgtatataattgcctttaattatttttagagtattagaatattatctatcatattagtgggttaggcagcagggcatggactccccagaatctactcaatggtttattatttacagtgaccaccaacactgtcttaactttatattttggcttaactgtttgatggttgaactgactttagaaaaccatatccaaagtgcttacattaacagctttgatctcagctatggactagcgtgcaatagctttcatatttttgtcacagtgatgggtgacatttaatgtacggtgaaggacaacattgaattattatgcacttaaaaatagataactgttttggtgggatgttcagtgttaaactaatccgctgtcaaaacgactgttgtcacattaaaatgaaatgccaattttgttgtttgtctttgccaccaacttgccagctttttaccaaaaaaaacgatttcaattttaactttccataacataactttagatatattttatttttaatgtcctattttttacttaaataaattgcagaaaagcctatttattattattcttcacacttagcaattttcctaaaatttactgaaaatttagttttaaatacgtgctgttctgctaatatgcctgtcacatattaaagtgattgctaaaattgattaaatattgacaaatatttatctaaattatggacctaaaagtaaacattgatgaaaattagatatattttcaaactgtggattaaaatatttccatagtagatgaggctacttctgcactaaataatatttttaaaattattattttttgttacaatgtacctctttattttagtggttccagtgatgtttatggttgcaagtatatgtggagtcaccaacccagaaaaaattcttagtttgtatctttagtagaaccaaaccaattgaaactaagttgaatcaatgacttcttttcagttgtgataaatatggtattgaggtaattgaggcaacagagctcttgactgaaagtatccatgtaggacaaagaagataatttaatcttcagaggagaaatcaaacatattttccacctctcaatttttaaattatgccagacatttacaggtgtaaaagatttgagaaaaaattgagtaagacaaaggcaatttaaaattaatgtgctttttctgtaattttctgtaatcaaatgctagttggcattttttaaggataaacatgcttatttattttttagaagtatctacatcaatctacaaattatttttttcacataaatataatttattgttaggccaaaattaagtataaacgcaagagcagaaatttgatagcccatctttatttttcaaattctatggataaattattggcctctgtatccttctttgcctccatcaccagaattgagtggaaagactcctggaagcaaaaagacttcctctttctagtcattttaagtgtttccactggaaaaatatcttggccaatgaacttctgagaactatggtcatctgtgatgatttgtttccatttagaagtttcataatgtctagctcagtaaatcacaaaattaattataataagttacagtttatggggtgatatgaagaaactcagagtgctaaaacttgaagtacaacgcttattaaattcttatatttgctaccaaaaaatggcacctctgttcttaatcaattctttatggaacatgtcattgtatttaacacacacacacacacacacacacacacacacacagacacatacacatgcacacacatctgataagagcagcacacgtataaaaaatttttttaaagatttggacaatggagtgtagtgggttctttggcagttactaatgtgtcttttatacatttctcactagctaattcaagctgagaagctaataggacaagaataatactggtttatcttccactttattctttttttctttttcctttcttccttttttttggaccagaataaatatttttttgaggtgtcttttaagaaccaacaggataaggaaaaacaatcattttttaccaagtgatacactttttcttttatgttttgttgtttctagatagcaacattttttcatagcggcagaatactgtgaattgcttgtaagaatacacctctccaggctggtctgtctgtggtaattctcaaaacaaaatttcacttctgttttccatagccactggaaaaatggtgcccttggtctttttggaagctttctcagtcaacctaagaaaggtcttctcaatctgaaacaactattccagcaaaatcagtggctttaaaaaatttcaatttttttaaatgaaatattttaatccacaatgtctagtaaagacaggcgacatcttttatatgaacatatacctttaaaaagtgaagtctgtgcaggaagccagtgacataaagataatgaagaaataaagaattgtttactaggtatttttctttcattctgtatgtcttaatgattaggagtactgtgctcataaaaaggcaattgtcttgagaaatgtagaaaaataggtcagtattttttttctttaatgccaaacatgacacttaaattagttacaattttacttggataaagctgtccttttgctgtaaattatttggggtaagagtcctttcaaatggatggttgtctatgcagtcttgtaccagagtggtgggtcaggtgagggacaattgagagaaaaaagaagaaaactaatacgtattgcatgtcaacagtagccagattatatttgagaactataaagagattcatttattacctttttttaaaattagtaactgtgtgtttttatgatatgatttaaggaataaatacatatatagcagcccccagcccctcaccctcaccacaaatgagattagagatgttttctttttgttgaatgctgttattgtaacactttttaattttaacttattatgaagaagaatgtgacactaaagaaaaaataaatttagaagaaaatggaaaacatattcagaaaagcatttgtatcacttgatttgttttgcctatcatgttaactttaccttctagtttttcttcccaaaatttagaaacttggcagttttttttatttaaagtatgctctattaaatatttttactacatgttagtagtatacggttttacagtaacagataattccttgaaaaaaaaatccttagttagctgtacttaagaagtatgtctttttctttagattgcaaataagaaagcttgaaaactttccaatcaactgggcacctagacaggagacattagcaaccaaatgtgtagatttgctttataaagctagtctctggaaatgctaacactttttccctgaaaattattagctacgtgttataaagctagtctctggaaatgctaacactttttccctgaaaattattagctacgtgtattaaaagaataaaacaacattgtgagtttttctgaagactcaagtggtattagtattgttttttcataattcatggatatgagagaaatatcaatgttaaataataatgtacagacaaaattttagtgataaatcacatctttctttatactaagtaaaattatgcactctatccaaataattaatgagtaggagatatagtgtcatcaaccagtgtaacttcattcattagagcatctcacaacaccttaattgctataattttttacattccattacataattacatcattcaagttaaactgttttcatatcaatcctgttgggtatacatatatagaaagagagaggtttctttttgttgtttttgttttttttttttttaagaaaaaatatcgtggctgtcctaaatagtaatgggaatttcaatatctttggatagaaatatcttggttgatctatttcgtatataaatataattagtaaaacaaatgaccatgcaaactattctattaacttttaatatgtatagtttttctagttagctcttgtgtaataaagctgactatgaaaatataaagttatctctctaagaaacttgttgattttatactcatttttgaaattttgtttggaagcccagaaattcacgtttcattcctaatgacagtaaaccatattaatgaagttattatatgtatttgcatttcaagcctatagttattttttctattttatttaatgagcattgattgaaacagactttcagttttaataccttctaacttatataaaggatgatttttctctttccccgcctggatataacatagtttcctgctattctttataagagatgttaaatcctaaattaattacttttaacatttcgctttctcatgggcttctgactacacctgagatgataaaatgagatgaacgcatttgcagtaaattttcctattaaatggataaacttaatatttgaagcaaaggtgaaattgtaggttttgaatgttactggcatgataaagttataaacagaatagggctacaactgtcatctaagttggttcagaatatgcacctgaatattattttaacataataaaattaggtaagtgtttccctgcttcccttactattcttggtaatggggggtgctgggaggtgtatttcagtataagttcagcaattcactagactgaagatatgttttggaaactggtaataatctagtgattttacaaaataagaaacattaaaaatagagaaaattttgcttgtaaatggacatacaaaaataagattcatacttagagaaatgtgtatttattttaaaatgttgatattactacttcaattttcaattagagcttcaatatttaggaagatattaaaaataatgttttaaatcatccacctaagaatttaaacatatttattttggagccaggcgctgtggctcacgcttgtaatcccagcactttgggaggccgaggtgggcagatcacctgaggtcaggagttcaagaccagcctgaccaacatagagaaaccccgtctccactaaaaatataaaattagccgggcgtggtggcacatgcctgtaatcccagctactagggaggctgaggcaggagaatcgcttgaacctgggaggcagaggtagcggtgagccgagatcgtgagccgagatcgcgccattgcactccagcctgggcaacaacaacaactacaaaatatatatttattttgatattttagttgaaaacaaaagtaatacatgatttccaaacatatttcagttgttttaggtagtaaactgtgtatagaatgcatatatataattttaaaatattttattgatttgtttgatacaatagagtgtctattttcaaaagacatttccaatttatttagtggggatgtagaaaacccacaagtcattcagctttgtgaaagatgttataaaaattatttttataggtaaaatttcctgcaaaaaagaaaactttacgtgccttatatcttgatggtagctgtggctatttttgtgtcatccagataattgcatattagttaattcaatttaaatggccagatgattttatcctttccaatgctagcttcaagtccttgttgataacatcatttacttactgagtgtccttgtttttttttttcttaaaaaaagcatagttttattttttattattagaaatctcttgaccttctgacttatctgaggacagtctgcctgaagtctgttaattctggatttactgctattaaaatccttagcaagtttttactgcaagctaaacatttgcttttgacctgtgattaattcaaatgtaaatcactctcatagttcttttaaaataactactttttaagtttggtattttatttgcaaataaatagctatattggtaagaaataattttttacaagacaaacctatgtttttttatgtaatattatatgtgagccattttccttactattctcaatttaaagccactcttaatttgattggacaattgggtgttttagaaaaaaaatgtatattgatagccagtgaatggaactacatgatagccattgtatattaaaaaatagaatccagttttgaatgtctaattatagtttttattttactttgacatttgtaaaattgcctgaattcatggcaaacaatattatgacttttcttcagaaatcttattataaaatgatcaatagatgattataataatttgtaatcccataacaatctcataaaataataatctcataacaataaggaataatcttggctacattaaataaactaaaatacagtataccattataactttaagtaataagaataagtcataaggatctgtaatcagcttattgatgaagttaatttcctataacaaatataaattttaagtggaagttagaagtcataaattctaaagttgattattttattgtttttagttatccatttaagactaaatcatatttatttttcattaagattatgtattttaaaaaattgaccacgatttaaatttgttatcactaacatattacaaatcagtagaactgatcattgttatcatttcactaagcctttcaaattcatttggatctactaaataatacatttaatagcatattattacaatgttaggtacaaaaatccttctacttcaccatgtacatctggtaactttctggtactaacactaccaattaaataatgtcgagcaattcatgaatcatctataaaattggcttaaaaatttaaatgatatttattgttcagtgatgtgatgatagtttaataattggctatggcagtgaaaagggctttcctttgtagcatttgccaattttcatagtttaaatattcccacaataacaaatatcaaactaccaatgggagggtcaccgaatacagatttgggaaaagagatgcaaaattagttattgcaagccagaatgagcaggccctaggataccactaatatgtaatatgttcaagagaagggaaaaacagtaagctgtaaaagttaatagcaggtagttcgggtggaatgtattgacatacaaatatacacaatgtatgaagaaggatatgtggaagataatgacaaggttgtagagccttgaaagcaaaagtaaaaagttaagttgttattaagataattacaacctcggaaacaattctaaacttaaagtaaatgtcagtttatcctcttgctcatttaaataagtttatacctaaacaattagcataacatttttgagttaactgtatatgaacatatctatggacaagagaaattataccaggaagactttagctatatgatgttttcagggaatgagtcattgtgaatattaatgttttcttaattattgagttttcaatactaaattacaaaaatttaactatttacatggaaatttttttaactacaacatattctttcctgcttataatttttaaccaaaagttcttaaaggaataaaactctttaagataatttagttgcaatattataaacatcaattatttttacctgaaagttcagtaatagcttcagggcctgtattagaagaaataggttccctcgcgggtaataggaaacttcaccatgttgtttgaattaataggggatgattgtgttcatagtctcaaattagacaaaattgaaacagcagctgaaaggtgttatcaaggaacctaacacctctatctacctgctacatcattcttagagacttttatcctcatagttacaagatacccattgaaaggccaggcattttatctgtatcccaggctgggaagaagggagaaaagagaaagagcaacctgcaaaagtcttcacctttttattcagaaaggagatgcttcctctctgtatatcttattaactagaattattttgcttagatcgccctagctgcaagagaggctgcagaaatggctttcttttatctgagcttactgccacttcagttcttttgttagaaaagtgatattattgggtatgttattggcagtggctgcccatagggatttattgaattgtgaagtaatgattcatcactcatgcaattctctcaaaatttttatttcaagtgctcatttctgaaattttctttttccttcattgtcatcagttatcagaatgcctgtctctaagcagtataactgctcccttcttgtttgttattttaaaccacattttctttaaaacaagttaatgaaacgtaaacaacgtatgaatagtaagtgcaagtatttcatgtcttagatttctgttatactttctttctggttctggtttatattgttgaaattcaaatttgccgaactagttttgtgtaagaaacatgaatcattactctaatattttaagtgatgctaccaaaatgtaaatttttaatgttgtagaaaataactctgatttattttgatgtgggatattcaaatacatcaatgtttttcccaacttctctatagccatgaagaagttggagcaaaaaaaaaaataatagttggtaaattgatacccttcataatgcccatataatataaatgcatcatagcatattttaggagagcttttacaaatcatcagatactaagctgtttctaggggaaaatatctctatgatcaaataaggtcaggagaactatgtagtagagttttcttttaggaattcactattaacaaattaaaggctctgaaaattcttgcaataaagaaatctgattaggtttgttgaactagcattgccccaacacttagccatggggccttttttttttctctgttaatctattatctctaattttatgttctctattagttaactttctgaatcaaagatgtgaagcattgctttaacatataagttcacttcaatttttttatcttcatcgtacacattctaaattgattaaatcacttgtaacaagactaagaatctagtctcctgattcctaatggaattatcagtgctcattttgctgatgtacatggaagcataagatcgtgtcacatctatttaagtgatagtttatgacttcatagaacttgtgtatagataacaatttgaagtttttaaaaaaattactgaaacaacatcattgcttcaatttttaatatcttcttttaagaaagtacatacaataaatgtgtaaatttacatttagttataaaattaaagtcatttaattttttaaaaaaatggctggtcttaggacaacctgttattatttattagtgaacttggtcagaaattcaagttttgttattaatcaaaaagataatcattggatacttaagaattttctaaatgcataaaaatttatgaaatcattagaaagttgggaaaaatcctcacaacctagcaaacaaattcccctttttaatactgtcaaatcataatttggaagcaagcatatgattaatgtaaagtccaattttgttagtattattaccttctgtggtaaaggagaaagtatgttagaaaacagttgataatttattttgtgtttattgcaagaatgaaattagttatctattctttataaatgatcagtactcaaggtggattaattatgtagattttaatttcatccacagttgtgaaactatacattttttacgattataatctttttgttggagtcttattagtctagcttatgacaaacaatgtacaagcagaactgaaagaaggtcattgtattttaaatctcatttacatgttagacaagaaatgacaattattaatgttctacttttggaatacaagtatatagtacaaaaagctaaaagagaagtagtgaattcagttcatatgtgagtctagagtgtctaaaacttgactgtagtgatattaaaatggtctgtttagagacaactagcaatttttatcttcatgtctctagtttgctcatcttgtgtaggttggacaggtagcaattttgaatggctcatcttaaaatgaatgcaattatcaaaggattatatggtccatcctgcaaggcattcactcattttaatctttcatttgcagctttctgactccttttatacaatttcatttatagttaatgggaagtgttatagcttagttttagcttactccaaataaaatatgtcgttagacaaaagcttcataaatagcagttattctttctcaaatttgaccaagtgttgtttgtttcttaaagttagtaaagttatattatttatttagtttgtgatcataacacacaaaacagcatgtatccaaaacattaaactgattatcataatttatagctagattgagattatataaattcatattccatcctaaacattaatgcacttgtttttttatttagtgatcttttcaccacctaaaatttattactactacatctatcaatcatctacctacctatttctattcatccatgcatcaatttatcaataagtattagcatataaatcagtgtgcaaaatttattttttaatgtctcgctcattcataatttctaatatgtatatatttggaataacctgccagtcactatacctactctttcagaaataaaaaatggaatttttatttattgtttgattaaatggaatagtactacatggggaaatgatgactttatgaataaatattctggataataaaagtagtttttactagagcaactaaagaaaatatgctgtagtttaatacagcaactaaaaatagtttgattttcttaactcaaatattaaagtgcgtttagatattttattgtataataaatcatatacaaaatattgtttcaaaaattccactcattgagagaaattaatgattaatgttctacttcttttggaatacatgtaccatagtacaaaaagctagaaaataactagtgaattccgctcctatgtgagcctagaatattgaaagcttgactgtagtgatattaaaattgcctgtctagagacaattagcaatttctcttttcatttttgacccagggaatttgaaggacttttgtgtgaaagaatttcctgcagattattaaactttcttgaatcataactataaaacaagatctgtgtgtgtgtgtgtgtgtttgtgtgtgtttaaaccttgggataaagactgtaaactccagagacttaaaaccatttactcccaaatttttgagtatgctctcactaagaagtgtggagaaatgcaaacgtaatgcatgttctgtctaagtggagggatttaaaatttattattgggaaaggacaaatgtacatgggaaggcaccagatgctattcaattagtccacctgaagatagcactgtaaaaggcataaaaagcaggctcaagaagtagttaataagaatggatggcatttcagtgttgagaattgcctgcagaggatgtaatcctaatggtatatttgtctataatgtatctaaaaacaatacaccggagtacaacaagtagcaattttatttgtagtttctgcctctattaaccacctgttgtctacctgagatttgatttacttgacctcataaatactggtccgcactagagtgtggtagcacagcaaagaacaacaaattgttgattgctatttttcctcatatgttattttacaaacttatcacttgttgcacagttgtgaactttgtacaaaggcaagaagcattttgaataacatggtaaaatgactacaatcataaagattttgctaacagtttctcagagatttgcagtataaagctaatgaaactgctgaatgtaattctgaaaatcttctggatatgatattttgaaagcagaggtataaagaagtgtatcaactgtacaacatgttaaggaatatatattagatatataacatttaaataagacattgggacataggtattttattttctaatacaaagtcttaagttcttgaaaaacttttaaatagaccaaattaggttagtggaataacaagaatagtttataaacatcatctgaatgctttaagacatttagggaaacttaattgtgtgattaaaaacgataaaagtgcatacagcatttcaaataaacctatggagttctaggcccctgtctgatttaaaagaaaaaaaaaagctgagcatatcattattggaacctcatgcttgaatgaagaagctgaaacttaaagaaataagatgacctaacaagaatccatatttaatcatagaactggagccagattggtgaccgcctgcagtgcaccacagtacgaaagcaacatttagccacccagtgacagaactttactttcacaactgtaagtaaagttcaaagtttaagtcttgagcatgcaggactttaatactcgtagctaacattgggttttgcggtttttaagaggaatctgtttcttcataatatttaatgttactttaggtattaggttattcttttttatctttttttctttcttcttttagaagatcttaaaatggtttcaatccataaaatatgactacgacataaactttagagttctatcagctatgtagtgtgtagcaatatgctacattttagtttttcacttatttcctcatttatcctttaagacattaagtagacactaatctttgtgcattcactcactgtttttcagggtctttggaattttcttcctcctctccccttttatcttcctcctccttcttcattttctgtaagaatgaagagcacatttctgaatttcccctttctttctcttcctactgtttcagtagttactgataggagcttttcagcatgatttggccactgttttttcagtcctacatcattctgtccgagctgtcatttagtaaagattaaatttagaagaaaattttatttattatattgtatttggttgttttaaaatataaataaaaatttgaagctggactagatttaataagaaattgttgagtcattttattatgtgcagctagtaagttggtgcaaaaataattacggttttgccaaaagtacattaaaattaatggcaaaaaccacaattattttgcaccagcctaatatttttacatactagtatttattgaactttttccttattatccttcatgcagcttagataatatatgaatgtttatatctaagctaacttgaaggaggaaagatttttgttgtagtcaatttacctattccttgattattatctttttagtacattacagataaatatatttacctataatgctatatttatataaaaattttaggacctataagttaatgttaccataaaaaagatccagggaagaggaagagagtaaatagatattagaacttacaagaaatagtaaataattatataaaataatgtaggctaatttattaaacttgctgtctttcaattaataaatttgcaaagtgtaatatgtttaacaaatgagtgcatacattcaagtaaaaatatttctatgaaaagacagataagataggaaggataaaaatggagatataatgttcatagcacattcagacaaactaaggcaaatgaaatatcaatcatattgagaacatcataaaattcttttggaatgaaaaggtgtttttatgcccctcccttgttttatacataagataactgaggcactgagtggttgaaagacatactagagatcacacagtcaaaggtgcaagaggactggaaatagggctctcaactagtatagaaattaaaggattctcttcaaaaaaataattttaaacagtgtttgaaattattagtaaaacccaacttcaaagtaaaaaacacaaaggttattctgtaacttttattaaggtactaccagctgttacacagggataaaatattattaataaaaataattgacctcataatcagtataaaagagattttgatggtaaatatttggacagattttactgaagtacaccaaataagaaaaaaatatataaacatgattattgttataatgtcctataaatctctataaataggaacaggaaggaataatttaaatgcctgcaatgagggtttcagagtgagtaaaaaatttttggatgctgaaggaagatagggttttctttttcttttttttttttttaaagatcatttgggatttagggaaaaaagtgtctactgctataagaagttggaacagttctatttgtttagtgaagtagatagtcaagcttgagatgaaaaaatattttgagaaattaaataactgatagctcaaagaaatgagtagtcacagatggacttcttggccttctttcgtgagcacatttcctgttttattggctttggataagtaaagctcctcaaatgaataaaaaatgaagaagaaaaaagcatccttgggaaatgcataaaatatgttcattgcctttttgaaaaaaataatgtgtgtatgtgtgtaagtgtgtttctgtatatctgtgtacatatacacacatacagatatatatgcattgtgtaatacagaacacaatgaatagatatatatagattaattctcattaaccagaattcataaacaattctcaaaggcattaagaaataatgcaatttttaacatctacatgtagagaataaaaaattttaattatgtaaaataatataatgcagcactatcagaaataaaaatctgataaaatcagaaatgttatgagttttgagaacagataaactgatagaagtgttgtataaaatctctagtaattgttttaaaaataatgtattattaaaactcttagtatatgtagttatagaatttgagtattaaacagaatcacttaaattattttaaatatctttataaagaatcagaaacatttaataaatattggcagtggtatatgtttctaaattaaaaatagaatgtctgcttataatcaaatgcataaacatgctgtatatgctaaacagtttagtcagtttttgcactaaaaactattatctgcaagttaaaatattataattaaacagtcatttttatgactatctagcaatatggcccaagtgactgggggattttgtttggtttttttaaatcttgattttaaatttgagtcaattgttactaatttactattattatactctctaatgtttgctttggccataagtaataacataagaaaaaatatattcttccattcttaaagtgaaaggagatagaagccaaatagttaaatatgaatgtcatcagttcaaatcaagtgttagcaatgtataattttgtgaggtttttcattggtaaatacatagtacttatttataaggaaagaacatagacctaatcatattgtatatttgagcatgttgtacatgtgaatcatatgactttcaggtgtattctctgttttttattttatacaaataaaataatagatctgccttttaaataatagatcttaccatttatcttgaaattgaaacaaagaagatcattagagagctacagaatgccatagaaattacaggaaaagaattaggtgactataactaaagggggtcacagtaaaataataccaacatacaccacacacacacacacacacacacacatacacaagcattggctaataatttttcaggtatctttatctaagataaataatttttcaagtatctttatctaagataatttttgttttacccttcagtggatttacttcacatatatgtatagtggccccttaaagagaggcagccaaacaaacactgcatttgtattattgctttcttatttctaccatataaaatgtaagggctgttttgtcttctgttggggatacagtaaacaagggagaaatgagctggtaaggagaggataaactacatctggaaaagtcagagctagtttgagatgggtaagcatgtaaagagaggaagaaagaaggaataatgaatgccaatcaggaagttggggctatagccaagaattttaactgtagcctccccagcaatatgaggtgcctgtcacaattacaaaactgtttgcctcattacatgaatcagtcaaatgatcagaccaaattggtattacatttcatcaatagattcttgatttttactgaatcaagaatattattatttatagttttataaaattcaggaaaatatgtatccactcttgtaaatgtatttgggtagctttattgtatctgctactggttcagaatgttttattttgggagatgctgacttaaagattatcctagacagcctttaaacttaaaggtaatcattatttgtaacactttgatttatttttaatcaactattttaacattgccgttcctttacctcatattgaatcttaacttactggaagcccctattctcaaaaatttgcctttaatactattcaaataatggtcccatccaaagttctcacaaaacattgtttgttttctacgtaaaacaacattcaaagagtaaaaataacttgagaacatttagtctaatatgatcatttttcagggaggaaaagtgaggtgaagtgactcatcttattacacaataatacacacacataatttaagtatgtaagttgaaaatcatgagctttaattgcattattataataaaggttttacaaaatcctgtcctgcttaagtaattacccttgtaatgtctacccttgtgagtgaatagataataagtaaggatttattttcaaaaagataataaacttgtgggttatcaattctagaaagaagctttagtgattaccaggggcaacgcacacacacacacacacacacacacacacacacagacacaaacacacacacacaaacacacacacagagaccgagagagagaaatcagcactatagacaagactatataatctgttgtatcaagacaactatcaattatattttttattgggtatacggctaacttgcacagacatcctaaaacattatttaaaaaaatggttggcaaatagaacaagtaatcagaggaagagcagaacctttaaaaaactcgttttcaaggcagcaaaaaactctaacagactctcttaagaagtgttttagctcccactacttagcattaataagtgtgaaagggattcccagtctcaggcctacatccctgtcagctcttagtatttacgtgcagctccttaattcatgctcaaagattatgttatcaacaatgattaccagtggtgggaaagccgggcttgaaaaggctgaataatggctaagactcgcttctcttcgtgcacatttaaaagcagtgctttcattgatagccaaaatcctgctaacaggggtgggtattattgtgcctactcctcagtttcatgaagagatctgttgtttcttagaatttccacgccacctcatctagtttcatgttgtttttccttgtgtcattaaaaaataccttgttcccactttttctgagtgctgtttccactgaggctggccatccagcagtggcctgaggttcttaatatttctctttattttttaaaggaaatgcatcttatgaggtagtgtttacaaaccagtcatattttagatcccaccactcattctgttgaagaaacttgcacttaagatgagagtaatgcaaagctcatttaaaaattctttatctttataggttaataatcattctgatattttgtttatttttcagaaaaatatgttactcgataaaacacagaaatagtatgattctggatatattttatttttgaatttaaagcagtaagattgattccatcagtagtttaaatacaaaataaatctgctcaagaagtagatcacaaaaaagacaggtagactgggtaaacaaggaattcatacaaatactctttgtccaaagtgtccaaaatttactagctatcaatattactacattgctctcgcttaataaaatacacacggaagaacagatacattttagtgattgttttattaactctataatacctctattatgcccaaggaactcctgtgtgcaatttattgaaaagcattagtatgataattattcatggaaaaagcagctctgctctgaatcttctacatccactggcatctacattctacataacactgaacaaagtgctaaagaatttcatttttctgtgtatatggacccaatgaaacaatagtatttttgagcacttattctattttcagtattgttctaatgctgtaagagatgtaaaattaaaatgacatacttcattcatttaatctattagtaagtgaattaaggctttaacatatgaaaatgatatcaaatgggcaataatgaagtgagcattttaggtggaggaggctaaaataaatatggagtagcatatttacctttcaaggagtgtatcatccaataagtgaattatgctttaaaatataagtagaatattaatgagctgtaataaaggaacatttttcctgggaggaagaacattaacaaagtaaagagatcttaatatgaatgctatgtaagatgttatatgagtgtcatgtatgagatatttttgatctatttagataaaccataagactcttgttagagcatagtagaaaaaatgatatgactcagctttctaaagccttgaatattgggcagaagaggttagagtttataaaaaagaaatattggtttcttgcagattcttgatcaatgaataaaaagtattaaagtttgagaagatttacttaatagtcataaatagaaaagacaaaagagatataggtgagagaatcaaaagatagggagatgtgttggtttggaggtaattagagcccaccaaaaattgtagtaataaggggagtgtgaaataaaaatggaaaggcaaattcaggaattattttgaaaaaaataggcaataaactttggtgatgtactagatgtggatatttaagaaaaagatagatgattttaagaattctaatctggattgtgggacaatgcttggattacctgccacattggttgaatatagacaggttgtcagtttggtatggagagcatgatcaatttgatattggtcatgctgagtatgaagtatagcattacccccagttacatctatctgtggtcagatgtaatatggaatgggttgagcactggtgagataccagtgaattcagctatatagatattctagctaatccaaaatcggcaaggggctattccaagaaaagagcaaataggctagctgtatattagtatggatgataatgactatattaagaatctgtcgacattatagtccttgcaatgtgggagttactttggtttggagtgtgagtcgtattactgatcctgacaatgtgttgcccccccaccacacccaagtgttactctttctaattggaaaccttttggcatagtgctaactagctaatatgctgcattcacttttatttactcttatcaaatgggattatgagtgtatgatatcaggtttcttgagctttcagttatattcaattgaaccaaatatatttacattcagttgtgtttattttatttaaaaccatcttcctaaattgtaaactgatatattatttcttagcttacataaaagtgttttctaaatgttttattactttcattcctttcttaaccatagtttaacttcatccaacttcaaaacatcaccatatcattttacattatgaagccttttacatctaagtatagaaaacgcattatagccttaactaacatcctgctcattaatgatttggaaggtaactgaaattaattatagctaggaaaatcttttccttagaaactaactctaaaagtacttaaatatgtacaattaaagaaaaaatgatacgggctgtgtgactcaaaactaatgcacacacaattactttttaagtaatatggataatttattgaacaataaaaatattttgggatatatgttatttataactaacaacagaagatgtataatagcaactgataacagaataacaaccattcttattgaaagaaattgccatgcaggttacataaactacgtatttggaatgatgactaaaaattttcaggctaagaagattgtttattattcattaagaaagtaaaaaattaaaaaaacaagcaaacaaataataaaacctaaaagtgaagtggtacttgctgaatataagaagatcacacagtttcacaggataatttggtatgtttgcagagcatgccactgaaaagaaacctttattttatttactatggaataaaacagtattttaggaaattatttcttagacttgtaataacattataaaagataactgcacagacgaaacttcagggtggcaaggatatttttacagaagattcttgtagtgaatccttgagtttcatatggatattataaaagaatgtaatggcagtgagtttgatatggtgccttccccaaagttacatgacattatgtttgataattgtttatcgtagacacatacaatgttttaagcttacttcttaatattttattttctgaaatcaatgtcaattaaaaattaatggttttgaaaaataagcaatctatcccggaaggtattttttccccctctcttcaaatatgtttagttaaattcctttaatttgatttatttcatttgagagatactgtgatctttcagaaaaattgctggggctcttgcttttagtatttcttcatggatttaaagagataactttttctaacagtgtaaaaaatagcaatattctattccatgtgaaaaataattcaaattcaggtggcaatgttaaaatatagtacaaacataatactgtaaagtttaggcttcaggtaaatttgaatgttccttaaggatttcatatctatgcatatattatttaattttaacatttgaaatatttatattattaggcttgatatggcagtaaataaaaaataacatttattccataatatttttaatagaaattagttaatacacttattaactaaagcatgatcttttcttgagcatttgtgacgttttttgtattctgataatatcacagactttatgaccaaatcttaattattgaatgctctcagtgtgcatgatttggttctacatagtgaaggatataaatatgttaaaaagtgatgaagcaggaagtcttctattcgagtgaaaattaaggaattactcattgattggaaagtaggaaaaactagaaatagtattcctctataattaggaataaattagatcataggaattcccttttcttgttttatgggaaatgataaagattgaaatgctgactggaatggattgcaataagagagtaggaacattttcacaggcgatctccattacagacctgactcaaaccttctgtgcacttcagagatacctgatttatacaaaactgaatttttatactaatgtaatagttttcttaagtcatttgttacagttcagaatgagacaatatagctaagtttgtttcataattggcaagtgtgacacaaacatcaggtgatgttattattcattatatgtaacattttcaatagtttattatttaaatttgccatctctgtaatgcctcaccttattctttcatggcttgttttaaacaattttagtcgcaggcaagtctgctttacaaaggcttgagatgttcccattttatgcctgatcccactacagatgtcatgaaaatggcataatttcagcagattgtacttaacagataggtggtaaggttgtctattatctgataagcctgtagagacctcatttcctttcttcctgacatttaatctaattttctgccaagtatgatagttgttataactggcccttctcaggccatttatgggttaaactaatagtaatttcataccctagaagtagagttaccctagcaactctcagtccatctagatccaatttctaaaaatactctctcatttctggctattttcttttgtactggagacacaactatgaagtccatttccacgttctgcttctcaagaaaatgccaaacacaccagtggatccatgctcacttgtgttggcaccaaactggcctgatcacctatgttgaaaaagcacatggctcatttaaataatgctgaaaagttgagcatagctgaagtgtaggatgattttaaaaaaatccagagttgagcctgaaaacatggcttatagtcattctgtgaaagtttttaacgtatatgggtttttagtgtagcaattacctgttttccatttctctcctaaataaccaagttagcattaccttgtcacttgcctttttttttttaagtttggatgatgtaacttctcttattaagaaggactactgtattttcttttgagaattttatatttttattcaacaaagtgtaccactccttagcaaatagtaatcatccttcaaaatattcttttttccccacaaatacagaagtaacaattgaaaatttgaatatcaaattttgaatttttaaattactttggaaattaaagtaaaaagtagtaagagatcacgtcttcacattattagtttaactatatgcccatgaaaagaaaaacaaagtcacagtaaatatgaaaatagtatgtaatgaaaaaaaaaactttgtattcctcgtactagaatgtttgtttatacttgattttgaaaatgattgtgtctattttgtttaagacaaattaatgtgaaaagctatttattttccctattccaatccatttactcccatctataaaatgaggtggggaattaatatgtcaacaaagcaattaagtagaacaaaaaaaccagaatattaccgttaactgctgttaaatttttaaacaagatttgctttgaatttttcataacacgtgaaagttgaggattgttatgtaataatgatgatgatgaaaaaataaacacatattgaatttaaattctgacatataaataggacacattctagaaaggccatttcagcttaaggaaaaaaagtgttcaaatgtgtaaaatatatcactaattggcttaaaattatatatgttataaaaatcatttttgtactcttcattagttgtaatgtagtttgcctgtgatatgacaaagtgttcaaattaatgttgaattagcttttttttcaaaaaatggtaatgtattccctcaatgagtagtagattattttatatattttctaaattatttctttgctctaaaggtctagagtaagaaatctttaaacaaggattatatactttcagctaacatttatgtagcaatatgtagtttgaaaacggctttgcacatattatctctcatgctgagttttcccgcctcctctttagaaataaatattcagctcagagagatttagtgatctgtcaccacatacaaagtatgtatttggctggaattcaaaccttccagtctcaaaacttgtagtcattctattatgcctcttttaggcactgaagtaatgcaagtgctaataataatgaggaggaggagaatgatttttaaaagtccatctctcaaaggcctcatgaaactctggaaatacaaaattgatacatgaaatcacattagtacagcaaaagacagtaggtgataaatagatatttgaaacagatcaacttttgggcaaaagcaaacactatggaatttcagaaaggagtagcatagaagccagttgggtgaattaactgaagaggaagaggacttttcacttaatagaaacagcataaacaaaggcataatgagacaatgggccagtctacataatagtttgaataaagttaaaaatattgagtcatattatattgagccttgaaattcagagacagagaaagttaaacctaataattcagtagttaatagatattgattctacacaaggggagtttcatgatgcataacttaatatgaggatagttttacaagacaaaaatggagaaaaggagaatcaagtagagacagttttagaaagtccgtgattaagaatggaaacaaaagtgcaatgaagtcggtaagatgaatcaaagatacatttttaaaaagttgacatgtcttaagcatagtttgtatttaagtaaaaatagtaaaagaagatacactttaagtctcaagagctcagagaagtgacacatcaatttagaaaaggagaaattgggaaacagagataatatgggggaagttatttggttcaattttaaacattttaagcatgaggtaatggtgagctacctaggtaggaagttacagagatggatggaaatccattgagggagaatttatggctgtaaattaagagagttttgtaatcatcagtatagaagttaaagtcatgagtgtgttaagtgattaaggaagaaggaaagttttgagagctgaaacagagccatgacagattatctgttagtggggcagagagtgagaaacaagggtgcatgtcagaagttcaaagggaaggcatcattcaataataatggtattagaagttcaaaaatggttaaaaagtagatttgaggaacaagacaatggatttaaaagcaagattttaaaacaatggaagtttaggattaaggagaaattaggtgtaaagatataggagaataatcattttagatgtttggccagaatttgaaaaagaaagagagaagtaaaaggaacatacaaataattcaaatatgtttcaaatgctcacttttttaaaaaccttgtgctaaaaatttgaggagatgcaaagataaataaagaactgtattgggatgtattcaattacaatataatggaaaagggaaaagatgtgcattaatttatagtgaagaaaccaggctgtgataagtatgacttgaccctcttcattttataaatatggagaaaagaaagatatacttgggttacacaagtagtggttaagcgtctctaatgaagacagcccaaaataaaatagcttgaattagtggacatttatttctctctcatccccaatcgagagaacagtccagctctggtgggacagctctgttttcctcagcaaggggcttctaatacttctctatttagcaccatttcctaaaatgaggaagattccagggcaaatgtctttaatgagaattttcagaaagttgtgcatattgcttctaatcgtatgtcagtggctcaaattgggttgaataacaagagcagatgagaagtacagttttagctgggcatcaatgttactactaaaacccaaggaggaaaacaaatactgagcgatagtcatcagtctctattatagatatcctccatgaagagagaatgaggaaagttactgaatggtagtactgggtagtattgaaggatgggtgtaggatttgaatatctatggagtgaagagtagggaattacagggtaaatgacaatatgagcaaagaaatgaataagaataaatacagggctttttttttttggaaaggggggtcagagatcacatttgctaagaaaagtggatcataatcttgaaatgtttttgaaggaaagtgtgaagaatcttgaattccatgtttaaagtctggatattttatatatggacaatggacacaattaaagatttttaaaatagagatgtgatattatgggaattattccacattaaaatcaactgggaagcggtatatagagattagaaatttgaataaaaagtggaaagtccagttaggagactactgctatggatatgacagcctgaactagtatagtgccaatgggaataaacagaaaatgggaagggcaagaaatgaaaaagacattctagaagtttaccgacataatttgacaactgctggagttttgggttatgaggcaaagaaatataaagaatggaagttgattcaaaggatattaagcctaagtgatttaagggctagtggcagggccactgcaattgttcatttaaggatgctggcaggtgatggtattaacagagataagaaatgtaataaaagaaaaattagtaaaaattgtgaattaatataggacactgtggtattggagagtctactgtcaggacagtggaaattcactttaagtcaagggagtgaataggatttaatatatatatttggggaaacaaataattgtatgagcagaaaaatattaatttggaggccaattgatttaaattatgatttaaatttaaaaagtgaatccgaaagagttggaagatgaggacagatactgaagcaagatctggaaacagggaagatagaattcagtgggacagtcaatcttagaggggtgagatgatttagcttaaaaaaataaataatggagctagaataagagttgtgttcacgttaatgtgagagagataaggtagaccacagacaaagcaatgcaaggccagtgagtaagagtgtgtgtgtgttgggagatattgcttgaaagtgggaatcggagataaaaagaattgacttacctttcctcactattagaggaatggtaatgaatcaaattgagaaagaggaaaagcttcccaagtattgccataaagagcaaattggaaattcatattggagaccatttttcttagcctgtatttgtatcttttggaagctttatccttttggatatcttcagtttaagaaaaaaagcagagaatgtgaggtaaaacatgtacattattttaatttaaatatcaatttaccaaacatttatttttttctcttttgaataaattatacaagagacttccttgaaaccagtgtcagtgttcccagattcttccttcctacctttctccatttccttccttccttccttccttccttccttccttccttccttccttccttccttccttccttccctcccttcctccctcactccttccttccattctttccttcctcttcagattatatagtctgagaaaatagaaaataaatttttcaaatgtatatgtataaatttggatatctccccaaccctacaaccacgtctcattcctctcatttcccatggaatcccttgaaacatctatataatacttcagggcttaaggaactctatgaaaaaactagtgatctcagtcaaacaaattacacagtctcactatctttagctatgtttctaggagttgtcatatgggaaaactaaatctagcttttatagaccagtttcatgttaatagctaatatacttttaagagtaggaaaaatatgttttaattatcaagaaattaaaattggaggttgaataactatagttgaagtcatagcatctaataatatttacttgctattattgtgtcaaagtattgaatatttgccacctgctggcactacattaacccatacaatcctttagaatacgcttatgggttaggtcttcctatttttctcatgctttgggcaggggaactaatggcatatggctgtgagggatggagatgggtgctctagcagcagagcccgttcatgatctaaccactaaatcacattgtctctcatgagcaatcaatgttttagatagttaatttaaagcggtaatattttttaaagaacacattcttgtataaagactgatggccaacattctgttacttggaaatactttaaaaaacgtgtataaactattctcattagcatgaaagtaataagggaatttaaatgaaaataaaatgtctaaaaccaaagctagttctatttcagtcagacacaacaaatcaacttactcttcaatcaacctttctgtttagtgtgtcagtttaacttagagaaccaaacaaaacacttttttgtttgtcaaggataggctattaaaacaagggtgttctaaaattgcattagaaagatgaaaatgatttgtttaatcttctgaattttcatatgtcaggaacattattgtgaagaaaattgagctctctgaagtgacggatacattattcaaataactttgattggatgtaagattttttttaatgctttcacaaagcggacatattctaatttggtttataaaagagtggctttaaaatttgaaatactgggaaaaatatttttttagttcaataattagacaaagcatatttaattgtgggtgtaatgtttatggataattccattaattgataaatatatctggattataattagcataaattatttgcaccttaataagtcctcagtttgaactacattagagatgttaagatttctaaagtcatctacaactggccttaaaaattagatttgattttttaaatcttaaaatagtggttcagataagttatagatttgaaacaaaataataaatggaaaacagtgagcctcagtatgaattcctgcttctaaaactgctttgatggctcggcgcggtggctcacgcctgtaatcctagcactttgggaggcccaggcaggcggattgtctgagctcaggagtttgagaccagcctgggcaacacagtgaaaccctgtctctattaaaatgcaaaaaattagctgggtgtggtggcatgcacctgtagtcacagctactccggaggctgaggcaggagaatcgcttgaacccaggaggcggaggttgcagtgagccgagattgtgccgctgcactcactccagcctgggggacaaagggagattctgtctccaaaaaaaaaaaaaaaaaaaaaaccacaacgctttgatactttgatatcatgctgattggcatgttctctgaaacctataataatgtcagaagcgtgtattagaatgcagtagattcttatttttttgtttctttagagttgagattttacacataaatatgtaaattcatagaatcattttgttagatacataattctgcattgattattttaatctctgttactttggtggtttctattatagcatgcaaaattcttatgatgattttatatttttttctgtctttaaaatactctacggtctttaaaaaatgtttcacaactaagtttgttttctactttaatgactttctagctttcaaatttttataaatcctgtacatacaatgcctaagtcttaaaaaatgttattggtttactgatatacagattttcctctaacaaataatgtatagtaagaaaatgcaatttcttactgtggaaattagctgataaggacagggatctttaaaatcgaacacttgcaggcacgtatatgaaatcttgtaaaaatgtctgtttctgctttctacttaaacttatctgtctttttgtttcttttgcagcaaaaaatgctggatagaatttcttcccactgcaatttaaatgtattcttttttctgtcaattaccacaggtttagtccttatgagtggtataatccacacccttgcaaccctgactcagacgtggtggaaaacaattttaccttgctaaatagtttctggtttggagttggagctctcatgcagcaaggtatacgattcagcctgctatttcctttgggcaccatgtcccactctttgctgggggtgacagctcttgctggcacaagtcgcttgcatgggtgcctctgtgcatgtaaccataatccagcttttccatcgacctaatgcatttaggccttctcaaatcccattcaagagagattctgagaaaataattagcttttgcaaatccacatagagtatactcatctatttttttccttaacctacagtagatacattatttcatagataaccaagctaacctgatcattagccagaagctgcatttaaactactacaaagattacatctccttgagacaagaatacagtgttatgctcctgtttcttgtctcattttgatgtaaaatcttctctttcatattaattcttggtgattagatgcatttgtattgcatgattagtaaatttactgcctataaatttgaagagttaaaatattaaaacatgaactttttgagtaaaatattagctgcatttgatagcatataagaatataaaatattgcatgctcggaagtgcatgcaaaaatactttttcgtaattatttaaactttataatatacatgttaaaattaaggctatatcttagaaaatgagataatacatgtactaatacgtcttaatggtttatatgtaactatgaatctactattttagtctcagtttttttcaagcagaattttaatatttgatgctatggtttcttttattaatcttttcacatttaaataaagtttaacaaattgctatgctagacctattactcaaaataaaatattttattagtcaaggtctaagactagttttgccaatttaaaatgtaacattttaaagttttaaaattagtaaataaagcaaaaaaatcccaaatttgaaaaactgacagtaaaggaagaaaaaaaaacatatttcttcataagagttatcatacctatcataaggtttgattttaagtttttgttgtgtatttaatatccactttgaagaaattcatttagtgattgcattacagatctgaagaagtggaaatttatgttgttataaaatgttgtttctaaaaaaggcatcgtgctattgcatgtttaattttatgcagaaatgcattaattcattactgtttcatttataaactatttcctaaagtgaaaatacataactacatgtcaaaagaaaaagtttaatttaccaataaataatctttaatacatattgtaagcatggcctactaaattgaaatgtttattgtataattattaatatatatgtaaactatatttttatatatagtttatgaatatttaaacctaaaacttgaaaatccagaaaacttttacatgagctaacctaagtttgtggcatctctttctaaataactcaaatgaagaatcagtagttatatttttcctttcctacattttcttacattttgggtccaagggttttttttttttttttttttttttcccttaggcttactctacccttagaagacattattgtagttctttcaaaataacagaagtgaatgaaaaagcccgtcatatggcacaaggttattttataagtagtgttgagtaatacaagtcacccaggcaaaactgctagtcgtctgttaataattagtagtctggagggagttatcctcataataaacatctgaccatagcaagactttcgttttaaaagtttcatatctctttgacaaagaaaacattctttttttctacttatattttaaaaaaatatttggaggtctttgagaatttgtatgctcataggacaaacttgctattagtagtatttaggaattagaggtaaaactctatgttattatctctgaagataatgacaagcaattcaagcaatgaaaaattcaaatatacatttgcttcgccacataactacgtcactgctggtggatacatgaaagaggaacccatactattctggctgatgcccagcttcccaggaattagtgggatatagtgctggacatgacgttaccttgagtacatgacagtcagcccctaaccaggctctgattcacaagactaggaggtactcgctttaagtccttgggtaagatatgaacttgtggtaattgggccatttatgtcaaatgtctccactattcttttctttcccagtcttgtttgactttattggtgttgttgtttaaacaaaacaaaacaaaacacaaaaaaagcaaaataggcagccaatgctgctcatcatcttgggagtatttagtgtttcagtgtccgagtgtgtgtctgacagggcctaggagcaactacatcagaaaggtacttttctgtttttttttccttacagagctgtaggcagaatctggagctggagttggctgtcatgtccaagtttgtctgcttttaaaattttgtttgtttgtttgaaattgcaatggtaagatgaactgcagtataagatgggctgttttgatatagtgcagtcataataccacttatttttcaagcttcacatgaataatttgttttattttttattccatctaaagatgtgttaccttactgcatcagagattatactaaagatatgactgtaagtccgtctttgcttcattccattttactcaaacacaaataaaattaagtacttttagtctatgctttcttgatagattcaaaatgattaaaagtgaacagtaatatatgcatatctacaaatttagtataccttacttataaaaaaatcacacatactgatatatgtttatttaagcattaagaatataaacaatgtggtaagctgtaattaaaatttaaataacagaccaaattttaaattggtaggattttgttttatagtctaaatgaattaaaattaataatagtcaaaagtaaaatataattctcagatcccattcttttattaagatcatgagcaggcaactccagccgtacattctgatatagttataaaagatttatatatgtataaaaataaatgtgacaatttagctatatattcttattctaatttttttaattgatgctaaccatagtgatgggagatccttgcttatacaggagaacataatttattatcttattttaaaataaacattacactaaaaccccacatcatttcaagaaatgtgggcaatagtagttattttattattatacgtaacttttaaaaataacaagatagacaaaatgtttgagctacatgcacatgaaaagtgaaatttacaaaaagcttaagaaagggatccaaaagtatatttaagcacttcctctgaaaccctcataactaacaaaatatgaaaaaacaataaatgtggtttataaaccagaaagcctaaaaaatctcttctaatgctatttttattaaaaatgtttactcattaatattttaattggaactttgcatcatctcaggtagaacatgagtctcctgtcactatatttaaacaagaatgtcctaaaagattgtctattttctgaaaatagcctctgctttcccaatggttgttgcttgcttactaaagaaatatgtaaatctttgatttaagcttttattacacagtgattccattctgccactgtgacaaaaagtatctgattgctgatcaaattctctatattcgtttcacctttcccccactctctgttaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaaggtaagttctgctggttacctaaaatttacaaattaaaatgatagagcgcaaacttctctcgattcacaaatgtaagagtgtaacaacgccattatttgtgcacaattcttaataatagcatatacctcaaggggtggagaggtgtacaactgaacgtatgctcatcaagaccaatcattttaatctctgaaaatgctaaggaggttttgctttacaatattttgttcctgttttgaggaaaatcagcccaagggtaacattttttcccagtaagcttttctttttgaataaaacaaaatgtattttttgaaactgtaatagtaggatgttcagattctacaaaactttgctattccagaagaatagaataattactcggaaaaatgtttcccatacgtacatttacttttgttgaaatgaggcaagatttaagggctgaaaatacagagacagtccttattatctatacgttcaccaaggtaatagtctgggagacacagagttgaaaggggctgtcccattgaactcacagtggtttccagagagacagccctgtggaacatttaaatgaaagtgtgcttgtaaaaagtttctgtcatatagagtgccttgccctcgtctattttttctctcttctccttactcttgcctactcactgggccaaagtagaccagttgagggatttcactttaggtagctattaccactttataattccttttgtatcttaccaagtatttttacagtttttgtaggttgggcaaattttaaaacattgatattttctttctgtgttcacagaaacacaactggcagttcaaatgtacagtggaaatagtatttttttttaaaaaaatgattaattcaagctataaaataaattatttcatgaagcattcatcaggtttctatcgagtgccagaagttacacgacacattgagtattctaattctcactatcgaggagattatggtttagttggagacagaataataaacttaaaacatcactgaatttggttttatgtgacttaagtcagtattttgtcaaattatgcaactttgtaaaaatttttataaaattaactttaaaataaatttctggaggacatccaattcccccaaaaataagataaattagatttagtcaaatatttaaaatttaattattttcaaagtgaatttctcatatgactagattaagtattggatatggatttcacatttacttggaaaatcactgttatttaatcaaatttattgaataatcaaatataagcaaaacaatacgttcagtatggtcctatttgactatattaattgcgatggatcagtttttcttaattgaatattgagaatttataagatttcctttcttatcaaacgtgttaatatttttgtgtttttataaagaaataagctgctaggccaggcacgttggctcgtgcctgtaatctcagcactctgggaggccaaggtgggtggatcacttgatcccaggaggttgagaccagcctccataacatggcaaaattctgtctctacaaacagcccaaaaattagtgtggtgtggtggcatgcacctgtattcccagctacttgggaggctgaggctggagaatcacttgagccggggaggcagaggttgtagtgagctaagatggcgacatagcactccagcttgggcaactggagtgcaatcctgtctcaaaaaaaaaaaataaaataaaataaaataaataagtcgctgaaattgctaaacgtgcgttgttagtgtcaacaacttgaaggaagtgaatgcgtgatgcatttaatttattccaatatccaagtgacttttgaattgaatttgtaaaatataataatacaacctattgtacctaacacaaaaatttgacaccagaagtgtttatttctggttcataaacatttccgttttaattttattttttccagaagactcaaatattttgttttaaagttcaaatatactagtagcaaagttcatttttgaaaaatcagttaccaaacatatgtattttttctttataaaatttttatttttaagcttattttcttaattctttgtcttttcattctttcgttctttttttaatagttcaattgctttctgctatgcaatttttgcctactttcacttttccttgctactgacttttcttcttactcttttttatctcttgtttttctctcaaacacgagtgcctctagcaccttgagaaagtcgacacgacacagctttctatttccaacagcacatatattatttctttagaattgtatttggaatgtacacaagtcacaataaaaaccacacagtgataattactaagttgacaactaccttatgttgctaatattatcacatgctgagttctattttcctactgaaactaggaaaagaaaattagaactcacaagactacattaaatgttgatatttttggtattttaatgtagccttaaaagattccaatttcaatttcatgttttcactttttaagtgtatagttattccagctatggtaagaaatttaaaaaaaattctagcagtctggaattcaaaaactacctactcattttgaaactgtacagtgaaccagagactattttgtagtgtatttacattttatacaattctttcatttttcatttaacagccacacatacaaacactctaggaagcatccctaagacattgacttctaaaggaatctctatcttgtttttactaatttagcaagaccttgctgttaactaattgttctggaatacttccttccagaaaattattataaaaaacgatacagttttgttactactagcaagaagagctggctccagatatctggtgttaaagggtgtaaatcctcagcattgcaaagacatagcagagttacatagctgttcttcaacatcgaataattccatttccaaagaccatgattgattttgttcactgagctcaaggtgctcaaagcatattatcttcaagaaaaattcttccttcttttttctatatccattacacaccacacagactctcctcagagataaatgtaaagccatgactggaaaaaataattcaaaataggagatagtggttctcacattattttcatgtaagcaatagaaaactgcatggtatcaccaatatgttcttaatcatatttagatagtaaaatggatgacagtccaagaattttattaagaaacattaaaggaggagtcaaaacctacttggaatctgggaatttagtgtactagaactgaagtttcacccccgggctaaccattatgcaacatgttaccaagcaacaggaacattcttttctccctgaagtataaaggctaggagaatggaagcctatacattataggatcaaaaatcactcagctatagcctgtaggtgttatggctttttttgagaatgcttgtatttttgaagtgagtcacatgttttacaaaatgataccgagtgcccttgtttctatgaaatccatgactcaagttttccagtttttagaaattatttgtctggatttggcctacctgaaatctctgactttattatgtgcactaatacatatgtccatctaaaagatatagtatcaaaggaagaaacatgtgctcttttgtatggtcattaaacaaaatgttggcacatattttaaaaatgtaagctccatccaaattgatgtattcctagtcctgtgttgcattctatacctttacatctctttctctaatgcccattatgctcttttttcatccccatccacctctaccaacctaattggttatattctctttattccttagattctaatctatacatcacttattccagggaaactctcctgacccttttcataccaaaatctacccagtctgggtacagtgctcctcttttacattctttgaagttttttttttttaaacttacattattgttaaattactaatccaagatatgttttcttggttcctgtatgtttccatactctactgcacagcaggagaatagggattgaatgaatctatatcattcatttttgtatctctagttcttggcactgaacttacatgtcttgagcttgtgttaattattaattgccaccagaatattgcttaacaaacagccaaaaacttagtgacatgtaacataaacctttatttatcttccaagtcagctgtccttctcacagaaacttgagagcccaagtttctacatttacagactcagttccttctacaccagggtgacagtgcttttaccagtacaatttcttcttaacctttaaatgtgtctaactgaatctacttatactgtaaaagccacacacgccgttcttttaaaggcatgcctctcttcagactgaatcgttgctactttgggctagaggatctttatccaaatgagaaaatctacaaggtattgccttgacttttttagaggttctaagaaagcatctaaggcatcacgcttaatttgattcttaattaagccttgtggccacgttgagaaaattttaagaactttcgctggcagaagattagaaatacgtttgttatccaaccatgcaagttttatcccctctacatcacctctaaattcagcttgcaaagtggtcagtacttttaaattttcttttcctctcctcctcttcctcctctttttccttctccatctccttgctgttgtactgattactcgtctatctctttcttgtcctaccttacatgtagctaaaactagccagctgatactttgaacattttgtcattttgtttggctatcttttggctaaatccaaaagattattagttcattttctatctttcaagtcactacaactacaacgtgtaattaaaaataatattttcccctgtattcatggattcctattttcccagcctccccaaatgatgatttgattattatctgctatgtgtgccctaaatcaatgccacagcttttctttattgcagcaccttgttacttttgtcaaattccacacagttatccattggcacaatgaattttacatttactgatggaaaacatatgacagaggctttcaggtataacgtgattatgtgcaaaattttattattctacagggcagtcaaaggtttattcaaaacatagagccctctatagctttcctattttaattatctgttaaaagtcattgattttgaagtgtaggtaatgaagttaggaatgaaaagcaagtgggttattccatcctaggtagaacgttttaatttttggtactgagcaaaagaggatttttcttgggagatttttctctttctttcttgttttctctgtctctctctccctttctttttttttcctttaacttttacagccttcctctgcaaagtacattctaaattccagctcatttatcttcagacaacttctaaggaaggtaggaagcaattatcattatgctcatttaacagatgaggaaactgggccacaaagaggttaagtgacttattaattataacggctataaccaaggaatgcatagtatcacaataaaggtaataaccaaagatatcgtcacataaaccatcgttactcaaaagagctaagtgtattgatcattttggctcacccacatgacctcaactgcttgattatattaagtttctaaaacatttgccttacagcattggggcagatacagctataacatgttctttatagtctgccacttattctgatcttaccagctcaatagtcttctaaaattaagttatgctggggtgattgtatatgatagtatatggtggggtgatagtatatgttttgaagtctgaattgctagtgtggcatgcctgcaataatttttttgagagcttgagtgattttgctttcagtatactacaagaatgtaagtaacttttccattgagagataaaatgtaaaaagttggtagtttactgcaagtccttattagatctaaaaacatatactattcattagagattgctcctaattttgtaaatataggcaaaacagaattgttgtccgtttttatttagagcaatggtggtaatataagtataatatatttactgtgaagagatttactcattagcagagtaaattctcaaaattgcaacgatagtgtgcttttcacattgaaaaatgtcttctgaaatgaatgtttattttcctcttgctatattggtggtaaaatattttgaaagttccactttgcatatgcagaaaattaacctaaaaataatatttaaagatgagaaatattatctagaacttttttgaattttagatatgtttggttttagagcttattctttaaatgtttttcatattttatatagcaagatttctagttaagtgtagttgtctgtaggaaaaggtttaataattatttgtcagcacatggttagaaatcaggttatgtcttttagtttgcacatgtttactattacgcggattctaataattttccaccactatccagaaggaatgcttttacaatatgacaattagaaattctttatggtacttcagtaagtatagggaggatgtgtaaatagctactcacttgagttggcttgtttatttaggtgctattaactagccacatagctttttctcatgtcatttttatttattttgagttgaatagggagtcttttcccttttgagcacttgtgtttctcagagatgtattttattttgtatgtctaagtgaaaattgagaaaatacatgttctcagggacctgaggaatgaacattcatcttttctttgtaaacctttatcgtaggtttttctatcatggggattgaaagcataaaggtccatatttgagacttgggagaattgtacatgagactttgtgtttacctaatggagactgaattaagaagagatgacttttaagtgatattaaggacatggtattaattggcctactctatagatttatattgaattgggttctgagcaagagctttgagatttgtgttcatgtagttttcttgcctgagcttattttactaccctataatatttagtgaactacttctgctcctttccttgttgtgaaaaaaagcgctattttaactggcaaaagtaaattagtacacaattctaatttacatattgctttgtgttacttgagaacccctcaatattcctttgcagatctaaactaaaacaaaatgttcctcaaacatgacatactgttctgacttggaagatgaaatacctaatatacttaggcttctaagccaaaaactattcttgccaacttgctcacaaattactgattaggaaatagctatggctgtttaggacacatagaaactttatttttaattttttgtttgtctcacatattgaagtttatagataatcttttttttttctttgtgctttaatgagttaaacaaaacataaaagcttgatgtggttgatcaccaatgtatctgggcagtaaggttaggttaatggttaatattgttaatgaaatttttgtttgttcatgttgctgtgttcttcattgtccatcagacatttttttctagaagtctggaagaaatatcgcagtaaagatttttatagtcatataattttcctaacgctcccaaattatttttcctttattaatggtgttgaaatatcgaatgtgggaaattcactaatgttaacattagattacgtggtagtattttgttcaataaaataaggttggtattttaaagtgtcattatatttttattagtgtctaatacagttttaatataaattggtcatgtttgatataaatatttaaaacatgactatttattatgtctttgatttatttgtgtagtaaggaagttatttttactcccagaggttgtctccctccccctttcctcatctaacacacaatttattgtacgtgaggcctgatcctatgtttattacagggatttgcataaggactacaggaaaccaacaccattttactatgttcccattgcaagaaataaaatggtgcctttgagtaaagctgcttcatcagacactagttcagcatgccaagttaaagccatcaatggtgaaacagcagatgtgaaggctagttggcatgaaagcatatgagtcaaagactttcctatgggaaagaaagtgcttcattacactttatctatagtgagaacattgggtttatcaagctgtctgaaaattagaatatgatgagttttattactcttgctctgccagagtgaattcaatggttaaaaagaaagcaataacaccattttaggaattataagaagtgattaggtttttagcgtatttaaacttggaaggagcagcaacttttatcttcgaaagtagcctctctaaaatatctaagggacagaagtttaatccttttctaattgctacatttgcaatatgtattaacgcagctttgggcgctttaactgaataaagaagttgtatgcttgactgaagtgtaaaatctgagaaacaatgttttaattgccttggaaaacatgtgcatgaggccctgccactccagcatacactagtatgctatggttctctccctcccttgtcctccctcctttactctgtgcaaggaccattcctgctgtttgtcaagtcaggttggcagctcaaacactgtgtcccaactcatcagtcttaggagagagggccccacagggagtgagaaaactcaaaagtcagttaatacagtgatgttgagctaacatgtcaagtgctggataatggataatagttgtcactgcaagagttcatagccactggttaggcaacattctgaaggaaattcaagaaggacatattttggatgcaaaaaataggctgagataaatattatccaaaaataccttgacattctaaaaattttagtgctttatatcttacataaaaaaactaaaatgacaaattccatttcttctatataaattgctgaatagaagcatcatttggtatttttaaaacaaacatacaaacaaaaaaacccagactctactttgttaatgttttgaggaaattatacttattgacattgtggctatgaaatatctattgatcgttttgggggtggggggtgttgctgctctgacttttgagtatcagcaaagacatattgttctcatttcttagatagcccattaattacaaggtgaatatcctgaaatttgtacttaatttaaaatatccttggcagtttaatggtcttgattttccacattattatgctgtcttttcagggagaagctattcttttgttgcaaaggcattttagactaattagcatctttggtcagctgaattttcatttgttcatttgttttcctgtctctttccaaaagccacattattctaaaaacagtaatatcactttgttgtttgttattaagagctgattgaagataccacatactagttaagttttttttttctttctttatgaagcaaaaggagatttactattatttgctgctactgccatcttcaatattagactcttatttaaagataatactgtactatttttccccttgggagcaagcaagatgtcaagtgatgcacccttctgatgctcaataatcttaccactttatcatgcatatttgcaaggatgaagcacagtttataaatcatctctgtttattttacattcttccccttaactccagatagatcaggaaaaggacaaaataaattttggtgcttgttcataagtgttgataactgcaaactgaatataataaattcctcaaaaatactgctttaagaaattaaacttggtcaaacattgatggtaaatgtcttattcttaaagagatcttattctgaaacaacttgaatctttgtttttatgctgtgatattagtggctgtggcagtgcctagaattgtttaattgcctaatgcacaaaggtgagcactttgattgatgtgtattcagagaagtactttaataattttataaataaagaactctccagatgactgaatgtgtctgtgtgtgtatgtacatgaagagtgtgttctgtaagaataaggtatgctttcttaatttgagttaaattatggatggttatataattcatttttctatacccagtttccatcttaaatctatttagagaaagaatagttcagggttggcgataaaatgtacttttacatttcctgatagtatttgaattatgcttctgattgtcattagcctattgtatacaccatagcacaagtgagttcagtgaaaagatttgattatctctaaaggtaggtgtttcatttattaagtattgtaattacagctaattagaagctacacattatattagtttgctttgtaggtcccttgactgttttcagaacactatgagcttatggttcatttcaatttattacaaaaacaatttaataaaagccaaagaattgggaaacagcattactaatggatataatttattgttgagtcaatataatagtttaacataattattaaaggcatagaccaagttgtggcgtgaaatcctacattcctcaatcaatacagatttatttaatttctctgggtttctgcttttttgaatttatctcccatagataaatcgagagtatatgtcttatatattgttcgtattaccactgaacatgtactaaattcccaatatatatttgctattatccttattgtgaggagcttaaatgttgaattgttaaatttcggtagcagatgaaaccatttcccccaatatgaataccgtacttttgcaaatacaggttacctatggttaatgctacaatctgacactcagttgcattctcatttcattaataatttggtcctgattttagattattaataaacaaatattctggattactctctaatctcactgaaaagataaagtacatcaggaatctgtttccatgtacacattacagatagtcaatcttttaaaacggattttattattttagtgcagttccatggtcacagcaaaatcaacatcgtgggactttaaatatatcaattcacattcttcaagagtttttgtcagccttctctttcaaaaccagaaaataaaaacccagcctgactccaacaaatagatataactaaactgagggacttaggattccatattgtcagaatgaaaagtggtgacaacccaagatggttatgactgagtgaaatgaattttattaaacacgaccttttttatgatctacctggaaaattttaacaattagggaggtgtttcagaaaggatgcccccaatttggtggtgatagttatgatgagagttgtgttgaaggaagtgttgattgtgacagaagcccccttggaaatttagaaacaaatgtatgtttgtgagaaaaaaaataattaactttcagataaacagcaaaagttcttcacaagaagccaaatatactagtattagcaaaaggataacacttccaaatttagaaatatgtctgcctttgaagctggctgagaactaatttttgtgcaggcaggattcttgagatcactgtttgtggcttttgttttaatgaagcagcttatgagtagcatcaagtcttccaggctttactttcaggactgctgtttccctgggggcctaacaattgcaagtggccctttcattgatttttattaccaatgccagagtgtacataatcattttagtcaaactcttacagctgaaacaagtaaatctattgcattttgaaaataaaaatagtggctaacctgttcccatctttatttattattattattttttctgcattgttagtaaccatgtaatagctgtcacgtctacctttctcactcatctttattctgggtgatgtttctttcctaatctcaggcctaatgtgttgcccctgctgtgtcctggaaatgaggttgcagtgatttacttttactagccattagagaaacactttagtattttgtcttatttcccttctttgaattccacaaacttcgaaagtatcaaaagtagtagtgtactctaaaactcttccaagaaattttactatgtaaggctaaggaataaactagatttttattttcttatggcttctaataaaacatgtgtggttatagagcacatgtaatacatctagtgcactgaggagtaaaatatgaaatttcaattatttaatttttattaaattgaaattttaaaaccaaagcagtgcaagacatttttgcaataaacttaaacatatatttcattttaacctttgcctcatataagatgttgtattatagagcatgtgatttgtgcatgagttgtttccaacacatcagtgatgtactcagtggcaatgatttgattcagtttaaatgatttcttctatgtactactgtaacattgtaatgtgtttatttgaatattttatgtaggtgaaataaattacaattataactatctaaaccatatgattattaaattgaaatgcatactattattttaatcaaaatataattaaattatttttctagtttaaaaatacatatgggcaaatttctaatttaaaatgaagttacactattaagaagaattaaatgaaaatgtagaaactggtactacaactggaagagtaaagaataagagagtctggataaggatatgttaactggtttcacaatgaatgaacattgcaatttgctgcaacaaagcaaaatggaaaagttgtttgtcacatatatatttttaagatattaaactggtcattatcaacatacattctcagaaaatacaaactgaatttgatatgcaattttttttttcttaatagtaaaaaaaagaaacaaggaagttaaccaaagttagagtcaaatgttcaatacatttaaaaatatgttttgacagagtctgaagttacacttttggactgttatacaatggcttggatttttaaacaaagagaccatttttggatggaaagatggtaacatatgttatttcaattatgattagtttgttacaaagttgtaaaaatgagattaaaagaaatattgtaaataagcaaaagatctttaattaatcaactaaaaaattgcccatagtttacaatagctttctaacaataggaaaaatcagttgatcctaatttttaaaaatggcaaaccagtgccttttttaagattagaatgaagtatacaatatgagaaactgtccaattaatactttgggtacattttttcctcaaatgactcccagatttaggagaaaaatttcaatttttgaaataaataaagaactagtggcataggttttttttgtatctcttacagctattaaatattaatttcagctagaaatagaaaatttagtttattacaagatggtcacgatgatggatgctctagctatgttaggttaaaaaaaaacacagatttattataattttaaaacaaaagactgatgtttttccttgatgtgatttggctctgtttccccacacaaatctcatgtcaaattgtaatccccatgtgttgaaagagcggcctgatgggagatgactgaatcatgggggcattttctaatcgtttagcatcatctccattttcaagtagttctttatagcactgtgaaacagactaatatagaaattggtaccaggagagtaggggactgctctaaagatacctgaacatgtggaagcaactttggaactaggtaacgggaagagatttgaacaattctgagggctcagaagaagacaggaatatgtgggaaagttaggaacttcctagagacttgttgaatggttttgaccaaaatgctgatagtgatatggacagtgaagtccaggctgaggtcgtctgagacggagatgatgaacttattgggaactggagtacaggtcactcttgtaatgctttagaaaagagactggtggcattgtgctcttgctctagggatctgtggaactttgagcttgatagagatgatttaggatatttggtggaagaaatttcaaagcagcaaagtattcatgatgtggcctggcttctactaacagcatacagtcatacatgttcacaaagagatggtctgaaattagaacttatgtttgaaagggaagcaaagcataaaagtttggataatttttagcttgaacatgtggtagaaaagaaaaattcattttctgaggaggaatttaagcaactggctgcagaaatttgcataaatgaagaagagtagaatgttaatagccaagataataaggaaaatgtctccaaggcatttcagagatctttgtagcagctcctcccttcgcaggcctagaggcctaggaggggaaaaaaatggattcatgggccaggtccagagctctgcagctctgtgcagcctcaggacatggcaccctgagtagcagccactccagctccagccatggctctaaggatccaaggtacagctcaggccattgtttcagagagtgcaagccccaaaccttggcagcttccatgtggtgttgggcctgtgggtgcacagaaggcaagaatgaggtttggaatcttcacctagattttagaggacgtatggaaacacctggctgtccaggcagaaatttgctgcaggggtgaagccctcatggaaaacctgcagtaggtgtggaggggaaatgtggggttggagcccccacacagagtctccactggggcactgcctaatggaaatgtgagagaagggccactgtcctccagactctagaatagcagatccaccaacagtttgtatcttgcacctggaaaagccacagacactcaacactagcccgtgaaagcagctgcagaggctgtaccctaaagagccacagaagcaaagctgcccaggccttgggagcccacctcttgcatcagcataccctgtatgtgagacatggagtcaaagaaggttattttggaactttaagatttaatgactgccctactggattttggaattccatggggcctgtagccccttagtcttgaccagtttttccctgttgcaatgggagcatttacccaatgcctagatcttcactgtatcttggaagtaactaacttgtttttgattttacaggctcataggcaaaagatacttatcttgtctcagatgaaacttggattggacttttgggttaatgctggacactgttggaaaagcatgattgcgttttgaaatgtgagaaggacatgcaatttgggaggggaaagggtggaatgattggtttggctctgtgtccctacccaaatctcatgtagagttgtaattcccatgttttgaaggaggggcctggcaggaggtgattggctcatgagggcggtttttaatggtttagcaccgtcctcccaatgctgtctcataagtgagttctcatgagatctgataattttaaagtgtgtggcacctaccccttctctctctcctgctaccatgtaaggcatgtcttgcttccccttcaccttccatcatgatcatatgtttcctgagctctccctagccatgtagaactttgactcaattaaacctcttttctttacaaattactcatttttaggtagttctttatagaagtgtgaaaatgaactaataaatccttttagctttactatatgacactgaaattatttgtgttcagttttctgaagcagactctgtgacaagtgtcatagacacagttgttaatattatttagtgtatatgtgtaagtgctatgactcattgccagtttgtagaactattgaaagaaatagaagataacaaatgttaatggttttgtaattttttgccaaattgctctttggttgagtcaaagaatacaaagatttactgtattgtctattcctactcaaagatgcatgaaattaaattatttctagatattcaataatcaaagataaaaataatagtttgttttatgttttttgtgctaatatcacactgaacaaaagcaaactaaattgaatttcaaaagaaaaaaatattttttatctagaaagctgtaataattcattataataggaaattatcataataaaggtcaataaaagtgatttttcacatttttttaaagagtcaatatacagattttagttgctgtcagcagtattatagcaaacttgtagtctcaaaaactacatgtaaaatttaaaaactttgttttgagattgataaatttagagattttcagtttatacaattttcctttgacttcagtgttaataattcttagttgatgtaagcattagtaaattacttcacttggaaagataaacagacataacttttgaacaagaatatgtgctttgaagccaaattaattcttaaaaagttaagaaagatgaacaagttttaccaacatgttgtgtatattacaggaaaattgcttttagtacttagttcaattattggaaatttgtttgaaacaacttgggtatatggaactagtattttaactgatttttttttagctttttaggtttatgcaatcaatacaacttaagcgtcttaaatgaaaatttagtgtctgaattgagatatgttttcagtgtaaaatttacgttggatttcaaaactaaaataatgtgaaacatctctctaataatttttatattgagaatgtctcatagtcacttaaaatccagtaaattcaaaatggagtctttatttgttcccagtttcatcattccatgattattctccattctaacagagggcaatgccatcaatgctgttgctcacctctcatatctaacccatgagcatgtacttttggttgtaccttcaaaatacattgcatctaaaagctattcacagctctccatatctatcgccaacaccttaatctaagtaatcagtaagccatttagtaagctcaacaccttaatttaatcagtaagccatttagtaagcttataagtttactactattttgtctgcatcatcagttgttccatttcaatcactttcctaagagtatttaaagggatcacaaacaaacaaataaatcaacataactcctctgtaaagtgagttttctctttactttttacttataacacatgttccttccatgataacattctaaattcattgttttcatttatgttattcttcttgtgactagaatgtgaatttcatgaggtcaaagacttagtaactagagcattctggtagataatagattctctatctactgtttttttttttttttcatttttatgagatagcaaattaatccttgtaagtaaattaatcaatataagattattaatcataatctttaatcatgtttatgatatagtaaattaatcaatataagtaaaataagccaggataaaccattttacataccctaattgttacaaaatataacatatacacagaataattttccaaaacataatttgtataacattaggtgttttgagattagtaaagttagtatgttaagaaaaatttagaaagtgaagaaaatggaaataagacaataattattaatgagaacacaaacatgcacacatatcttctgatatatataatatgtatgtgtgtgcatacacacacatacctatatctgtaatgaaattggggcaatgctataaacataacttcagaagattttctaagcctgggcaacaacccccatctttacaaaaaataaaaacattagccagggtgtggtggcacatgactgtagttccaactacacaggaggctgaggtgggaggatcatttaagcctgggaggttaaggttgcagtgagtcgtattcacctcattgcacttagtcttggattgctgttgaaaaaaaaaataagaaaagaaacattttgatttttaattagctattatgaataatgcttatttgtaaatacgtaacaaactatctaatcattgaattaaaggaatatgacagtgtcttcatcgaagccatgactgcaccagaacaagttaacacaggcaaggcgattattgtagtaaagaggagatgccaggattcagtctgaactcaattctactgctcaaaggactggagggtgtttaaaagttggagagggggatggaggcagagtggtattgtaaaccatttatttttgctagttggtcctacccaatggaaaacaaactttttgatatcttcatgacaggagatagttctacaacttggagcaaggtacccactgaagttaaatttctaccctcccacagagaatgttacacagggacactagcttcctagatgattacagttcaaaaagggctcctaggaccttgagcaaaacgttgctaccttgtaatattagcaagaaacttttaaaaagatttacattccaaaagagtcaaagaaataatttacgattataatttttcaaaggtgtgctctgagaaaagagaggtcaggggcttagagtccagaagaagcatgcctaaagtttaatcaagctgaaatgaatgaaattgtcttgatcacttgatacaacaccctttagagacattgaagtaatttttaatactaacaatatgtaactgggtgattcttcttcctattctcatttttagtgtgaattatagagtattgagaatttttaatgagggaaatattatcattattttattttgaattgttttgatcataacaggaattaaacattttaaaatgtttataacaaagaaactttaatcttacagacttaaatgttggaatatcattattttaatttggtttaaaaaattgtatgcagtctgcattccactaagtttcttaacctataaaacaagtattttttaaggagcattataagtacagagattcatgctaatggcattcagctcattaataattatgttgtagtaaagctgagaaaatgtgatataagagaaacacttgcttatttaaatatgtcagttttatttccttctgtttgctttgttaaaacatgcatataattttggataaaaatgtgttggatactgaaagcctgcctcttattataacaaaggcattaattagacatgagaggtccgcaccatgatcccaaatgttatatttcaatacacatgttcagaaagtaatctttcagacattagtaggtgtgttaaatgactataatcctgagcacctacatcgacactttatcctttgatatttgtcagacatgcttaaccccaactaggagaatgttgtttttattaataattatttcaggtaatacctgattaggtctaatgagtgcttggcagtcttcatattggaatgaagtctgtgtgaacgtttaccaaaatgtagaaaccttggaatatttgacaaatgtttatttttaaaaaatggcctctaatctcagtttgaatttacacttattttatttttcagtttatttgtttggaaaatattcctattacctttaaattgactttttagagaagttttacaaatacattatttttaaatacaagaacaaacaggaaaacggagttaagttttatatggcagtggtgatagaatggttgggtaggagcatgaatactgagtaattatatttattatgtccttattcctgtgtcttcaaaacagaaaatgatttgaagaatcttagaactgtctttttttttttaaagtctcttccgtttacccagtaagtgacataagccacaagttactattttttacatctaaatcagagccagtgttaaccatcagtgccattttaacgtgtgatcagttccttaactaatatatatatatatacacacatatatagttatagttatatatagttatacataatatagttatatataaatatatttatagttatatataatatagttttatatagttatatatatacacatacacacatatatatgatacaatatatatgcaagcagatttttcagacccagaataaaatgttaaaaggtttttttattgttttaattaaatagagacagggtcccactacgttgcccagactagtcctgaactcttaggctaaagtgatcctgctgcctcagcctcccaaagcgttgggattacagggatgagccactgtgcctggcctaaaaagggttttaaagcaaaacaagaaaacaatcaaatttcatttatttattaaagaaagtaaataaacagatatcaaattgccaatatgaggcaaactcagggcaaatttaatttgcacctgggcacatttacagaattttgacatggcagttacttgactattcatcaaatgtgtaatttcctccagtcgtagcacacccactgtttaaatttgtgttctgaaaatataaacccaccacttaaaataattgcttattttattaattcaaatatacacacccattgattcataaattatcaacagtttaactttatgataaaaataatgtatatgttctatcttgtctcatcatttcttctggctatccatgatggaaagggagaataagagagcttttgttgttgttgttgtgtttttgcgattttttttttttgtgggtaccaacacttttcttttgcctccataggatttttaaatgcagccttataaccatgttaaatgcctagatttgattataatagaaatttatcaaattcttttaatttacacactcaggtttcttgtcaggtctaggaactcctctttgattatcttttttttgttatccttttaagttctggaatacatgtgcagaatgtgcatgtttgttacatagatatacacagtggtgtgctgcacccatccaaccgtcatctacattaagtatttctcctaatgctatccttcccctagtcccccatccccaaccggccccagtgtgtgatgttccctgccctgtgtccatgcgttctcattgttcaactcccacttataagtgagaatgtgtggtgtttggttttctgttcctgtgtttgctgagaatgatgctttctatcttcatccatgtccctgcaaaggacataaactcatccttttttatggctgcatagtatttcatggtgtatatgtgccacattttctttatccagtctatcattgatgggcatttgggttggttccaagtctttgctattgtgaatagtgctgcaataaacatgagtgtacatgtgtctttataagtgtagaattatttataatcctttgggtatatacctagtaatgggattgctgggccaaatggtatttctggttctagatgcttgaggaatcaccacactgtcttcatctttttgaaaatattatatgtctcaatcatgctgatttcatgttcaggaacagaacagaaatgagaaaatgagaaatgagtgagatctgacattggttttatgacctctatttattaaataactttctcattttttatttctcattttaatctcctgattttaagaaaatcagcctgttttgtaagttttttctacctgtttcaaaaagtcttataggcttgtatcacattgggactacaaaatgtgtttccattttgttgttgttgctggtaataaatcattttctaaaatctcttctccctctaagttatcaagataatactccttttcttgttttttggaccaatttttatagctttatgtttatctcaatctttggtgagaggaatttgattgggatttgtggttgaccagaggtcacttgaataaacctctctctctactaaaacttgaaagcaggcctacatgcaaactttgtagtccagttatcaatctcaggatccaaaattgttgttttgtgttttaacatggctctttgggcctgagatagaatggactcttaccctcaggaccttaaatctgatactctgaatgatgaagcagccccctttttagggcttctcttatcttccccacattttcatgacaaatgaagactattcccacctgcctctggaataggacagtcttccctgcccactacttgcttagttatttcctatcagttgtagcctctatttttttgtttttcatttttttctttatgtttttttattttgtctttattttttgtagcctctaaattagcacagaatacaagtactaacagtagtgggagccaggaaacacattccactggattcaaaattaatatctacaaaggtgaaggataactgctaagtgtactggatcagggagaacttataggtggcatagtgtagacaaagaaacaatggtatgcctaacacctttcaacatggtagtagcatttgacttcaagcaagggcgggccatagattttatttttaataaagtttaagcgtcattgtagttaaggacatttatttcagacttcagcaagaagttgtgtgtcagttccaatgttctgttgtgaatcgtcatttgttgtgtcttaccatattaatatattttactgtgatgttagtagagaaatcattgagtgcagtcatccaaacaccttttaaaactggaaatacataatctttaatgctttaaaatgtatttgcatatatgtgaaagtatcatctaaactgcaatcattataacccatgaagtgtgaagaaatcctgtattttctattttctttaacatgatggataaaaggtatttaagagagttgagaaactaacctttagtcctgtgtcaaatctgatagaattcatctttcaactatctgttaccactttctagacactgccaatagtaaaatcaattgttgaagtaaatggaatggcttttggtataatgcacaaatgggtttaaattgaggattcagtatatgcgtgttttgtttaaatatttttgctttaggtgtaggttcatatgcagctgtaagaaataatacagagacattccatgtagactgatatggtttagctgtgttcccatccaaatctcatcttgaattgtagctctcataatccccacgtgtcatgggagggaaccagtggcccagtggcaagtaattgaatcatgtgggcagatttttcccatgctgttctggtgatagtgaataagtctcatgagatctgatgattttataaagagtagttcccctgcacatactttcttgcctgctgccatgttagacatgttttgctcttcttttgtcttccaccatgattgtgaagcctccccagccaagtggaactatgagtccattaaacctctttttctttacacccagtctggggtatttcttcatagcagcatgagaagtaactaatacatagcctttaagagtcccacaatgtaatatcatgaaaagcaataggacattatcacaacgatgttggcattgttagagaaaagacaggtaacatttccgtcatcacaaacacatcatgttttccttcaacagtcataaccttttttctcccacatccccttcgttagctcttgacagtgcctaatctgttctccatttcagcaattttgtcacttcaagaatgttacataaatggaatcatcctctatgacggaaccatccagtatgtaaccttttggtattagctttttccacttagcttaattctctggaggttcatccaggttgttatgagaatcaatagtctgttcctttttactgctgagtaaccttcaatggtatggttttaccacagtttatttaagcatttactggttgaagtacaactgggttgttttggggttttggctattttgagcaaagctgctatgaatatccatgtacaggttttgtgtgaacattagcttttctttccatgtgaccaaagcccaagtgtgcaattgcagagttgaattatagttccaagttttgttcagttttttttttaaataaaagctctattaagatgtaatttatataccatgtaattcacctgtttaaagtaaaaagttcaagaatttttagtatattcagaactgcataatcaccacaatattttttttttttttgaggcggagtctcgctccatctctcaggctggagtgcagtggcacgatcttggctcactgcaagctccgcctcctgggttcacgccattctcctgcctcagcatcctgagtagctgggaccacaggtgcccgccaccacacccagctaattttttgtatttttagtagagacggggtttcaccgtgttagccaggatggtctggatctcctgacttcttgatctgcccatctcggcctcccaaagtgtcaccacaataatttttaaaactttttcaacattttgaaaataaaccatgtactcattaacaatcattccccatttacttaaaatgtccactctccaccatacctaataaaccactaatctgcttctgactataaaacttcttagtctgaatatttaatgtaaacagtgatatagaataaatgctctttggctttaactgaactttcatctgtgtttcagtgtgtatcaaaattttattcttctttttgcagaataatattgtactacattgatataacaaattttatttatctgtttatcagaggatggacatttgaattgcttccactttttggatattataaataatactgctataaatattaatgtatgagttttggggtagatgtatattttaatttttcttgggtctataagcagaattcatgggtcaagtggtaaatatatgtttaaccatttgaggaaaatcaaactactttctaaatggctgcacaattttacattgcctttagcagtgtacaagggctccagtttcttcacatcctcaccaacacttactattttctgtttttatgattatagccatcctagtgtgagaaagtgctatctcctcatggctttgatttgtacttccctgatagctaatgtggttgagcatcttttatgtgcttattcaccatttgtatatctttggagaaatgtttattcagatcctttgctcatttttaaattaggttgtctttttatcattgaattgtaagagtatttttacattttatagatagaaatccctcatcagaaatatgatttgcaaaagttatttttccattcttgggttatcattttactttgttcatcgtgtcctttgatatacaaaagcttttactattaatgacatttattataattatttattgtttggatccttgcttttgatgttatatcaaaggagacttttcccaacccaaggtcctaaagagttactactatatttttttctaagagttttatagttttaacttttatatttagttctacaattcactttgatttaatttttgtgtatgatgtgaaggacaaacacaattccatccctttgtatgtagatatcaaagtgtcccaacacagtgtgttgaagactattctttccctctttgaattgttttggtactctagtaaaacaagaaatgaccataatgtaagggtttatttctgaacctttaattcttttcaattaatctgtatgtctatccatatctacataccacatggtcttgcttactgtagtttggaaattaggaagatcatcagtttccttttttatttcaagattgttttgactatgtcaggttccctgcatctataagaattttgggataactgacaaatttctgcaaaaagccacatgaggtattaattttatgtttatttgggaagtattgttatcttaacaatattaagtcttttgatccatgcacttgagatgtttttcaaattatttaggtcttctttaatttctttcaatgtgttttcacttttattattagatcttgcacttctttaaagaatagatccctctgtattgtattctcttcaatactattataaatataacaatttttataatttcattttctgatagttcaattttatatatagaaatataagtgatttttgtatagtgattttacatactgcagtgggttagaactcttctattaattctcaaagtgttagtagatatatctggatttcctatatacaagatcctgtcaactacaaagagagatagtttaaggttttctttccaatctggatgcctttgtgttttttttcttgcctttatggcctggcaatatgagaattacagtataatgttgaatgtaaatgagaaaggtgtacactgttatcttgctcctaatatcgggggaaaacatttttccttacaccattattacattaggtgtggatttttcacagatgccttaaacaatgttgaaggcattcccttccttcattgattgagtgcttttcaatcactccagaggtactgaatttgtcaatgcttttcctgagtttactgagatggtcctctgatttttcctttattttactgataaaatatattatatttatttgtttgtgcactttaaaacaacctcacattatttaattaaatcccacttggtcttggtgtataattatttttctgtgatgctggagtcagtgtgctggtattttgttgatacattttgcatctatattcataagatatattgatatgtagtttgtttttcttgtgatttttttggggggttttgatatcaggttgacactggcctcatggagtgagttggaaagtgtccctgcctcttttgctttttggaataatttatgaagaaatggtattaattttgctttaaatgtttgacggatttcaccagtaaagccgtttggtcctaagcttttatctccaggaagtgttaacaattatatatccagcctgggcacagtggctcatgtctgtaatcctaacactttgggaggccaaagcaggaagtttgcttgaatccaggagttcaaagctaccataggcaacaaagtgaggtgagttcccatatctaaaagagaaacaaaaaaaagcagacaggcatggtggaatgctcccacacacccagagtcccagcctgagcaacagagcaaggccttctctctctctctctctctctctctctctctctctctctcccccccatttcttttacagtcagatttggtagtttgtgttttttaaggaatttatccatttcatctatattgtctaatttgtggccacacagctatacatattattcccttttaatcctttttttttctgttagattgtaggcaatcatctcactttcatttctgatattgataattttgttattcttgctaaaagtttgtaagtattgttgatcttttcaaagacttggctttgtgtttctttgattctctctctttttcaagttgttgcttcattagttttcattctagtttttattattttcttccttctgctttattcgagtgtactttgctcttctttttccactgctttatgttgaaggttaggtcattgatatgaggtcatttttctttttaaatataatcatttacatttataaatttctctctaagcactgctttaacttcatcctacaagttttattatgtcacgtatttttattcagctaataatatgtccttatgtcagtgtgatgtgttcttttatctttaaattactaacgcattttaaatttccataaatctatttctttctgttattaattctttgtttttaccctttggcctaagcaaaaaacttatgactaagtcctcatttctatcagaattttgggataactgaccaatttctgcaaaaagccacatgagatattaattttatatctatttggagaatattgttaccttaacaatattatgtcttttgatccacgaacttgagatttttaaatttatttttaaagatttcaggggtacaagtgcagttttgtttcatggatatattgcgtagtggtgaagtcttggttttaatgtgctcatcgccccaatagtgaacattgtacacaataggtaattttcaatcctcactcccttcccaacctcctaccttttcatagctccggtgtctattattaccctgtctatgtccatgtgtacccattgttaattcctacttttaaatgagaatatgaggtatttgactttctgtttctgaattatttcacttaagatactgatctcctgctttatctatgttgttgcaaaagacatgatttcattcttttttatggctaagtagtattacatggggtgtatgtgtgtgtatatatgtgtgtatatatatataaaattttcttatatatatcaataaaaattatacatatctataagaattttatatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacagaagttatgctaatttgcattcccaccaacagtgtataagcattcacttttttctaaatgtgctacaacatgtgttaatatttgaggttttaataatagccattctgtctggtgtacgatggtatttcactgtggttttaatttgcatttctctgataatttgtgccgttgaacatttttgtcatgtttttttggctgcttgtatgtcttattctgaaaaatctcttcaaatctttcacccactttttaatgggcttgtttttgtcttatagagttgtttgagttctttgtaaattctggatattagccctatgtcacacacatagttttcaaacattttcttccattctgtaggttattagtcttttgattgtgattttcttatttatttatttttattatttatttatttatttattttttactgtgcagacactttctagtttaagtcccttttgtctgtttttgttttagttgtgtttgcttttgaggacttagttataattttttgttgtttgttttggccaatgtccagaagacattttcaaaggttcccttcaggaatttttatagtttcagatcttacattcaggaatttaattcatcttgagttaatttgtatatggtgagagatatggatctagtttcattcctctatgtatggcaatccagttttcccagcaccatttattgaataggatgtcttttctccagtgtatacttttgtcaattttgttgaagatcagttggttgtaggtatgtggctttattgatgtattctatattacattccagtgatctatgtgtctctatttataccagcaccatgctgttttagttactgtaaccttgtagtatattttagacaggtaatgtgatacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctgtagctagaaattccaggactatgttgaatatgagaggtaaaaatgtgcatccttgtcttgttccagtttttaaagagaatgttttcaactttttcctgtttagtatgatgttgcctatgggtttgttatatatggcctttattattttaggtaagtttatatgatacctggtgtgctgagtgtttttatcattaatgggtgctgaattttataaaattattttttctgaatctattgagatgagcatatggtttttgttttaaattctgtttatgtggtgaatcacatttattaatttgcatgtgttgaaccattcttgaatccctgaaataaaacccacttgattatggtgtattacatttctgatgtactgttgcatttggcttgctagtattttttagaggattattgtgtttacattcatcagggatattggcctatagttttctatttttgtggtattcttgcctggctttggtatcagggtgatactggcttcatagaatgagttagggaggattctcttctcatcaattttatgcaacagttatagtaaaattgataccataaaattgattgataccatcaataaaattgatcaattttatagtaaaatttatactggtatcaatggcttcatgtggcaatcatatggcttcacatgtctggtaacatttggctgtacatccctctggtcctgggctcatatctgttggacaattttttcattactgattcaatgtcattactcattattgtctgttaaagatttctatttcttcttgttacagtcttaggagaaattttctctagtttttctagtttgtatgcctagtgatactcatagcagtctttgatgatcttttgtatttctgtggtatcacttgtagtcacacctttatcttttctgattgtgcttaagacttctctccatttttcatggttgatctagctaacaatctatcaatattgtttatgatttcaaaaagccaatttttattttgttgatcctttgtatttttttgttgttctcaatttcatttagttcttttctgatctttgttatttcttttcttctctgagctttgggtttggtctgctcttgaatttctattcccttgagggacttgttagggttgttaatttggaatatttctatctttctaatgtaggtttttaacaccgatgaaaattttgttgagagtccctttagaagtgattagacacttctctcttgctgcttttaggatttttttccttcatattggctttggataacctaataactatatgtgataatgagtttcatcttgtaaagtatgttccaagtattcactgagcttgttgtatttggatacctaattccctggccagaccagggacattttcctggattgttcccacaaataagtttccccagctttttcttcttctccctcaggaatgcctataattcataggtttggttactttacgtaatcttttatttctcaaagcctttttttagtgttttgtttttttttttttgtctgacttggttaattcagaaggcttgtctttaagctctgattatttttcttctacttgctctaatggtaaggcttccaaatgtatcttgtaattatttcaataattttttttattttcagaagttctgtttttttaaaaattatctgtaataatttttaattaacatcctgatttttcttctgatttctttggtttttagctttctcttggatctcattaagcttcctcacaatctatattttgaattctttatctgtcatttcagaattttcatttagttttggatccattgctagacagttagtgtgttcctttggaggggttaaagcactctgtttttccatggtgccatagtttttatgttagttccttctcatcctggagaaattgtcatttattttttaatttactttcttttagatggtacttttttaaattttttctcttgagggcgtaactgtaatgtatgttgtgtagggctgtttggcttcaattctgggtgctttcaggggccaagcctctgtatgagttccttggttgtagataaccttggttataaatacagttcctttatgtggtggctttttcaaatgctgattatagtagcaatgtactcggcctatgagcaggactaacaccttctgtgggactgaggttatggaagtctcaggaaacttaccttattccgcagcacaatgctcttctgacagaagatttttaatttgattgtgcagtccaatctccagttcattaggtggtagttacgggtaacagctgtctgtggtatatacttgatctttgtttactgagaagggctctgttgtcacatgtagtgggctggtctgtcaaatgactggtgtcctgacttccctgctgaagggtacaggtgggacaaagctgggcagagctggaccaccaaactcaccctcagataccccaatgataagttaatgtatccaccttgactggagtgacagggagaggttatagtgaaagcctcccatgtttctcccagttccacatcatgggcaggcaggaaagtggtcaacctccacatcacacccttcttccagggctcaggactttcatttcagatagacattgtagttcatcttcaggactcaatgtaactgagggttccagcaaatccctaccccatagctaccaacaaaatgacctcgggagaaacctctttcctcaaccccaaacagacagctttgtggctcactcacctgtactctgcagcgggaatgctgctgttctgtgtagagtgagggatggactccaccattcttgcaagctgggctaatggacataccaggagtgggagtgcaactcctcctaatagtcctataatggttctccctaggcatacccatgccaacgccccccacgaaagaacagctagctgcagctgcatccgcagctgtgggtcggcaggcagaagtccccctatccatctttgttcccaggcaccagtgccacctgctgctgggatggaaccacactctccctgacatagcctagcaccatgcccacatttctcatgcaatgggcgcagtaatcttcagctcacaagtggggagctcttgtgcagaggagagtgcacactccggtttttgttgttccaagggcacttcggcatgtgacactctcccttcccctagggagagctcaccctgaacgttagaattccgggaatcccacagctcccctttatcctgctggtcctttctggttgctgctgtccaagtagattctaaggaatgtctataagggatctactggtgttgaggcaagagctgagactctttgggtaggatagagatccacaatatgtgcccaactggtatggcacctactacctcagcttgggtcttgagagtggagggatggtaaaactgcatgagctagcagcctagtgctttgccctcaagaaatttgtaaacacaacccacagcagtacttgggttcatgagggcagaggggctctctgacattccagaaatcagcagtatgacacaggggtgaggggagcataaagtacccccatctaccttatccatgggactccaagatcttcaggggtcaatctctgccagactcttgcttccttctttttgtgtgccccagctttttcccatgggttctttaatagactgtggcactcttccctcggtattccactcaggatgtgattactaactggcaactctggttcttctttatgaaaactggcattcaatgcctctagtcagccatcttgaaaaaaaaaacctcaactctgttattaatttgtaatgttattccattgtagcaaggcacatgctctgtgtgctttgaattatttcaaatgtattgaggcttgtttcatggcctggaatgtagactaccttggagtaccatgtgtacttgagaagggtgtatattttgctttattttgggtggagtgttccataaagacttcttagttctatctatcctattgttgttcaagtcttctatttcctaatagaacttctgcttatttgtcttatccattattgaaagtgagctactgaagtcctcaactctttttgctaattctccatttcacattttaattctgtaattttttgcttcatattttggggttatgttgtttggtgcatatatatttataattgttccttttttgataaattaacattattaaactagaataacaaaattgatctcaatataactataaaatatattttttatatctagtgattgtttttgtttttcaaacctactattccttatttctgtatagcctctctgtcttgtgatggccatttgcctgacatatcttttgctatctttatttttaaccttcctgtatctttgaatataaactgggttttctagataaaacaggcagttgaattttttttttatttttaatccagtgtgataaactgccttttgatttgattgtacaacagattagaatttaatgttattattgatatagttaaatttacatctgccaattaatttttatctttctaatgtctcttttgtcctctctcctttaccagttttgcattaagataatattttcttgtgtaacattttaatttaatgatttttctttgtattttttgttattttctttgtggttgatttaggacttatatatcttaatttataagaatctatttcatatttatacttatttaggatttttttttttttttttttttttttttttttttttttgagatggagtctagctctgtcgcccaggctggagtgcagtggcaccatctcagcttactgcaagctctgcttcctgggttcatgccattctcctgcctcagtctcccgagtagctgggactacaggcgcctgccacagcacctggctgatttttcttttcctttcttttttttctctttttctttctttctttcttttttttttttttttgtatttttagtagagatggggtttcactgtgttagctaggatgatcttgatctcctgacctcgtgatccacccgcctcgccctcccaaagtgctgggattacaggcgtgagccaccgcgcccggccacttatttagtttaatatagaaacaatcctagaaagctctatttcctcttatccattttatgctctaatttttgtacatattatatgtatatatgctccaaacccaaccatacatcattatatatgctgcaaacccaacaatacatcatggagctagcagtctccacttaattgcttaccaataaaatttccattatttcagagagtacccttcaacttgaacttgcctacattcttttctaaataaagttaactcttttgggcagaacttcagaattctcagttcttattacctggctctcttcttgggcaaaatatgcaccactgctctggagctaatgggaaggagggtatgggttaaggttcaaattacatagatgcttgctattgttactgagatttgtgtttcttgaaaaaaaatacatataatttgctgtatatcttagaacaatttctggagactttaaatgtagatatataatatatacataattatatttcattaatgtataatatatacatactatatcattacacatataacatcatatataagattatagatacatgatatataataaaacaatgctaacacatatatgtataattaggtacatgattttgtgtatgatataacatatatgtatattattatattattgttatcaattgtgaatgtttcactggagaggaggtttgtgaaggtcctctgatcccagttagaagtggattttccttgtgttttaagagcctctagctattggggtttcagtaccagacctgttagcaaccctgtcctattgggaaatgaaggagaactagacatgggtgtttacagtgtgacttttgtgggatactacttctacctgctaggcagcctaatgtctagttctcaaacccgtgaccagggggtctcgcacacaggaaaggtgtttatattggaagatgcccttgtggctcttgtttgatccctgttcagtttatgcctgcctaaccattgctgcagcactgggatcctgactttttgttcttcctggcatcccagggaaattctggcctggggaagctgtagttctttgcatggaaggtgcaaatttgatacaccaccacagtaagaaacaagctcaaagactttttacttatggatcctaggcagggagaacacaatgagtcaggaggacagttctctgtctccaggtcatgcaaggcagaaatgtagagtcaggcatagagagagagagaacatgtggcaattagcaggatacataagggcatagggtgtagattatgttaagtttgcgggaaaatacctgaatagtttttttaaaggaagtagccggaaaatggataacctggtctgctaggcaggagagatgcatctaagctcttatctggagcctctggattgaggcatttgggtgtggtgtagaactggaaactgagtcaagggtgaccaaaccctgcttttgctataagaaacttaaacctgtattcaaaatgaacaccaaggcaacataaaattataagaatttactatacttcattattcattttttgatctcaggacatgtgcttaactgctttgcatcttaggtgtcctcctgtaaaactggataaagtaccaggtgtatagtgctgttttgcatatttgcttagaaaaaatttgtaaaccttattttttcaatgtctgctcataaaagctatccaatacaatttagttccctgtttttctttcagatatccaaatctgtcactctcatcatgccatttctataacaagtcagagagtctatcttcagctttatctgtcattgttctccctcattttgcagtttgttccttgggttgaataatacctctgtaaaatgtttcacattagtcttaataaaaaaagtaatgtttatttttgtaataatttatgtaagatatagctcagtgaaaacatattctccttgcatgttatcacacacaattgtttttgaatgacacaataatgtattgacattttatacttctgatttcacagtatatttgccattacttgttagtaacaaagcatcagtcataaatttgaagtctgtggaattggttaattttacctcatttgagtaaatctcaaatgaggtaaagtataggaggtaggaggaaggaaggaaggagaaagggagtataataactaattggagaaaaatatatttgataaaataatccttgtctgtataaaacaattttcaataataactgatatgtttccctaaaggtagtttataatctattattctttttataataattatgatgttatgtggtttggatttctttgtaatccacattagatagcatagaaactagtatataaccaataaatatttcgtgactgcatgtactttgtgtataactttatgtgccaaattcttgatacaaataatctgtaaattttctcctcatcagaaaattgtattctttgtctaccgtcattttgccattatcagaatgtatattttacatggcattcccaaattaaagttaattattctcccctatgaaacaatgtactttgtattttaacaaattgtttagctaaggaagaaaacaatttatttaggtaatgcaaatatgtcaacagataattgcattatagcagaagtttaatataaaagacacaaaagttttaggtgtgtcctgagaagtgattgatttctgtagggcagaagtaaaggagaaatttaaaaaatatattatgaatgttgcgatgcccaagtagatcttgagagtaacagaagtaatagagtttgacaaggctggagttcctgtaagaaaataagcatattactaaatccactttattctaattaattatttgttcagatcttaacttttataacaggatatgttgaggacctgaatgttctagtcatctgtttcccctgagcacataatgcaatcaatggcctgtgataggtgctcaagaaattgtcaatgcataagtgattcaatggataaaggaagagggacgaatatttgacaggcccatcccctcctcacttgctctgagctgtgtcctgagattatgattgataggatatcttatgaataaatccatcaaaactgagcaaactgggaaaatattaacaatttaatggttgatttttagctaagtcttataatccaaggcaaatacaatttcctcttttatactctccagtacttgttatgtactcatgttttgtagacaataaaaataaacttaattttatgcttggtaatcaataatttatagtgttttattgtgatattatgtattcatgataagtaactcaatgtaatattaagctaagttttaagttacctaaagatcttgaaaattttgttcaagctgacaaactataaaacaaaattatagttgaaataaaaagattgagagaattatgattcaacttctttaaaatatatttttataatattaaacatttttataggaatacatttttattttattagtaacctagtatacaaactttcaggaattcagattaaatagacttttcatgaggaaccaaacctaaatcttataaaaattaaattgcctacttgtatattacttaacattgatactttatataaagtcatataactgtttttcttctttaaatcattattaaaccagttgcgatttgatattttatagaaaatgcctttggggaattttttagaggttatcacaattcatgtattagaaattattttaaaatattctatgtatttgggaatattcaatttacataagcactttttaaaaataaattataacagtgattctttagcttaagagatgccacaatttaatgtacttttatcctctggatatagaagtgaagacctttctcaatttcaaacacagttgcatagtcacaaagacgacttgtacctgcagtctcatcacttcagtcacgggtcaaaagtgaacacgaaaacccaaccaaaaactttctagtccggatatcaggtgttttccttcccagtgggcaggaaacactttcccagttgatttgagatctacgcaaacaggtaaacaaacaacaagccaacaaaccagaatctcattcatgtttaacccaataacgaatagagtttcattattcatctcatagaaattaccaagtggtcagaacagaaaaccaaaatcttagtcattgctctcactaatgggggataatttatgcaccaacaagatctagaaataaaaatcaaaacaacaacaaaccaacaacccctcccaccccccaccatataaacagtaggagaaataggaggaaaaaagaactggagagtcaggaaaattaaagttctattgacgcttgagattctctctgagaactagaaaagatgtgacttcactcaaagatccttgaatgtgcccttctccagtaatacaatttatttggctctgtcaagtgaaacaataaaatataattttcaaaagttaaaaaaaaaccatgcatcttatgcaaatataaactgaacacatgatgaagattttattcaattattaattatggttcaaaggagaattttaaggacataaacacataggtacacacaatcaggaatgctgaaatgcatttgctaatagatgcaaagctttttaaaaccctttatatgtgataaaataagatgtttaggagttatatttcctacagagttaaagcaatttttttctttactgaataaaacaaatttgcattgctattaacaagaataatttgcattagtgtcagttttttacatgacaacttctactcctacaaaattgctactagtctggtcaatagaaggtcagtcaaaggagcatatcattatggaatcagacaatccccggagagtatgcaggtaatatccagcactctacaatatgaaacaatcattttaatatttctagatcctcagtctcaagatttgtttcttcacattgatttggctgagaacataaagatacatactttatgttcgccttatcttctcactttcctttcacacttgcacttcttgaacttggtaaacataaatcacactttcatccacccatcaaaaatgtgtgttctctgaggggaaaaaatcactgtggcatacacaaaaatattaattagaagtattgatgtttaagaagacttctaaaatgaggatactgtaaacctaccccttatcttcataatagatgcatttccaatataaatttattcattgttcataacacaatgaatacatttgtccaattgtgggctaaaaatagttttaattgtaactcaatagagaagaatattttaaacattaaagactcatgacaataaattttaagtaatatttaatcttaacactatataaacattttgaattataataaagtgactgaataaaatatttgcaagcataaaatatatttccttagaataacatgttatagaagtagggaacaacaatataaaagaaaatgaaccacatataatttataactgttgaaaagaggagttgggttgtgtattttttaaatgcatgattgtgggtggcaaacagctattgtattaatattctacacaggatgcatttgaagaagaatgtaacacttttccttaaaatatgaatagtgaaagtatgctagaagttatgtttatgcattttttagttcaatgataaaatatttgaatttgtatagcttcaaaatatttgttctatagcctgtttaatttatgttatttctcagtggcttacttttaatttcaggttcatttttccccaaattttcacttgttattttttaagagaaaggcctatgaaaatatgaacaatgacctcaaataattgatttcaactcataaaaataacaaagaataaaggagtaatactgagacaattgccgctgtttgacaactatgatagagcatatgaaaggataatttccgaactgatagtttttgttcactaatggaattatttttgtcttcataggatatacttttagtcttaatgcataatatttaatccatcacattaatctttgtagatgaaatgtcaatgactacatatataggattgtgtgtcttagataagtccacataaaacataaattggagtaatcataaggagcagcatacgagtttggtcagcaactgcttggtttgcaaattgtatgtgaaagacttggagttataataatggctctaggcttaaaaccaccatattaaccctcttgtttttactatcttcaatttattatatggcttggagagtgtgttctgcatgtgtagctctgtctctttttcctataatgttctcaaccatctcacctaattcaattttgtcagcactttgtaaaggcctgttagaccaatcccactgaaatcacatgcctatttttatatctacagcattttatgccctttttttggtgtttgaaaccttatacacagagattttcctcaataaaaatttgttgaattcattaataaattaaaaaataaaccaatcaatcaaatctaatgccaaagggccagagtaatgatttttttttttctctaggatttttggggcaaaaatgtggccatctcaagcagcttcaacattttaatttagggcaagcaagccccaaaatttgggcttggcccaggatggttcttgccatcacccaggaaagaatttaggcagccagtgttattagacaacaaattttattgaagtagcagtatacagcagctgtagaggtactgctcctttcagaccaggtcaaccccacagacagtgtgcctaaagtagcagctcagaggcagtttggctgtcgtatttatacccactttttattatatgaaaattaaatggtggattatgcagacatttataggacaggggtggtaatttccaagtcatcaggtcattgtcatgttctttaaagaagcagtaacatctgagtgttgttctggcaagggtaaacgacatggcacactggtgggcatgtcttatggaaagctactcatgccccatcccaatatttacagatgtgaacatctgtaaacattctttctgcaaatacatcctgcaattgtatttagttggtcctcaatttcatctaatgtctgagtcctgtctctgcagttaagtcctgcctcctgagtcaagtcccacctcctacctcaatttgagtttaagttgaaaaaacaaattttgcagaagtgaaggcaaaaaatgaaggcatatccaaatgatacaaatgacaatcattgtcaattaatcttctgtttttataagggcaaatatgattccagaagctcagcattattttggcataatgggaactgtaggaaaggcagatgatttccatagtatttatcactgcattccttgctgtgtatttcaaattctcttggagtttgtacttctaaattttagaaaaagttgtgaattttgaaattttttcagaaattggaaaatatttgtagatcaaattaaacagaaagccaatgagatatattcacatctgtaaacattcttttttatttcaaatatattttgttagctaaaaagtactcctgttgttatattatttagttttacaaccatttttctaattataacaaaaatgtatttctgcaacagtgatatatgtgtttatattaagagaaaataaatgtaatcttcttgtaaacattttattttgaaacaccggtctaacatctgtaaaccaaggcagtattatgtttccatatacttaagaataggtactcccagtgggagatgatataggatagaatggaaaatgtattatccattggaaagattctgttatgtgggcatgtcaaggttattttctaaacatttgtgtcacatccttcaaaaattcttatttttttcttttatttttataattgcaacttttattttagatacagaggacacgtgcagatctgttacatgggtatatttgtgacatttgttcagtggtagatacaaatagttttaattgtaactgaagtttggggtatgatcctgtcacccaggtattgagaatagtgtccaataggtagtttttcacccattgcctgtctccattccttccccttctagtagttcacattgtctattattcccatctttatgaccatgtatactcaaagtttagctctcagtcatcagtgagaacatacagtatttggccttctgttcttgcattaattcaccgaggattatggcctccagctgcatgcatgttgctgcaaaggacatgattttgttctttttttggcatcatagtattccaaggtatatatgcaccatattttctttatctgttccaccattgattggcatctgtgttgattctatgtctttgctattgtgaacagcactgtgatgaatgtatgaatgcatgtgtctttttggtagaatgatttattttcttttggacatatacccaataatgggattgctgggttgaaaggtagctctgtttttaagttttttgagtaatctccaaatggctttccacagtggctgaaatattaataatttacattctcacgaacagtgtataagcattcctatttctcccgagcctcaccagcatcattgttttttgtctgtttaataatcaccgttctgacgggtgtgagatggtatcttattgtggttttgatttacatttctctgatgactagtggtgatgaacattttttcatattcattgtctgcgtgtatgtcttcttttgagaagtatcggttcatgtcctttgcccactttttaatggaatcatttgtttattgcttgttgatttattttagttccttatggattctggattttagacctttgttggatgcagtttgtgaatgttttcttctattctgtaggttgtctgtttactctgtcgatagtttctttaatttggtcctacttttattgcaattgcttttggggacttggccaaaattatttgccaaggtcaatgtcaagaagagtatttcctaggtttgtagtcgaaggtcttatatttaaatctttaattaatcttgggttgatttttatatatggtgaaaggtaggagtatggttttattcttctgcacatggctagccagttatccctgcaccatttcttgaatagagagtccctttcccatggcttgtttttgtcagctttgttgaagatcagatggttttaggtgtgtggttttatttatgggttctttattctgttccattgatctatgtgtctatttttgtatcagtaccatgctgttttgattattgcagccttatagtttagtttgaagccaggtagtgtgatgcctcaagctttgttctttttgcttatgatcactttggctctctgggctccaaaatctaatacacttttctatgtctagtagggactaactctctgcccagagtttaatcatgaaattagtgagccagtgttactaatagaaatatgacctatctctcagacataatagggcataaaaacttcagcggctgaaaaatcatctgaaagactttttaaaaatgtacaatctgagccatttttttctgatttactgtatcaaaaactctagagttggatctagaattcagtatttttagcaagcacttgaagtaatgtttctaaacactaaaatttcaaagcaataactccttaataaatgacaccacttttacatacatttatgactatagttgtaagtatgcgtaataaacattcaatctcaataatatccaaaaatgcaagaacataaagatcttctacaatgaaagacacattaaaacttataatgcaagacatagaaagattctcactaccataacctttcaggagaaagttttttgctgccttttcctcagaaatttagaatcactatgatattttgaaatctttatgaacctcaagatgtttacttttagatcttgttttaaacatactaccaattataagattgtttatattaaatgataattttaaaggatcaggaatgtgataatattgtcaagtattggggggaaattgccctaaatagcattataaataaatcatccaatcatcagtgttactcaaagttcattctttggaaccctattaccttcagatacagtacgaactaaaagcattattgttatcaaataggtgtgagaaatgatgcattgtatagcacatctgattgcagtgaatcacaatgcacaataacatatctaaggctctggagaggtcttacaagtgctcaaccttcccaatacagtttagcccaactaatacatagtaatatattgagaagaaatatacatttggatatactaatttatatgactcgtacaattggtccctttaaattggcaatcaacatatactttattaaattatactacttccaagttctgaaagttatttttaataatagagtctctactatacaaatctaactggttatgtctaggaaaatttagccatcttgtctttttgtaaataattgtgaataaaaattcattttataaaatgtaaataataccaatgagtattataaagtaccaaacaaaaaaaagacatgcaaaatcttttatactttattttaaaataatttttgagtacgtactatgtctgccagaaaatgtgcaagattctgtggaaattgatcaatagtagatatacgtcctgccctccttgaggttatgatatcatagagaagataaatgttaagatactattaggcatatgttgaatgctagctaaaaaagtggcgggtgctatagaaactgcattagtcaaagttctacagaaaaacagaacatacacacacataaagaaatttaatttaaaggattggctcacacaattatagggacttcggaaagtctcaatctgtaagcaagccagcaggctggcaactccggcaggggaatgctacagtattgaggaagaatttcttttctgagaaatcttagattttgctctcaatgcctttcaactgattggtcgaagctcatccacatcatcaaggacaatctcctttacttaaagtcagttgattgtagatgttagccacacatacaaaatagcttcaagcatcacctagatttgtgtttgattaaatagctgggtactaacctagccagattgatacataaaactaactatcacagcaatatataagggggcatatataaaacagttaatcaatcaaactgggaagctcaagataggttttatttaaaaatcgaattgaatttaactgagacttgaaataaaaatagagttaggtaaaaattaagggtaaattatagggtaaggtaggatcaagaagacaaaaaatcttatatagaaatattcaaacatgaaaagaatagtgctgattattttgtttctttcttttatataggaagcacaaaaaaaggaaggagtcaaggatgattttttgattccacagagtgagttatagaaccacaaaaaggaaaatagtagagaaaaatcgtagtttcagtttggggtctgttaactttgaaatacctatgagccctccacacagagatatctagtaagaatataagaatatgggcctagagagattaggtttggtgttgttaactcaagtaatctaaatcttgggaatagatgaaatcacctggggaagtgtagggtgaagagacaggtatttagtcagtgacctgtggcacttaattcaccaagatttaataggaaaataacccaaaaaaggagattgagagagcagccaaatacataggtaatgtggagtgtgatatcagggaaaccaagaaaagggcttgttgtaagaaaagtgttgtgatcaagaatgttacgtcctgctgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctatctgtctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggagaggaggaaaaagaggtcaaagtgaagggaaaggtagcaagatccgacatttcaggaaaatggaaagtgtttaaagatctacagtgagaaattggagatgaactcactgggtaacagtaaacatagggcaattttgaacactcagtggaacttggagaccactgaagaaatttatcttctgttatgtaatatatttttctcagtggaattgagtagcttatatatactcatggaataaatggctatattttttccagattgtttagatgagtgtgacaacaggataacaaagctgaggaatttaggttactggaaaaaaagggcagtttaaagtgttctgtgcatctgggtgtggtggctcatgcctgtaaacccagcactttgtgggcctgaggagagaagatcacttgaacccagcagttcgagaccagctgggcaacatggagaaatcgtgtctctataaaaatattagccaggcatggtaacacacttgcattcccagctatttgggaggctgaggcaggatgattgattgagcccaggagtttgaggctgcagtgagctatgatcatgccaccactgcactccaacctaggtgacaaagagacatcctgtttcttaaaagaaaaaaaatggtctgtggaatatggatttagaatagaggtaagtgacattagaaaatagaggaggcatagggaagagaaaaatgtctggtggacagaaatttcattgtttaaaaaaaaaaaacaactgtagtgggataaaccaaatagataagtaagaggacagaatttgtagttgtgcagtagaatgacttactgaagagtgggggaatagtggaatagtggaatagtggaatggaggaaaattttgcagaagacaaagaagttaagcctttaactagctgtccatgtgtacatgtaattgtcatggtatcaaataaaaaattggagtggaaaacatgatgacacaggtactaatgacttaaatgagtgaggaagtaaccaggcaagtaggcagtgacagtaatgaagtgacaaaggaatttataaagccatatgatgtgaactaaataggagagggatttattattttttttttacaagagaggctataataggaaataaatagaatgtagtatatacctatttattagtggctatgttatgttatgttatgttatgttatgttatgttatgttatgttatgagtctgagtcttctgtgaaccagatgccaagatggaattagaagagccaagatttattgggaactatctatgggggataaagaagaaggggaggaagcagaagtaggcaaagaatgccttcagacagcaattcagccctgacatgtgtgaaaggagataaggaaggaagggatatttggtaggaaactcatgactacgtgggcattctgcaaaagcctcagccagaccaatgtggagtccccaggcaaatgtttctccttggaaaaatcccacatcaggcaggcatggcccagatttatagacctcaccatatttagtcattggctgtgagcagagcataggatgtgtggctttggagtaaaagccattgtggaccccaaggtgctggaggctgtcggccaactctgcttccacggaggattttctggaagggagattttagtggaagacttctaaaacctgcgtgcttcatcttctcaggcatcccacctcttccacacaatcctctaagccttttttgaccgcacttattttatttggtttgttttgctttctttcctagaaatactctatttagaaaatgacacctactaaataaagctcctcgagaaactttcctggaggtggactatatgacaaacatacttgaaatggactgaacaaagttattcttgtgagttagatgcagcaatccatatgcttacttgtagaagaaaaaaagtggtttaaattataatctggatgtaaaaaatcttaaaatcatgatggttacattcctgcctgataggaggtttttttctgagccccacatatttctatagtcagagactaagtccataagcctagcttccaggtggcttctgatcttcatgcagagtatggcttggatatcagtgtgttatggatcaaatttgatgggttaaaagtctgtatatcacaggtgtttcaagattaaaggcaggggagtggtctcttcatcagggaactgagagttgttatatgcacttaattatacatttctatatgtaattataaagagttttaagaatagtatatgcacatctctgccatggatgatctggaactttaaaaatggcatttgttatgaaatgactaaatatagtaatataattgctattgagttgtccttttcttgactgtcaggcagtaacctcatcatatcatttaattctgattggcagctgtttggtactattcatcttacttttttctccttgaacattactcactttgtaatcattgtatctttaatatcttgtgtcatacatttgaagcaatctggcagtttctgacagaaagaagttagaaaataaaagccaacttccctgtgtttttttctggtagaattgctgatatacctacaaccatagaaatattatgaaaaagtagttgaattaaacaatgtcagtgggttataaataataattggctcacttttataaaagctatgtatataatatttagaattatttgctaatgatcagttttctattcaatagaaaagctgtatttatttactaacaataaataaatgacaattattttgcagcataagctgctgtctctaaatctcccctctcccccagtttctaatactacttaatggcagacaaatggatatatttctcaactgctattttattcctatctccatatgttatcctaatcatgagccacaataccccactttccatggtcagttttggataacatatcttattttcaaccaattagtgtatccagttatcatataaaccgttttttgcatagtaaaaaacaaacaggaacaagccagttttatgctcccaaattcagttaatatgatagcaaacaaagggtaagagaaagcaagaaagttttaggactgaaagattgttggaaaaataggaagtagtagtcagagagtggactacaggaaactattatggaagagttgcagtttttagtaatggcaatgctcaggttatgacctgataacatgagattttaaagcatgttagagtttagagatgaacagaggaaaatggtgtgaaaagggcaatgatagaaaaagagagtcaatatcccatgatattgaaacaaatagctaccgctgcaaaggatggtggaggaagcaccaccttcaggacttatctgttaaaggtggaaggtgagtagaatgttcacagaagagattgagcatgaaaggacatttgctgaatgccagagggcaccctggaaaacttgtgagtgttggagtataagcagaggtgggtaagaagaaatggctccctcttaatccctcttgatggaggtgaggttgtccagggttcactttggattgctgtgggaggaatgtgcaagagctctaacttggtaggtaaagtctattggtgaagctagttcttctagcatgcacacccccttcatcttggtgatagagggacacgaaaaagtgtaatttgtctaagttagacattttctatatgttaagcccataaatattttaccttctctttattcactcatcaaatattcattgagttgctgctcagcatcaggtgcagcagcgagcgcttagtctctgtcctcctgctgcagcagagagtacggtatgggaaagagacagagccagttatttcacaagcaagaaccaattaaagctgtggcgatttctgtggtggagaagtgcatttggcaggaaagtatgtaactggaggcttagatttgcttcagttgtcagaggggcttctttgaaggagtgacatttaacattttttcgaaaggatgctggtgagcgggtgaggaaacatgtcagacagaaggaaatgaatggataaggatctgaagcctgcattctacatagtgctcttccactccctgttatatcccataccctcccaaaacacagagcttctgaggctgttcaaagagcaaatatttttggaaatctttaaagataatttgaaaagtacaaatgattctttccagtgggatgaaggaagaatgttttaccattttacttatccaactgcttttcttgagtctgagagaagagggagagctcttttttgagggaagcaatattttagagatctatcagtagaattggagtttcttagatttataaagtattttttgttagtgtcagaagaatttgaaaagcaggggaggaatataagagcagtattatggctaacttaagactttttacaacctttgctcttatctctataataaattgtacaaccaacaatctttaaactattagtaagtcagtagtatttcctatttcattactatgtgccaccaaactatgcacatttctttggtcagaactttttaaggatatgatgtgtatacttgtataatattaatattgtataaaatgcctcatttggatttctaaatatctaataagatcttttcaagtttctaatacagcttaatcatggttttatgaaacagttataatgccacgtggagtcatttaaaagatttgtattagttataagaaaataaacagagcatatagtaaataataaaaattacagttcttaaaagtataagcactgaagtaacaaattaaccattaccctcccattttttcctttttttttttttttttttagaacaggcaacttagattagtttctgatcagtcaactatcttttcctttttgttttcttggatccctacttggggagctttttataaggcttattcccaggcaacagaattccacttaatctgttatgtgaaacagtgatccaagttccattttgccaccttgcctggaacacatgtgttccattaaccacattagctgaattcccagccatgcctgcccagaagcagacccaagcaggttgatgacatcatcccactcactccttctattttgtttcaagtttataaatatatttatcttttttgggcatgaaggacttaaatttttctctttgtataatactattttaacaaaaatattctgatatgcttcttagtttatgaattgatctaaatgaaatcatgatataaggcagttttacattttagatgcctgggataaaccagctgagatccttcacttggaggtacagggatgtggcaatttaaaaggtaatacagtgcattgattgtatcatcttcatcattcagcccaaagatcaactgagcatcctcactatccagagtctactaaacactaatagtcaagttaaagagataaattatcttttaattcaaagattttacaatttagtaaaggtttcagctatgtaatacagtggtattaggaaaaaagaaagttagtacaacgatgacgcactttttctaggaattcaaaaaatgatggttaaatacaaaatgggaaatcaagaaaggagggagatggggacagaattacagagcatctattatttgaacaaggccttgcatgagagaaaagtttttaagggaagaaaaaatggaaaagaaagtgctttctcttcctctgagataaaatgggcaaaggagaagaaagtggaggtaaaaaaaaagtatatttcaagttgaagatgagaaagtacaattctcttggatggccttgattttcttagttgagcagatgaaagatagaagtgcatggttaggcaaaatgagaaagaaaatcaaaggtagaataattagatggatgcatagctggttagatagatgggaggaaaaatatagaaaatataaaaaacaaacactttttgaataattagtccctgccaggcactatattttcacattcgctatttgaagccaaatatgaagaacacagtgatactagaatcttacaatttgtggtggagctagggaaatccacttatatcaatttgtcatcaaacttcagcaaatagaattggtgggtggtctttttaatccttaacttttgtggttgcagatatcttgagtatagtcttttccttttagaaggcaaatactgtaattttcatgtctgtctcccatgtctttctctaattacttcattacctgaatggtctcttcagaaatataattttctggtaaaaataaaattatatggagttaagtgacaactctgtgctttttgtatatgcagccactctatcatgcagatatggtagttaagttgctcagttttaatttggggcaatagactgagcagccatttaagaagctgaagagtagcttctctttttcggttttgtgtgaatcgtgggtgtaatttaaaaggcaaaaatggagaaagcctttctggtcctggatagtgaagcttacaggaataagaagagaaaaattgaatttaaaaacaacaacaacaaaacatctgtttcctcagaattagctgctactacccccttcttctttttttttttttcaatgtgtacgagaatccagaatttcttcagtgccacaactgaaacaaaaggtgtctggattagacataagtgtagactacagcaaaatgcttcaaaagatccaagtggcaccacttacataagccctcaggtacccgttaccttacaggatgaatggcatctcattgcagcatgtaagaacttagagacagcatgggagccaaacatggtttggctcctctctttacttccacaaaggtaaatcagcttctttctatactctgattctatatttggaaaaaggaggaacagggaagttcccttagaggggaaaaacatgcctaaaagatggaatccatatattcatttttcctaattttcacctgctatgaatgaagtaatgtctttattttagcaaaattatccatttggacaataaatggccaccttattatcaacgagcttgaactttcaattgatttaatatgtacagtaaactgacagttttaaattggaagataataaacttggcaagtctactcagcaatttgcctttggttggttttctatccctactcccaaattccctacacatgccccattatcattggaaataaaaatttccagagcaaaatgaagttagttagagaaaatgatggttgtttttgcatgttagtttaagcatttaatcttaattctgccataccaatcttgagtagacaggtctgtgtgtaatacaagcagagtattgccacaatgtctctaatcaccggttttttattcacattggtgaatgtcatcaacttttagatcatccaccaaaaatccttagtgtaactgcaaacctagagtttttctctattttacaaacacactaatacatgtcctcatgttttattgaatttctaatgttaaatgacccattggcatatattattatctgggatagaaaatatataactcaatgataaaaatatattttaatggcagatttacttggtattcctcttacatttcatacaaggtatgcacaaaacagaaattttaacttttctcacctgaaatatctacaatttcttatcaatctcaaagaaaatacattatgtttgaatagggttgtcctaggaatgtacagaaaccatgtatttctaatcccttaaactaggtttgttgactttttggaaaccttagacttccaatacttaaaattcatacactggtctttacttttagaaaacaaatttgagaatcaccatatatatatttttgaaaattttggaaatatgtttgcttatagcaaggtaggaaaatagattgcttatagcataaacatcgttgacatttattttgaagaaaaaaagcaaactaagtaatttcacagacagaacaaagccaggctttcaaaaaaacttatgtgctctacatatactacagctacatgaaagtaacttgtaataagttttaatattcacatgtcaaatggataaaataattaaaaattctcaaaatattaaattattaatttatgaattaccttataagtgcttatttaatgggaaaagaccagcactttgaacctagagctttggcccatgttcaatttaaatgataacctgtgattctaaactagagggtttaacatccccagtagaaaggtcaatgggaaatgtaggaaatgagattttttttcagtcaccctaaggaattcttaactaccttgcttgggtataagataagtgtctgacaaggaaagaattgtcccctcaaaaaatccatctttattagcatccccgttgactggaacttaattaaatttatttatacttgctggacacaactgaacatctaagattccttccagctctgaaatactccgcaacagttacttaggaagaattaaactgatgcagttactctagtagaatcagatatacttgtggtttatatgtgcaggaatacacattaaaacacacacacacacacacacacacacacacacacacacacacccttcaactttaacagcatcttttctgtaaaggaagtcagtaaaaggctgctctatttcagaatcaatctaaagagagttatgcaagtaaaaatggtcttttcataacattttttcaggaagatgatccctatatcggaccccaataatgaaattaaactacattttagtacagcaattacaaaacatcttttttctttatagaagcaatgcatgctttttaaaataaaatagtaatacatagatagccaatatatacagtgaatgtaagttgagttcttcaatgccccatgatctgctccttcttcacatcttatcttcctctctggtggaaccccagagacttctttgttaaacccaaggcttcacataacacagtggaaaacttattgctataaattagacataactaacctcggttaatagagaataagcaattgaagtagattgtgccagtcctggacaatcagtagtggtagaattgaagtaaatttaaaacttcataccattccctcaaggattaaaattcaatgaaaaaaaagtaggccaaagaaaacacttctataaattatattttgtccttgaggggtatttttgtattgtattctaggctacatgctgttacatcattaaaggaaactttgtttattctttctaactagaacatttatcccagaagccagcaagcacctcaatattaggtcttataatatgataaagtttcacctccttttatcaatgtagagaagtagtttcttatcttccctggtgacattctggcttttggcatccttcttgaatatagggtataaagtctccttttgatttgaagaacttgtgccttctgatatatccctgcaagtttgggaccatatttggtatgcattgtgtgtaagctttgcttagtgaagcacagtttgtccataaacgaggctcatccttaccagacaaactctgggattataaatacacataatactcttagcccttagtaatagaggtcaaaagataatcactgggtgggataaaatgtgaaggtataatccagaatagtcttaaaagaaggttcttagaatagttgcagataatatacattgtagtagaagggtgtggaaaataaaattaagaaagaaagtaataataaaatagagaaaatggtgaatggaagtcaatgataaggtaaacatatctggaaattaattcatgtcaaattttgtgtatatataatattttcccctcattacaaaattatgccatatacctttctaaaaagagaaaataatataatgtaatatattgtaaaactcattgcatattttgtcctgatgctattaaaaagtatttcccacctaaagtttatgccacatgcattttatactatgagaaactgcatttgaatataaatttatgcacttttatctcaatgtctggatttcaacctcttgcaaattagcaattaaattgaactagatgcactcgtgatgtgatttaaatgccatttgactctttcagagcactcataaatatgattttattttcatggattataatgataaatcccccaaatgtagacttattttttatttcttcaagtaacaaaggaatatagaatttagaattatgaataatggagatttattcttaaagtattcttttaattttacattcattatattttgtgtatgtgagagagttatacttcacactcagaaaaagtgatatagctactagttaatgtggtagtgtgattttactagttactttacctgagctagccaaacattactcagttttcatattttcttctgcatagtttgaacgtgacagctctcttttttaattgcattagctttgacagtcataaggagatgaaagcattttaaatgataccataatgaaaaatacagaggtttgtttgctttttctattaggtatggttgagcataaaaactcatattttcagttttgttttgatgcattggtacttcacttccttgcatgaactgacggaactgtggaagagtattatgtctacacctgattatgagtatcggcaccagacaattagtaaagcttcattctattacagttcatgcctgaaacagtccccagcactcactggttgactaagtgaacctttcaaaaacagaagttcattacaaagatgaaaaacatttaaaagctaatcttagttttaaaactggccggggacagtggttcatgtctgtaatcccactactttgagaggcaaagccaggaggattgcttgaggctaggtgttcaagatcagccttgacaaaacagtgagaccccagctatattaaaaaataaaataaaattagctgagtctggtggcacgcaactgtagacttagctacttaggaggctaaggcaggaggattgcttgggcccaggagttcaaatttgcaatgagctatgatcatatgatcaatccacggcacttcagcctgggtgacagagaaaggcattgtctctgaaataaataaataaaaataaaaaagaaccttagtctacatatccctacaagagatgaatattatcattccctttatactaatttttgggaacaattttttgtgtggacggcattggtgaaaaaacacttgtggctacattttacattggttctttagaatcatagcaaataaattctaatagtatgcaaacaaaacgaaaacaaagaagtagtaatcctttattaatcacatagttttgctttagtaatttctatcatgttttatttgcaagcataatgcagttatatctttgatctttttaatagtaagttcgctttctgtaaaagtaatgaaaatttaactgccttttcaattcttattaggtgtatgatatttaatttaaacatataggattaattaaatatatactaagcctattaatgacatcctattaaacactattagcttcctgtattacaattaattagatgtatactaattattaagacaataatatataagtatatagttatatttaattatattaatcaatttatggaaatttaaatttatgaatttatattttaatatcttcattttttaaactagtaattatagatttgtaacatttgtaatatgtgtaggtaatcaacataaatacaatttctataacttttctctgtttctaacagatttaaattttttcatttgatttacattcatttttctgaaatagtagcattaatttctcttttttcctgagcttagactcctcaatacccctatttatagattccaagtccataacgtgttaccttggaaactatttaaagagcatcgtctctttactatttgtttttatcggatcataaaactgccttttttctccttcagctactgcttcaaataactcagtactgtgagaactgataagctcagggcttatgccagtattatagtgtgtgtgtgtgtgtgtgtgtgtgtgtgtgtgtgtgtgtgtgcgcgcgcgcgcgcgcgcgcgcgtgcgcgcacatgcaagagcattctcatgagtatgtgtagatatatgtgtgtttatgttttgtgagtgactactaaaaattaatcattatgtcttatacatttcctcacaccattatgattttgggggactacctgtgtgttgaaaaactggtttttgaaatgacttcttgtatgaatagtctaatatctgaatctgtagtatgtagtattttaccagtacaagatatatagcattgtaatactttatctcaggcagtctgaggttatttttagctctaattttctctataaaaggcagcacaatacagtgacaaagaatattagctctggggctgcactgcctaaattgaattctggttcaccacatactagttgtttgaccttggacaagctacttaatgctctgtgacttatctgtaaaatggggttaataaaagtgcttgcctcataggcttatcagtcaattcttgtaagtacctagaatacgtggttaatggatgccaggggtctaaccaactggcttgaaaaagattgatcttaaactttaattaatgcctgtggatatacactcctgatgatctaaagagaaatttaatttacatcaacaaattcacagtctgggtgttaaatgtgaataaaatcaaatagttaactgcataaatactatagatttcaagatttatttttcagtccaaattttgaagtcaaagtataatgaatttataccagaccctcaggaagttattagcatagtgtctggcatatgataaagtctcaataaagagtgaaattaataatcattgtgtgattgagactcactagcactagtaattaggatgataatatcacatggaggaaaactatcagagtccatacttgttatttttgtcaatcttgttctattatgaatcagtaagagcaacttatggaatgaccattcatgctttagcatgtgcatcttaacatctatagaatctttccatgatatgttttgttgtaaataaatatttattgacataatttattatttacttgtaataaggcatttagtatgcatatttactattgaaatgaagcaacattagggttttaaaatgttcctttataccagaccctcaggaggttattaattatttttggatatccttgcaaatagtccacttcacagtaattcacactggttttgatattttaagattcttactgtacgaaaggtatttattaattaagttagagtctttgagtatctcatctgcattatggattcagatatgcttgcccggataaagcattagatttttaaattcttcatgtcacttaggacatttttacttgatatcactttttaaggtgaattcatttgtaggaaaaaaagcaaatgaaaagcagaaaaattagttagttaattagcttgggattagccatggattttgtccatatgagaaaattcagtgaccttaagtaatgatttattttataagaactcacagacctttatttattactatgttacattgtaaaaatgcttcacctgagccttggtttcttcaatacaccatggagctaaaaagttttattttgcaggattctgtatatattgcagttttattataaagcacacttaaagaaggctaataaactcctcattgatatgcaataaatattagtttctctatttcctttgtggaaaccatgaaattatatatatatataatttttgaacacttttatcaaattaatttttaaaagcactcatttactaaatatgactacagtggaaagaaggacttaatagtaatttagattatgcttcatcaatcattagaggaaatgtgagattggatcaaagaaacaagtcatcttccaagaatagttgctctgaaactgtcattttttatttcagtgtgaatattacattgagtaattgcagtatattttgttctgtgtggcccctaacatttgcattccctcttattgggaggaaagatttattgctgccaccctaatagtacagtgagtctttattcagtgagtgttcactgtacaccaggcactgtgttagccactttacaggcattttttcttacaattcttacaaccaacttgcaatgtgagcattcctattatccacattcacatttaagcataaagaagttaaggtttatgggatgtaaagacttgcccaaagtcatacagatttaaaatgccagacccagtatttgaactcaggccttatttcagagcctctagtccatgcctctatgtactatatctctgttcattttctcactccaatttccacttaatattttgttctttgaaactaatgaatgaacctcatcacttgtaactgcacactttgaagcctgaatatctctggggcaggaaatgaaaacttagcatgagagagacagaacatgctatgaaaatgtaagtctgtgtgtcatgtcaggcaacttcatgagcagcaattccttcaaaattcttattctaatttcattaagggaagtgaaagggaggattttgagggtgcttctagttttcagctggtgccttagtgtcttgttttggaaatcactttcttatgtctaaggaagtaaataatgaaaaattacaatggacataaataataagttaataggatcattgtggggatacttatttcattgtcattaatttcttaatttttttgaccttccttagagactatgtcataaaaaggaacattttaaaaccctaatgttgcttcatttcaatagtaaaggtgcatactaaatgccttattacaagtaaataataaattacatcaataaatatttatttaccacaaaagatatcatggaaagattctatagatgtaagatgcacatgctaaagcatgaatggtcattttccataagctgctcttactgattcataatagaacaagctggacaaaaataacaagtatggattctgatagttttcctccatgtgatactatcatcccagtttctaatgctagtgagtctcaatcacacaatgattattaatttcactctttattgagactttatcgtatgccagacactatgataaatagcttacacataaattatttttttcagctcttcattcccatttcagaagtgaggaaatttaagcttgaagaagtttagtaacttgttcagtgacaggcaagtaatagtatgaagttggaatgtctgactccaaagcctagtatcttatttgctatgtttttttttttacaatttgttgcatattttcttttgttttgtaaataataatattgaaaaatatgaaacacaaataaatagaagtgtttgttgtatagctttttataagactaggtttttatgttagcaaaataaatataatattaaaaagaaaatattttacacctttaatgtaccaatggaaaattctttcaaaaaaattcagaaaattatagccaattgccccctaattatctgtggtgtttaattcaatgcctaatctattatctgtgaaatagaaaaaacaaaaatactttcatattcataattagactttagtactcagtagtaagaaaaaagaaaatattgcatatatgattctgttgttgttggtagcagcatgcaaatttctgcataccttgtttataactgacattaaaagttctatgttttcctcttgcttctttagcaaccatatcaacatgcttttggggaataagaaatgccaagttatatcatgtatgacagagttttcctggaaatatttgtacatgtgaagcatactatatatgtcatggggaaaaagaggatatatgtaaatgtatagctttacgtttctggtactgagcttggaaaaatggtagaagttttcagggatgccatttagtgttggattgctgcacagtgtatttgcattatttgcaataactgaagtatttagtatttgtgcaggcatccttgtatttaatattgttaatatttatgttaattaagagagaactataaagaagcagatcagtcagttgcagaaatcatctgtaaacagcttttctacaaaggttcaggatgttgctcccaaggaaagacaccgttacatgacctctgattaatctcttccctcttatttgatttctttgaataaatagattgctctacgttctcaaagtaaaaagggtgatatattctaatattgctgtaccattttaaattgcatagataaaagcctatttagtggggcataagatcaccataagcctcttggcagttttcagcgaattcatacatatcaaaagggactcaaagaaaaataacaaagagcaaaaataatgagcccgtcaaagcaaatgcttaatgcagctccactttggtattaatcagactgtatgtgggtgagggtcaaaccaaccgaggtcaatagagaggattttggtaaagacgaaaaaagaactaagctagtgatttcagacagattgaattttttttaaagtgaaataggaaggtcacaaaatcagattcagtttgcagaagcacagtgggcaagttttaatgacttctcagtagagctttttaagagaggcacttgagtttgaactatctaaactaaacttttaaaaaatcaacaggaaaagggaaggaatatttgtaaagattaaataaacttataaaacttgcttttattgaagaatttcactactttggaagattaaagtagcttccttaaaaaggagattttaaatgtgtgcagattttatttaacacataatttagatattgctttatgtcacagaagagcagtatgtgcatatgtgtgcacatataattgtaaagatgtctttataagatactttccataattaaatataggtgatttgaatatttataagactttaaaaatgtttctgtaaattgtatattctgagcttgctaaatccctctttgacaaatcctgaatgggagagagccaataacattcttttcctctatcaaaccattcttactctacatattcttcttctgctttctagcagaagaagaaaaaaaaagaatgaggaggaataagaagaggaggaggaaggaaagaagaacagaaacacaaaatcttactgtgtcattacatgacctatgattaatctcttccatcttatttacattttggataaataggtgactctattttctcaaagtaaaaaggaagatatatttacttacttgccaattatcttattgaagtgttaaagttttatttttctctggattattttaagatgtacttactattaattcattttattgaaagttgacatggtaaactatatttccaggactatagaagattcaaagatgataaaatatgtatggccttttcttcacaggctttaaaatctaatgacaatttcataagcaaccataaatttgaacatttttgatatctgtaacaatatagtactttatgtaaatggttatagcaaaaataatgccatagttctatgaggaaagaaattttaaaattcctgattcttctcctttagaaatatgtacatatttatctatctatgcatagatactatttcttgaaatatagttaaatctattatacttccatcatattaggctatatatgcatgcttctatatatatattaatatatatgttaacatacagaataaaaataaatatatatgttctactagcaaataatgtatttgctctattatttaatataaataggtacattgatatatattatacacacatatattaatatacattgtatacaaatatgaatatatacattataaacaaatgtatatatctatatatacattacatacaatgtatatacatacatatatacaaatgtgtatataaatatatacattatatacagatatatacattaatatacattatatacaaatacatacattataaatgaatgtatacatatatacattctactggcaaatattacattctgtccattcataatgccacccattacttcactcaagcatcctagattattgtataattggactttatgccaatagtcattcctaatctctccatgatacgaagttcaacatctgcttttttaggttccaaatgataggacctttaactacatttctagcctcattttatcttcctttgtatttttagtacataatgttatacatagcagtgttcattaaatgaaataattcataacaaatgaaatgataaatctttttcatgcatatgtatggttttcaagcaataatagtgaataatttgtttttctcttgctcctgaattataaaaattatggtagaaatgaactagcattttaaatactttttttatatcacaaaaatgactgaattcttattaaattatgtgatttttaaactcacaataatcttggaaattagacacagcaagagttagtattctgacttataaaggggaaattttgtctaagatagataaaggggtttgtgcaggatttctcccctagcaaatgatgaactagcactggaatttaggattcctgaccatctgtgctttgtctttttccattagagctaggatgaacatatgccccattttttccagaaaatttcacttaatacatagcatcttgaattgataattaattgtgccctatttcactctcctgtcctggtttaaacaataaattatagggcaaccataactatagctcacagtaagaaataagagaaaaatagaagtaggctatacccaggataagtaattttgatatcaaggttgatcagatcatattaacttgttaccatcaaaatatgtcattttaatgattcacaagttggaaaacttaccttgtgaatattgatcactactgtgatatagattcttattattttatcttatttgaaaactactaaattgtctatgaatgtttctgagtgttgtctacacaaatttaagacactacactatgtgaaaatgaacccatggtagttccaaactactcaggtttgacatgccagccatcacatgagatgagaacagagagtaacttgcttgatggaaactgagtcagattgggtgcttaatcagccactgattaatcagaatgcaggtctgactaggagaaccacaaatcaaaatgggcattaggctgtgttccctattaaattaataactgactataaagccaagtaacatttcaaatttcatttgattccatagatttaaaattggtggtatgacaactgaacgtattttaaaacatgccttttttttgaaggcaatgtatttctctgcagaaataaactcttgacattaatgatattgactctttcatccagtttcaaaactctattttgtcaagaaagttataattattgatactacttgacagcaaagagcagactgctttaaatgctcatcaacgtcttttcaaaatagatcattattcttctaatttatttccaaataagaaaagagctgacagaggttgagatttgttcaaatatttcaatcctagagtatgtatatataatacatatgcgagatgtgatggggtgtgtatgtgtgtgtgcatttatgtgtgtgaatggcacataatctttccaaattacctggagaaaattgtatctgacaatcctattatagaatgcaaaagacaggaatgaaaaatctatggtcatacctattcacaaaattgtttaagtctagtttaaacaacatactaacatcactattatttctatataatcccaataactatttgggcttaaaatttatacaattctatttagataaattcatagtatgctagaaatgaagatatttcaaggagaatataagaacggcaaggtctttgtagcatcactgcatgtgactggactaaaaatccaccgtgagcttgctgagtaaattgtttcagatttgatcccttcaagtgttattgaagattctcccacatataataccttaatgttactcaattcattgttctaaggttgttctaaaattgttctaaatttctggctatgccgaagttcatttctaaaataaaaggtaatgcaggcagttaacattttgataaatactacttcatacttttgatctcatttcctgttttttattacattagattttctatcaaaagaggccattatagtttagggataaatgcttgacaacagagtgtgtatgtcaggatatttcaaacggtgaagaaataatgtttttaactactttaattatgcttctttctttcctattggatttgataatcatggccaaattattcattaattacttttacagataaccaaaaaaatgccaaaaagtgctgtttctactaaaatctcttagcaggaggatcttcatgtttggattgtgcacaaaggtattttcatttgttcagagcacttaaacaaaatggacaaaatgtgtattttttagaaaattacccatatatgacagagcatcaccagtgacaaacacgttattgctgaagagtagacgtattttgcatctgcttatgtcttaatctgatgtactttattcaagaagcaggaagtgagggacagagtcctgtagttggccttaaaatcctgccccacaggtctgtgccccttacacttactcaccaaggcttggccgtgggtttgttatattgaatcactacttagaaacttagtttcctccaccattggccaattttcatgaatgttgtcaatgatagaatttctcgatttttcagatatctcaaatggctttaagccctggatgtaactcaattaaaaatattactttcagttatgttgttatctgttcacatttgagctgctgataacatctgttatttgagttgttaaaaaataattatttgttgatactcttttccatgctattttacagaaacgtgtaacttgttaaaagtgttagttctatcttttttctctgtaaaaagtagaattctaagaaaaaaattacaataaccaactaaggtaaagaataattaagtttgcttttgtttcttttatttataggtatagtgagttggattaatctcactcctaagttgcactattattagtctatgcaaggtctttcttttttatttgaaaaatagttttaaaaattttaattattaccttctcagccccattgagacccatgcccccactatctttacgtaatgaaccactctaacgtacattagtgtatgtcctttatcatggttatatcctcaaagaatatatgctggtacttttaatatgcatctttggtatttttaaattttaaatgtatatatttgttttagttttcactcaatgtgattattaattgttaattgtttctaatccacaagttttatacagtacctgctcatcacatagtatttatttcctagtgatggaaacttcattgacttcaacttcctgctgtcagaaactatcctttaataagagtcaccacacagtgttaattcattcctaatcaatttgtggtgccagttaatgtgtcaaagtatctgtctgtctatatttgtctattatctatcatctatatatcatctacattgatctgttttccaaagtcttaattacattctattgattttttttctatttagctccacttatttttactaaaaattttagtaggatatttaatattgactaattcctcttttttcttctttttcaaaatttgctcttctatggaagtttattatgatatgtaaactttggaatacatttgccaagtaactaaaaaaatctgctttatttttagctttcagatttattgagataaagttgacatacaataaacttcacaagtttaaaatgtaaatttgaaatttttaacatacgtatacatcagcgagaaaataccacagtgaagatagtgagcatatctatccactcccaaaagcttccttgtatcccttggtaatatggaccacacaccttttctcaatactgctcctaatcataggcaactactgatctgctttttgtcagtacagattagtttgcattttctaaaattttatataaatcaaattgtatagtgagccacaatttaaaacttatgaattgttagtttctgaaattttccatttagtatttgtggaccacagttgactgcaggtaaccatgtaacagcagataaaggaacattactgtgtgtactcaatttgtgctcctttttgtctttcttttttcattttgcttaaatattttagatttatctatgctactttatcttagtctatgacttgtcttttgatcctcttaaaagtggctctggaatagcggaatcactcaagtttaatgaaacctgatttatgtagggtttttttgctgtttcggattgtgtttttgttgtcttatttaggaaatatttgccatattcaaacccacaacaatttcctgctatattttcttctagaagttttatagggttaggcttaaaaatggttctaagattcattttgagttaattttttgtacacgataaaggtatagatgaaagtttttgcttaattttccttaatgtataatgttacatgacagtatttattttgaaaagattatcctttcttcactgaatttcctttgcatttagtttaaatcacttgagcgtatatgtgtgagtttttcttttttcttttctttttttttttttttttttgagttggagtctcgttctgtctcctaggctggagtgcagtggcatgatcttggctcactgcaacctccgcctccttggttgaagcgattctcctgcctcagcttcccaagtagttgggattacaggcgtgtgccaccacacctggctaactttggtgtttttagtagagactaggtttcaccatgtttgccaggctggtctcaaactcctgacctcaggtgatccgcctgcctcagcctcccaaagtggggtttttctttaatctgctgcatttttctataacaatactacactgtcttgttgactgtaggtttgtaataattattgaagtcaggtagtatatatccttcaactttttttctttttcaaaactgttttcactattctagatattttgcatttctatgtaaactttagagtcagcaagccaaattctataaaaatacttgctgaaaatttcattggaatgtcattgaatttatagatcatttggggaataattgacatcttaaaaattgataattttactatataaacagactgtatttcatcattaatgtttaatttctcttagtaatacttttttagttttcagtttccagatcttacacaaattttccagctatcctcaagtatttcataattttgatgctattgtaaatggtattttcaaaaacttcacttttgtagaaacacaattgattgttaatagtgatcttgtatcctgagacatgtgttaagctctcttattagttcaagaagatttttcttttttttgtagagtaatatgttgtctatggaaaaaaaaggttttcctcttccccaccaatccaaatgactatataagttttttgtgccttactgtattgactggaaacttgactaggaatagtaagaaaagatgtattttccttttttcctatcaaaggggaaaacattcatttttacataattaagtatattagcttcaggttgttataggtaacttatatcgggttggggaattttcctttcttctttactgaaatattcttttttagtgttttaaaatcaggaacaatagctcgatttatcttatactttttagaaatctattgggatgatcatttgtgtatatgatgaatgatattcttttttattctaatgttaaagcaaccttgtattcctgagataaactcaaattggtcttttttttgtatagtgttgaatctacttgttaacattttctgaaaaccttttacatctatgttcatgagggatattggtctaaagtttgcttctgttgtttgctagttctgttttcggttatgtttgttttatatcatgttaagaatattctatcctcaattttctggaatagtttatttaaattttttttaatgtttggtagaatttattatgatactgtgatatcacctgggcatagagttttctttgttgaaggctttttttttttttttttgatacggagggtacacatgcaggtctgttacatggaaatattgcttgaagctgaagtttagggtaatggtcctatcacctgggtagtgagcatagtacccaactacctgttggtactatgcctcctccctacctcacccctctggtagtccacagtgcctattgttcccatatttacatccaggggtgctcaatggttagttttcacttagaagtaagaacatgaggtatttggttttctgtttttaatgacaagttctgtttttcataactacaggattacttaggttatccatattatttttagtgagctttggtaatttgtgtctttcaaagtatttgtccatttatctatgctgttgaacttattggtttaatgttttttacaatgttgccttattagtatttttaaaaatatatctgtaaaatctacaatggtgtcacttctcgcattcctgctactggtaatttgtgtttctctcttttgtttctgatcaatctagtttaagcctgataaattttactgacattttgaaagagtcagatttagattttcattgattttctctatatgtctgttttctagttaatcattttccactataatctatattatgtcctttctctgcttactgttggtttcatttgtttttctttttctaattcttttttttctgatatcctgacattctttacctcatattatttccacttccaataaaatatataattgagctgaattttgaaaaaatatagatacttcaggatacttctaaatagtgagtgagtgaaagtcattatttgccataacataacataacattcaattagttaatcaaaaacccaaatgcccgctaggtgcccaacactgttccaggcattcttcttctttatttttttttttttttcattttactttaagttccgggatacatgtgcagaacgtgcatgtttgttacacaggtatacatgtgccatggtggtttgctgaacctatcaacctgtcatctaggttttaagcaccacatgcattaggtatttgtcccaatgctctccctctccttgttccccaccccccgacaggccccagtatgtgatgttcccctccctgtgtatatgtgttctcattgctcaactcccgcttatgaatgagaacatgcggtgtttggttttctgttcctctcttagtttgctgagaatgaaggtttccagcttcatccatgtccctgcaaaggacatgaactcattcttttttatgactacatagtattccatggtttatatgtgccacattttctttatccagtctatcattgatgggcatttgggttggttccaagtctttgccattgaatacttaagtggaagttgaagtactggatttgaatcttttcttatcttttccagtctggtcgtgtagtgctactgcttcacatagtgttactactgtacctaaaactgatatattttatatattttattttcattttcattcagatcagaatgcttttaaatttctcttttgattttttccttcacttgttatatgaaattgtgctattttctaagtaatcaatgattttctagctatctttctgttaatttgattgctaatttaattttatcagaaattaatttcaaagtttttcgactctttacttacaaggcttaatagttttaatatattttattaaaatgcatataagtttgttgagagtggatacctaaaaaaaagtgaacttatcttggaatgctattaatgtctatctccttcaggttttgtctaagccatttaaaagttttaaagctttcttctttattcctagatatttgataatttatattattatttatatgatactagccctattgatatttgattattactatttaggggaattattttgattttattggtctaccttctatcacaatgagcttgattttttaagctaaatgcctggattatgtgtgtgtgtatgtatgtgtgtgtatatatgtgtgtgtgtgtgtatatatatacatactatatatattatatatgtatgtagtatatgtgcatgtatatattatgtatatatttatgttatatatatgtatatatgtatattatacatattagcatatacatacacagtatatacacatatatgtatatataattatatacacatatgtgtgtatgtatggatatatgtttttagctatttttattgcattttaattctatttaatgagtcactgagaacatattatctgctcttgagtgttgcaatttattaatgctttcattgtattctttacaaggtctatttttgttaagtttacttatgctataaaattatttttggttattttgggtaatgtacattaacatattgaatacaataatcaaatatttgtacacttctttattgattccttcataattattcagtcactgaaagaacaatgataaaaaaaactctcattacaatcccacctattatcacagatgtattcatttttacctataatttcatcagttgttatttataaatatataaaaaggctacatttttagatatatatatagatttatacttgttatattctattcatctatgtttaaatattgcatggaatttgactttatcctttatgatttgtatacttaagttctatttttaattatacagtggcttgaataggattctttgattttaattgtcttatttaaattgcaatgcttttatttttaaactttctttgttcttctgattgtatctcttatagatttcagaaacctagaatattttttcttatccaatctgaagttagtgccttgatataagtttaacttagttgtattagctttaatgacatttgtgttatgatttactacagcttttccattttatattcatttgtttatcacaattccatttatcctatgtttattcatatatatgtatatttatatatgggataaatggaattgcacacatatacatatatgtgtgaataaacatgggacaaatggaatgcgagtgcatatatacacgcactcatgcttatgtttctattttgctatttacttcctggaatcatcttggaatcctctggctcactgatatcacaacacccaaaacacatatcatattgatattatataaatttcttgattgtaataaacatactacaatcattttaaaactttgtttcttatttatgttgatggcattaatctttaacaaataatttagtgattattgttattcatatcccaaatatatgacatattgaaattattttttctttctatagtatattgtttattaacaaaagctgtccttgcatgacaaaggctgttttattttgtcattgcatatatctgccagtttgctggaaaaaattagactacaatattttctgtcaactattcaacaatattattcctttgacttctcacatctagagttgctgttgtgaaaaccaataagtatctaataattgttccttttaattgatataatttcctttttaagagaattcagaactttctgtatagtgtaactagaagttaattttaaaaattctatagtgcttagcagtctgaaaactttataaatctgatttataatataatcatattgactaggtattaaagttttatttttgttaactatattttcttttttctctcttattaattccatctatgtttctgtagatttgtattcatgtaagctttctttaattttaagtgcacatttatttctttcattatttcaactaccatattttatcatctagtatcaccaatgtattttatatttgcatttatatttgttcatactccgtttttgagttttatttatttgattatatttgtatgcttattttatattacattcatatttttcattaattctaatttgctactcttgttcagtatgctgtcctttatagttctttatgtcccttatatatccattttttttcctgtaagttcattttttttttttttttggaaccattatctacctcagatcataataacaaactgaggggagggagaaaaagactagtttctggtttataccttataaagcttttaggatgttagagagtgaggtaggggatgcctcaaagtacaaatctactgcttttatgatctggtctcatttgtccacacacctccttatattaaaatataacatgtccttttgaaaatgtttctatacctccacttaaggcctgcttaattctaagatttatgtttcaaagttaaaattactaaatccatacaatgaccatatgatcacagagggtcagaagcaattcaattcttgggagtgaaagcatcatatatacctgttgctcatccttcattccgtctgccctctagtgcaacattgtttttgttctcacttctcgatacaaagatcagctaatgttatttcagctccttagaatcagagtataatgtgcctactatgaaggagagaaatgtatttatatagaatagcttttcacattatattgttatagttaaactgcccccccaccacctttctccagtgcattttttttttctttctttctttcttttgtccacagcaggatctattccttttgcatttccaggaaattattaagattttaatattaatttctggcataaaaatattttttaatttgtgtaggtggcaggagaacagtagcctatatttattaatactcttgtcaagaaatagcagcttctcatgtacttctttttacatattttgttactcctgaatttttaatcttttggtttatgtttgtactgactagaatagaaggataatatttcatatgtgcagtatatatattatgtatatttatataagtatatatacacaattccctctaagatatgtacatatatatgtgtatagacataatacacacatacaatcatataatcttataaatattcacaatatgagactctgtgaaagaagttctttaaaatgctgatcttcaaataaaagattaatatataatctataagttgtgatctttattttggctatatatttgggacttcttatttataaattagcataattttattgatattatacaatttaagtgagtaaatgccagagtccaatcattgagctcgggatctatgcctaagtgtgattcttggccaagaagaacaattgatggttgactcagtcttatgcataaccctgagggaataaatctctttattggccttcctatataaatctttccatttatataacctttccataaaaataagctttatctttggtatattaaacacttatcttgttcattaattttttcattgaatcattgtttggaatgcttaaagcataacatttagtccagtaaatttgcttttacgccaaacctcaaacgtaatcagtgaaaatatattttatttcttatccaagtgtattatattactttggtatggctactataacagaatattatagattgggtaactgaaacaatagatattaagtttctgtcagttttggaggctggaagttcaagatcaaggtgctgacagggttggattcttctaaagcctctctctttggccaccttctctgtggatgcatgtggtctctcttctgcatgcacacgtgtccctagtgtctcatgtgtgtcctgatttcctcttataaagattcaagcttagttagattaaggtgcactgcgatggccttattttaacttaattacctgtttaaaggcatctatctccaaatacaagcacattctcaggtattgagggttaggacgtcaacaaatgaatttgagggggatacaatttagcccatagcaccaagaattctgctcagtaaatatttttcataacattagtgcagaaaaaaatataacattgtgtaataaaaaataaatactttcaaaaattatttaattctgtagaatagaatcccagagcaattcaatgaaaatgaaggaggctatcttttatttcttggtacaatagttaggaaatgttagtagaaagggtatttgatttgagaaaagatgataaaccttttatatatatatatatatatatattttttttttttttgagacatacagtggagtacagtggtgtgatgatagctcattgcagcctggatctcccaggcataagcaattctgtcatctcaacctcttgagtagctggactacaggcatacacctccactcctggctaatttttgtattttttatagagacagggtttcgccatgttgcccaagctggttccaaacaactgggctcaagtgattctcctgccttggcctcccaaagtgctgagattataggtgtgagtcattgcgcctggtccagcatactgtcatactgagataatgatccttattaagccccttgacccctacaagccctgtcattttttttcatggcatgtttatggaataatgttttgggagatcaaatgaattatatatttgcaagttctaatataataaaatcgcaaataatcatatcttattgtttgatattactatcataattatcatcatgttcgtgtaacatacatttgacaaaaaataaatgcatattttctgggtaattttaaatggaaataattaatattaattttgttgaagaactttatgagacccttttcagtaatttagaaatactcctaattctgtgaaaattaatgtatatttttaagaacctattatgtataaaaagctagattgggtgttgtgcatgatacaattgtaaacaaaacgtattccagtttttaagacaattgtttccagtaacagtaatataccaaattgaatatggatggttccttaaagataactctacatgaagtgtggttgtagcccatgagagtttgtagaaagtcatgattgtaactgttttgtgcagagtgagaagataagaaaatacattttgagaaggtaattgaaaaggagagaaatgggaggaaatgagacctatgtaagaaaattcatagtgtgagtttgagtgagaagtaattaggtcctgaaataaagtaaaatttgaaaactggataaaggaaagataaatgacataaatatttaaatgcagggtttgcaagctgttagaatattcttttcctgccaccttcactttgtgacagtactcattctaccttgcatcatcagcaataatagttgtattcttcttttgatcctgtatttatggaggtggcaatactacattttgttttcctcccaccaaatagcatgagaacaattacataaaccatttgtattaagcttgaagaattgaattgcattgaaacaatgcaattgttgaaacagatggaatcaaaaattttcatattagatgatagtggtggaggaaagtaaaaaagggtaatgccatttatataaatacaaattgcaaaaaagaaagttttcttaggaaagaggtttaattcactctgggctgggtctagtttaagaggctgggattaagtagatggcaatgttaaataaattattggacattttattgtcccttaggggaatacctctatccttcctaaatgtaggaaaaaatctccctacatttgaagtataagtaagggaaaggggttccattaacacattattattctagtttttaaactgatggtcttaccaaggtgaagttgataagaaaaggcaatggtagaatattaagaaaatcaaaagttagaaggcagggaaaaggaaaaacaacaacaacaacaacaaaattttaaagtagattagaaaggtggaaccagaaaagtaaagtgttttatgccaaggagatgggcagatgtcatgaagtctagctaaagaatgtgaggaaaccattggtctgtgactttaaagcttcagtgtacaaatagaaaggaacaacttgaaaggtcaagatagaaaaagacaagaaagagaaagcatgctttttagaaagaggacttggaagacacaaaacagcacatgaccaggcaacagaacagagagggtaaaaacagaatggagtagttttgagaatttacaagataggcataagctgtttgatggaaccaattttaatggcttcagcaaagttgaaagcaatgtcgcctgatgacagagaactagtaacaaagtatttcaatgataaagaaaagtaaaaaatattttatatggacacaccaagaggtaagcacaaattacaattaacaaagaagactcgtgtgacccatcattaataataaactctgggaatttaaagaattgaattctagaaggaattttgcctctaaaacatgagatgctaacactaagtgaacaatttaaggcttcacttttgtcttttccaactgtaaaatattttctaacagtatttatctgatcgaaataattttatgattcctaatgaatccatagcaaactcctagtgaatcatagtgactctcactgaaagtgagtgcttcaggactttgaaaaataatagttactatacagccatttataaccagaaccatgctattataatataaatctcaaggaaaaaacttcaaaatgttgtgttatacatattttgtaaataaataatatgtaatatacatgtatacacacatgtccatagttaaattatgtttaaagaacaaactttttagtgtcgttaagtaacagaagaacagatttagatcaaattacttaaaattaacatcaaaaagtattattggtataagttaattgaaataaatttgtacaaccagttattttgagaatgtatatctaagtatttattagattgttttttattatggttactagatggtttatgtagatatgtactttatgttttctgaacacataaattgaaaaataattgtcaggtacaactaatgaatccttttgattttgcattttgtggttctgtatcacagacttacttttgtttgctccattttgaatggtgccttactttattattattacaatgattatttcttgttgggcttttatataaatttcaagtttattcagtttctacttctagttgtttaaatttaagagattatttgcatttcctgaaactatagctctttaattctgtaacattacttgtcctggattattaaaatgcaggttcatatgacttccgttaaggttcttcatgcatctccacttctctctctgtgaaataccttcaacagaaactgttaaaaaggaagaacttctctttccccaagtggctgcagtaaagggaagtaatagactgacaaggcttttagatgtaagaaaatgtcttctggattaattactccctaaaactttatatacaaaaagtctttgatactctaagtttccttatcaaactaatgagtttactcttgcctatacctgtttccccatccttgattttacttttccaaactcttacggtgtaaactgcctaattttgctatgtatgagatacatggacacactcaacaactatactatattaggtagaaaatcatattattgtgtgtgagatgcatggtaaattgagtgtatgcagtcttctgggaaaaaccattaataagtattaccttgttaaaagattttagaaaccatgaaatacaaaagcagggcatgtgaatgtatttatgcttttaatgcttgagtgcaatatgtaactacagctttatgaaaacttaagcaacatgtatatatatacatatataaataataaactttattttagagcattttaaagttcacagcaatattgaacagaaagtagagaaagttacagtatactcaccagtcaacacacatgcgcaatctctcccactatcaatatgctgcaccagaatggttatatttgttactattgatggacttaacactggcacatgattatcacccaatgtccatagtttatattgtttcactcttgatattgtattttttgggttttgaaaaatgtctaatgatatttatctaccattatagtgtaatgcaaaataatttcactgccctaatcctgtgttctccctattcatcccgccctcctttcctcctcctcctcctccccccacttcttctttttcttttttcttttcttttgagacagagtctcactctgtcgcccaggctgaagtgcaatggtgcaatctaggctcactgcaacctccgcctcctgaattcaagcgattcttctgcctcagcctccccagtagctgggactacagtcatgtgccaccatgcccagctaatttttttgtattttttagtagaggctgggtttcaccatgttagccaggatggtcccgatctcctgacctcatgattctcccctctgcctccccaagtgctgggattacaggcgtgagacactgcaccgggccccctcccttcttcttaacccataacaatcacttttttttttttaatgactccatagttttgccttttccagaatatcatacagttagaattatacagtaagtagtctttcaagactggcttcttgcactgagtaatattaattttattttctttcatgtgttttctttcttgggtagagagttcatttctttttaataaatagtacttattccattgagttggtgtacctcagtttatttatccacccatctcatgaaaaacatcttggtggcttttaaatcttggcaattatgaataaagctgctgtaaacattcatgaataggattttgagtgaacctaagttttcaactcgttagggtgaatatcaagaaacatgattgctggattatatgagaagagtaagtttgattttataagaaactgtcaagctgcctgctaaagtgtcttctaaaatggcaccattttgcattcccactagcaatgagtgagagttcttgttgttccagattcttactaatgttagatgttgtcagtgttctggatgttagccattttaataggtatgtggtggaatcttaatgttgttttagtgtgcaattccttaatgatatatgatgctaaaaaattttcataagcttactttctatccatagctcttccttggtaaggtgtctgttttgatctctccatttttaaaatgcgttgttcataaattttaagagttctctgaatattttggttaatagttctttattggaaggttttttgcaaatatttttttcccagtctgtcatgtcttctcattctcttgacattgtcttttgcagagcaaggttttaaattttaacgaagtccagcctatgagttatttcttttttttttctttcttttccttttttttttttttttttttttttgaggcagagtctcactctgtcacccaggttggagtgcagtggcgcgatctcggctcactgtatgctccgcctcctgggttcacgccattctcctgcctcagcctctccgagtagctgggactgcaggcacctgccaccacgcccggctaattttttttgtatttttactagagacggggtttcaccatgttagccaggatggtctcaatctcctgacctcgtgatccacccgccttggcctcccaaagggctgggattaacaggcgtgagccaccacgccaggcccaagttatttcttttatggataatgcttttggtgttatatctaaaaagtcatccccatacccaaagttacctagattttctccattgctatcttctataatttgtataggttagtattttatatttcactctatgatccattttgtattattttttgtgaaacgtgtaaggtctgtgtctagattcatttttctttttttaaagtttttctagcactatttgctcctttgtattgccttttttcctccgtcaaagattaggtgactatatttatgttggcatacttctggtctatttattttgttctattgatcaacttatctattttttcaccaataccacactatgttgatcactgtaactttacagtaagtgttgacactgggtagtgtcagccctcttactttgttcttccctttttttatttgaattgagtattatgggccttttgcctctccatataaactttaggatcagtttgccacaatgcatataataatttgctaagattttggttagaattgtgttgactttatagataaagttgaaaaaaactgacaccttcacaatattgagtcttcctatccatgaacatgaatgtctccccatttatttgattcttttttttgaaatcattcatcagagtattatactttttctcaaatagaccttgtgcatattttgtgagatttatacctaagtatttcattttggagggtcctaatgcaaatagtaatgtgtttgtttttaatttcaaattacatttgctgctatataggaaagtaactatcatttgtatattaactttgaatcctaaaaccttgttctaattgtttattggttccaagagggggttgtaggtatgtggccttatttctggattctctgttctgttccattggtctatgtgtctgtttgtgtaccagtaccaccctgttttggttactgtagccttgtagtatagtttgaagtcagtaatgtaatacctctagctttgctctttttgcttaggagtgccttgactattcaagctctttttggttccatgtgaattttaaattttgtttttttctagttctgtgaagaatgttattagtagcttgatcagaagagcatgaatctgtaaattgctctgggcattatagccactttaatgatattgatttttcctatctatgagtatagaatgtttctttatttgtttgtgtcatctttgatttctttgaggagtgttttgaaattctcacggtaaagatcttttacctccctgatttgctgtatttctaaatattttattccttttgtggcagttgtgaatgggattgcattcctaatctggttcttaccttggctgttgcttgtgtataggaatgctagttattttcatatgttgtttttgtaactgaaaccttgctgaggttgtttaccaacttattgagcttttgggctgagaatgcagagctttctagatatagaatcatgtcatctacaaacagggatacttttaatccctctctttctacttgggtgtcgtttatttttttctcatgccacattgctcttgtcacgactttcaatactattttgaataggagtggtgagagagggcgtccttgccttgagccagttttcaaggggaatgcttccagctttttcctatttagtatgatgttggctgtgggtttgttagatagctcttattattttaaggtatgttgcttcaatatctaatttgttgagagtttttaacatgaaaagatgttgaatattattgaagccttttctgcatctattaagataatcatgtggttttgtctttagttatttttatatgatgaatcacattagttgatttgtgtatgctgaaccaaccttgaatcccagggaaaatgcctacttgattgtggtggatttgtttttgatgtgctgctagattcaatttactagtattttgttgaggattttgcatcagtgttcatcaaggatattgtcctaaagttttcttttttttgttgtacctctgccaggttttggtatcagaatgatgtcagcctcatagaataaggtagggaggagcgcttcctcctcaattttttgaaatagtttcagtaggaatggcaccagctcttctttgtacatctagtagaatttggttatgattctctctggtcctgggcttgttttttggttgacaggctacttattactgattaaattttggagttcattattgttcttttcagggaattaatttattcctggtttagtttttggaggttgtatgtgtccagtaatttattcattaatttaccaatttcttctagattttcacatgtgtgtgcaaggaggtgttcataatagtctttgatggttatttgtattcctgtggggtcagtggtaataatcccttcattatttctcattgtggctatttggatcatctctccttcttctttattagtctagctagtggtctatgtattaatttttttttcaaaaaacccactcctgccttcactgatcttttgaataggttttcatatctcagtttctttcagtgcaggtctgatttcggttatttcttgtcttttcctagcttttgtgcttggtttgttcttgcttctctagttcttttaattgtgatgttaggttgttaaattgagttctttctaacattttgatgtgggcatttagtgctataaatgtgtcccagaaattctgtgtcccagaaattctggcatgttatatctttgttctcattcatttcaaagaacttcttgatttctgccttagtttcattatttactgcaaagtcattcaggagcatgttgtttcatttccatctaattgtatggttttgagcaattttcttagtcttgaattctattttattgtgctgtggtccctgagagtggttggtatgacagggggttcttttgcatttgctgaggattgttttatatctgattatgtagttgattttagagtatatgacaagtgtagaagagaagaatgtatattctgttgttttggggtggagagttctttagatgtctatcagatccatttggtcaactgctgaatatctttcaagtcctgaatatctttgttaattttctgactcaatgatctgtctaatgctatcagtgaggtgttgaagtttcccactattattttgtgggaatctaagtctctttgaatgtctccaaaaacttgatttaggaatctgggtgctcctatgttgggtgcatgtatatttattatagttagttcttcttgtttaattgaaccctttactattatttaatgcccttcttttttttttatctttgttgatttaacgtctgttttgtttgaaattagaattataacccctgcatttttctttgtttctcttgcttggtagatttttctccatccctttattttgagccagttactgtgattgcatgtgaaatgggtttcctgaagacagcataccattggatcttgcttctttacccacttgccactctgtgccttttaactaaaggcatttagcccatttacattcaaggttagtattgatatgtgtggacacacacagtcctacaccagagccctgccctactgctaacactgctacgagtacagatgtgcaaacagttgctatcaggtcctttgccccccagatcatactgccactgttgctgcggccaacacctgtacagaggccagcaccctggcacccactagcaccccacagcagctaaatgcatgtactccaccgtgctgctgctgctactgcttctggcacatgcaaatgagtatggatcccactgccactgccctgcaaagtgctttggctggcaccacccttcagagtgttgtgaccagtggtccaggagcacttcaccgcctccagcacagcaggtccctaaccttgaggaaccagaaatcaaagctataacctaatatcaatggctccccaatcagatttagaaaatccagtccaggagtcctgatctgagccttggcacccttaaatcttccagtaatgaagccagttgactgaacccaccttatatcacaatcaaacccccaaggtcatcaaataggataaaagaaaaaaaatccaaagggcagcaactttaactactgaaggaacatcagcccacaaagatgagaaaaaaacagcacaagaactctgacaactcaaaaaactagagtgtgtttcctccaaatgactgcactagttgtccaacaaggattcttaactgggctgagattgctgaaatgacagaaatagaattcagagagtgaacaggaatgaagatcatcaaggttcaggtaaacattgaaaccgaatataaagaagcaaagtcaacattatagatgcggacagataaaatagccagtatagaaaaagaatataaccaatctgataaagctgaaaaacacactataataattttatattgcatttgcaagtattaacaccagaatagaccatgctgaggaaagaatctcagagcttgaagactgtttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaatttaaaaaaaaatgaaaagggccaaacaaaacctccaaaaaatatgggattagataaggagactgaatctacaactcaatggtgtccctcaaagagacggggagaataaaagcaacttggaaaatatatttcaagatatgatccatgagaacttccctgatctagctcaagaggccaacaatcaaattcaggaaatgcagagaactcccacaaaatatttcacaagaagattatactcaagacacatcatcatcagattctccaaggtcaaaatgaaaaaataaatgttaaaagcagctatagagaaaggacaggtaacctacaaagggaagcccattagattagcagtggacacctcagcagaaactctatgagccagaagagattggggcctcatattcaacattcttaaagaaaagaactcccaaccaagagttccatatccagctaatctaagcttcgtaagcaaaggaaaaataagatcctttccagacaagcaagttctgagggaattcattacctctagacctgccttacaagagttcccgaaagaagcactaaatatggaaaggaaagacaattgctagtcactacaaaacacacttgtatatttagaccacacaaacaagttggcataataaacaactgaaaacatgatgacaataaaaccaccacacaagcaaggtggcaggagatggagagagtgaagggggaactgccaaacacttttaaaaccatcaggttttgtgagaactcactcactgtcatgagaacagcatggtggaaactgtccttatgatcccatcacctccccaccaggttcctcccttgacatcttgtgattacaattccagatgagacttgagtggggacataaagccaaaccatatcaattgcatatgatattcctaggtatagtttttttgtttggtttggtttgttatctgtcctgctttgtgttctctgtactttctggatatgtagtttgatatctgacattaacttgaggacaatgcccaggcattattgcctcatacactttttctgcccctttctgtctttcttctccttttgctattcttattctgtgtatattatatattttatagttttcccacagttcttagatattttgttctgatattattttcagtatatttctctctttatttttcagtttgagaattttccattgttgtattctcaagttcagagattctttcctcaggtgtgtcccgtctactactaaaaccatgaaagtctcattattcatttctttacaatgcctttgatctctagcatttctttattagaatttctatccctctgcttacattgtcaatctctttttgcttgttatttactttttccattaaaggccatagaaaaataatcatagtttttaggcgttcttggccggataattccaaacttactgccatatctgactcttgttctgacaattgttcagtctcttcaaacttgtgtttttgcattctagtatgccttgtaactttctgttggaaggcagacatgaggtactaaatgtaactgtagtaaataggctattaataatgtagtgggaagatataaggggagggtaacttttttccagtcctattattagatctcaggcttttggtgagcttctgcttctggtctacaatctcgcagatccctcctctgtttcaggtgaggcagaatgactggaaggaactggaattgtgtatttcccttctactccatggaagaatagacagagcttgagttgagtattttccttctcgccaaatatgttaggctctgatataacaccagcaatttaggctctggtaaaagaatttctcctgaggactggccttgttaaaaaggacagtaaatatatggtgaagtatttcaaaataggtcctgcaccatgactgggttcccctagagtttatcttttagtttccccccacttctggcacccagcaattcatcaattaattatcagcttaggattttccacctcagtgttacttgtccccattgaggtttctactcatggatatctgcttcagtaatttgtggttctctatatccacctatctggctctctaatgttggggacagcagtttgccctgtgacatctcttctctaaaaaatctaagaagcattgttgactcttcaatttgtttacctttttacttggtaagacataataaagacttttgagctccttaaatgctgggctggaagcagtatttttaaaaatggcactgttgctaggaaagaccaattaaatcttaatgtttaatgattgtagtaagaatgcagcttgttttctaaaagtaagcaacacaaaatattctgagacatgtcattttcttttgtttaaaataaatttttaaattatttttttctgcgaaggggtttgaaataatagttttgtattgtgttttcagttggctatataaacttttaaaaatagataaaatttgacttggctttatttaaatagatttttgttagtagcatttgctctggcaaatcagttggttatgctagcagttctgcttacttttatcaagtcaaaatgatgcatcagctgaaatttaaggctagagtcagtcaaactgccatctcaaaactagtctttaacatctggtttgataccttcttaacatggtatcttttagatggatggtgttacaggaaaatcctcatagcaaaggcagcattcctggacatctgcagcctttttagaatcaacagaaatgctctggtgaagtagctgtgacatttacctcagcaaatactgaaattatgctaactgtaaaatgcacttcctcttcctactgcaactgctcttttgggaaaatttactatcacaatggccccagactaacattcttactcagatgctcacattttatcctgagtgttcaaacacctctctgcctttccagaaaggaatgaaaggagtgcagttgtttttcacaggtgggcatttactcttcagctttcctaactgtatgaggtacaagctttctttgtgtcaatctatacatgagatttgtgtcagtcttttcagtttatcacttttcaaccagtttaggattatgagctttacttttacacacataccaaccaaggcaaaggaatattgggaatcacagcaagagcattgctctcttctaacaaatcatccttgacatatctactcttaatcttttaaaatcatctttatatatccctttttaaattaaccatctaactgcttctagatctcctactatgaaatgtctaatggttgtctatttcatatttacttagtgtattatgctcatgatttctttgcgcatcaattgaaatgtcaaatttatcatcatattacccatacagttgctaaaaacatttcagacagatgcagcatttttaaaaatattgttttctgctatataaataaagatgtttagttaaaaaagtcctctttaggttaaaaagactatattgtgtagaaataatgtagagtccttacaggaagtaaatgacattccacagagtaagtatctcagggtcctgtctttgatatgattgctaagaaaactcttagacctttcattctgaaattgtttttagaatacccttgcttatgacataagaattagttgctttatttatagtgttaaagaaaaaaaaatcagtgatacatgttaaaacattgtatggaagactttcttcaggacctttgctatagctttagggttcactgcaatgggatattgtagtagggaagagatattgggatcaactcagaatacatcatgggcaagtagaaatttatagccatggagcagagtgaggctcagtaggtgaaaaattagtaaaaggaaacatcagggtaaggagattctagctaaaccatcctaagaagattctgctgaagacaggccaaggtgatcagacatcccttgccggatgatgaagaatgaggaacccagtgagctattttgggtcattggacattaagaatgggagcttcttgctaaactgacttaacagggttctttgctaaaactggattttataaagaagttcatagatgtgcctaggtgaaggttcgaaagccttgggaaagtttgatcagagaatatttgtcaatagctattcctgcttttagaacaattacaaaaatagtatataacttatgcattattttacttaaaataccgtgacatttttcaaaaagaaagactatcctaatgtgagaattgttattaataaggatattccgaaggaacaatataacatctgaaggcaatttcaaaagaggaacttgaaacattcaagcaaatttaaaataaagtgactattttaaaaatggaacagcaatttatatgtacatatttgagaatattcatataaaaagaagttgttttaaattttcattctatagaaaactatgtgcttcctagacatggtcacaacactcatatgggaagtaaagatggtaagaaacattctaatgaaaatgataatgctttttatgaaaaatttcacattttatgttagctttctcaggaaggatagaaaatctgaatgataaagacaaatagttaaagtaaaagttcaaatactattgtattacagtctaagatgttgttattactggcattgattccctagttattaagtgtcagagtaaataaatctttgtttttataaaatccttataaggaaatgaaataaatgtgagtactgaatttttatttcatagaaaactgagggtaaactagttcctttatttttagtttatctgataatagacagttaaaataatattctttacaagataattatgtaaatatattacaaataaatcatctacattatgttgactgaactttagttttatttcagataatttttatatttaatactgttttcactaatgctattcaatagctttcaggtagtagtttgctaattaatatttgaagtaaaatattaaaacccattaataataatagaggtaatgtcctagagttttactgtttgttcttttagaggcttattagtattttttcagactcgtatattatattcagttttcagtttgcaccatattttcaggtgatgtttcttttatttaactaaattcatccatatctaattctcatacatttttagtcacagctgagctaccctgcttatgtattaagaaggttgaattataattatgatttctttaaagtgtccttgaaacttcacccagtctagaatgaattttgaattttaaaatgttagttttgtgagcgggtgtcacttttgttttaaatagtagcgtagacctttcttcacttgtttcaaacacaacgtggccaggatgctgatacattcggaaaaaaaaaaaactatggatataaatatgcaaaaattttatttttagaagggtagatttagatattaatataaataatttatattatttttaaacttcactggctctatgaagcatagttctcttggttcctaaaattcattctttttctttccttttaaatgagtctgtctatataacacacacatacacacacacacacacacacacaacatatatttatatataaaaatttaacaagtaacttatatacatataactgtgtagtatttcaaaacagagtccataaatcatgaaaaaaaaactccatacacagttgttaatgaattaaaaccatgagtcatttctcagtgaagtagttatttcttattctaaaatttgataaaattggctaaatacagacatacactcacaggtacacacatacattttctgtgactatactttgagagcctggtttcctagttacttttgcatactattgtaccttacattttggtaatccaaatgtgagtaagccatgattgtgccactgcattccagcccgtgtggcagagtgacggcatgtctctaaaaacaaacaaacaaacttatcttaatgcaaaagaaattggatacattttcatgattaatttgaatgtttccttcagctattctataataactttatgcaaagttcatactgtcagaattaagaaagatgtattattgattttttttctgaagatacatcttcaatattatattttttataatctagtgttccattgccattgtaccttcatcacttgattcagtcacttcattcatttcttcaaatatttatagagcaaatgggtagaaaactagctgtgcctgctagagctttggcatcagttattattttcttttttaatctttagcataatagagagccatgttttctatcttaagagtaacagagctttataagtgagttaataaagtaagagttgatatgatcaagattgagatttaggaaaatcatcctgtctcagtgtagtgaacagattgaaaaggacagtggtggatgtgagaagttgttagagtgttgcaagaatgcaggagtggttaagagaatggcatactggagagtggccaagtaacctgtgtccaaaaaaattaatttaaatttaaaatatatggtgatcattggcatattttctcagatttatttcactaaggaatctagtgggctaattagaaaataagggaatgaaattatgaataaaattctttgattaattctgttgtgaagggaagagagaaagtatggcaactactgtggaaagtatgttaactagaggaaagaaaaataagacctgaaaggcttgaacatgtttaaatgttgtcagtaaaaagggaggggtaaaaaaagaaagaaataattatataagattcctgtaagtaatgtaagaatgtgatggaatttaaagcagaaaatgaaggattcgctgtggcttgtagggtaacaaacagaaggagaagaggagagattttgacagatggtctttgacataagaaggttttggattgatttttgagtgtgtttccataaatggttttatttttctctgtaaagtaaaacccaggtcaactactaaaagtgagttgagtccacagaaagttttgagtgtcaggaaaggagcaatttgaaattgacgttgtagagaataagttgaaagagatactaagctttctgggcagggttgaacatgtgcttcagtttcactcttgttagtaccactttttccagcaatgctgtgctgcttcagattcagaagacattgatagttgagttactccagggctggggttgggttaaacagttcaaaggaaagagagagtttagtgagtttaagatattggcaaaagtaatattgagatttatatcatggaaaaatcatctgaacatggtataatataaaaaaggagaaaaatctaatgaattgtaagactgtaggtctttaatgcgcatgaggctccagtgggattggaaaatattaccggtaaagaaactgaataaacaaagtggggagaaaaaagagtctaaaatcatagagcaggaaagttgagtaattcattttgaaagtaaagtaaattcaggtgttgaaaatagtgttatgtgaccatgattggctgaagcactaaaaaaagtgttggtaatgattttgaatgactgacaagtcactctgagtcctgtgtgaagggcactctgtgtgaaggactctgagtgacttgtcagtttcaagctggtgaaagagaaacagaggtaggctggaaatgacttgtactgactttcaggaaataaatttacagaaattttatgatttggctgacataatacctgtagcttgaaatcattaatagtggatataaaatcagcaagtaccacaagtaaaaataaagcaaataaaaattggcaaacactacaaatcagggcaagtctcccttttccagagagacaactgttaaacatttactagttcatcactgaggagaagcaaacatctgtatccaggaaatgaatagaagactgtagtaaaataaatcaggtagtaatattgaatggttcgaaccttaaaagaacagggttttgtaccttcgcttcctttcaagaggagtgtggaatgtgtgatttagaagtaggaaagaaacaaggatacatttcccattcttgatgtatgtggagtgtgaaatacatttttcattaatgtattaaagctgtactcaaaattaaatagaatttaaaattatttatgtagagcaataatgtggctatccttctattttgctttaaagctgggtcaggtatatatacatatatttttcttattgaatgaagccatgaacagaatatgagaaaaataagtacaagtctagttattcttaattaaactgatttgatcattacaaattatatgactgtattaaattatcacatgtgccatgatatatatatatattatttataaataaaaataaaaaacaaaaataaataaatattaatggatatatagaccatctccactgaaaaatatcttggaatttatatagtctaatccgtttattccacaattgaacaaattgacttctagagagataaacttactcactacagatcatttagctttgtaatgttagagctgaaagtaatatgcctgtcttctaaactccagcatgataggaataatttcattgtatgcatctagtcattcatttatccatttttttctaatttattcaataagtatctattgatatctatgatatactagacactgttccagatacaagagctataaggataggggaaaatccttgcattaatggaggttttcttctagtaggaagagagagaaattgaacagataaataagtataaagaggaaatacataatatactacctagtcattaagaggtatgaatacaaataaaatagacggaggataaggtatatatatggtgagtcgagggttttaattttaaatagggtaaatattagaaattctctggaaaaaggaatgtatcagcaaacatcaagaggaagtggagaagcgaggcacatggatatgcagggaaaatgcattccagctagagaaaacagcatagtcaaagaccctctattaaattgtacccctaattaaaatgtgctgtaaattaatgattaatataatcatcaactactttatacatactcatattgtgatatgttttaattctcagtgtacttgtaatgcattataagactttaagctttgccaggacaggggtcatgttttgtttttggtaaatctacgcacacacagtgcgtggcatggttatttataccaagctggtggtcaatatatattagaatgatagatcaaatgattgaatgaataatctagtgaattattaaatagaataagttgagttttaaactaaaacttttgtgcctctaagtctcctcacctgaaaaggcctggcgttaagggccatgttggttaaagctcctacctcagcaaaagctcagggtgctttttctattcttgcttactagggtgattaaataacaatagaggggaaaacaagtttccttatccttaaaaaattaagaattattttaatggtaaaggcatatacatatacacttacatatatatatatatatatatatatatatatatatatatatatatgaagacagtaggtatatgctacagtcatctcatgtacaagtactgtgtttctcttttgattgattatgtaaaacaagcaacgagaataaattctgattatctttacagagctttatggactgtcaaaatggctttagatgagttttctcatttatttatcacaatacttccacgatattgttaaagaagctttttattacattaggtagggaaaagaaattatggcttatccaaggtccttcattgacccagtgtggtaaagtttcttaattgtatttcagtttgtccacatgacagtaaaatatattcttgatggctattatttataagaaaagaaaatatttgatcaggaaagttgaagacatctcatttaaaagataatatgcaatgaaccttcattatgagatacttggaatggtacacaatgaactatcaaatgctgtttcaactacctaaaaaggataactgtctttaactgcaccaaatgatactaaacttgctgcctatcctattatgcttagtcactctgatttcttttattcctctattaactcacactaacactgagaagagcaattctctctgtttcattgtccttcccttcaaatatcctgttttaagagattacagatgccttgagataacactgccagaattatcccaaggctgacaggtttactaacaactgaatgcttttcagatcactgcactggactcagatccacctttgatatgaaccacatatggcttcagtcttgtttccctgaattaactctaatttcctagtgaccaaggtcagatgagtccagatagggctcagctgttcttacctagcacatatgttccagtattgttggtaatttatttctgtaataaaaaattaaaatggaaatctcagccagaatctcttttaccaagggagaccttgctatgagcattagggcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggaggtaaaacttttatttataaatgtctgtttattaattcaagagaaatagaatttgttaacaataaagtctttttcagattacttcaagatattttgggtgttgtaccacctgattaactttttaaggtgtctgagctgaagtcaacatttctaatattatgtataacaaaacatattacaatatagtattcaattttctttgcatggtggatgtgttgttgttatgacatttaaaacaaaattaatgttaaaggttttaaatttcattcatggagaaacctttcctgtagaacatacttaaaaagttaattctaaatccttgctttaggaggttacacaaatattgataatgttattttcttatcacttttagacagtcaggttcataaaagcaagttcaatgagcataagatggtttctaaattttaatttatttttgacagcaaacaaaatgaacaaaggtgaggaatccatttgtgtacctaagatatctttaaaaagaagatacctttatatttgtcaaatatgttgctcccagtaaaagaaaagaagatctatgcaagtggttcaagagtaaaccttaccttattagcttttcataatattttcgaagaaatttaaaacaaaattgcaaagcactattcttacactgatattttaccagttcactaaaacattcagaaaagaaatttaccctaaaatttgttagtcatttgagacttgcaaagagccaaataatttccaggttgcaaactttatttagtgttctagcagaaactaaactaaaatgtctataagttttaaattgttagatgtgtgtttaaaatattttaaatatttacattgtatgctctttttaatacacaaaatcatttggcaattgtgaattttaaaagggggtgtatttcttattcctttaaagtttatttttgacaaaaatacattattttgttgatgtttcacaatccatgaaaactgctattataagcagatagtgtcttctgaactgattttattggtttgtgctgatgtagaaaaaaacaaatcggcttacaagcctcggcatttttataaaataaacattgctaaacattgacatcccaaatccatctaatataacatagaaaaataagtttctttaaggaaaggaggaataaaatagaaatacattctagtatttttagtggcagataggataagtttagtgggaaaataagatgatttacgaaaacttaaaaatgcatttttcttacagtgctttttttaagatatgcatttcatgcaatatctctgagacattatttaattgattctcttggctttatctggctaattactctgtataatataactataaggataataattaagaaatcgttttttttatttttgtcaggtaagttataatctttttatgttttatgtaattaaaattcttttgcaaaatcatgatgccatgaattttatctattttcacttttttttaaggcaaggagctttggttctctcaactgtgtaggaaagaaaaatattttaactatttcttatcttttacttggctaccctcaaggtgagctctttatgatcctctaatttgttgttacctcaattatttgctaatagaaaattattttatgatgtgcttagcttactacctgtcttttattttatatatttctcttaggtactacattcttttggagagtatttcctaataaatttggcagcagctatggacagggcaaggatgtgtctcaattcctgagtctttcctggtgttctgtctcagtcttcactttctctcatcacagtggccagaggaccttcaaagactgtggacattttggctgatcagcttagtccttatgtttgattttaatcaggtcccttggcaatgatcagtatctacttcactgaaagacactagccattgttacaggtgatggagcaaaatgtatttacaggtggctccttcaacatgccggttgttttccacgtataatctttagtttatactgcaactttatatttcctttcttctatgtcaatttgcatacaactttcatattcaacatagaaatatttgattaatttcatttttacctcatcactgatcctaagtgcatttttattccttttctttaacttgtacagctcccatttattgatttttacgtttcaagttcctataatctatttaactttgagaatgttcaacaactttttgctttattaaaaataaatctagctaagtcttcttattttccccttacacaatatattttacagtggaagtatgaccccatgggtgtttaatataaatattttcaaaccagaggtcaagccaatggcagtgttctaaatcctcgtttattctactcaggacccaccttattaggaacattgccttattttttttcagcttcactgaggtacagttgacctcaataaaataataaaaactgtatatatttacagtgttggagagtctttcctaataaatttgacagcagctatgcacagagccaggctgagtctcaattcctgcgtctttcctggtatcttatctgtatctacatacatatatataaagttatcataatcagtttaattaacatatccattatcctgtatttttgtgtatgtggtgagaatatttaagatctattctcttagcaactttcaagtataaatttgcagtataattatgtgtagtcactatgttaaatgacataagctaggcacagaaaaacaaatgctgcatgatctcacttacacatggaatgtaaaacaagttgaactcatagaagcagggagtagaatagtagttaccaggggtttgaggggatgaaatggggagatgttagccaaaggaactttgcattattgattgttctttctttttctgacattttaaacctctcctttcttttgaaacatccgccattggcatttaaacatgctcaaatctcttcaatcttttaaaatcttacttaaaccaaaatattcttctatctgctattctggatctgctcatcttcagggttgtactttttattttattttttttttctttttggcacttactgctaccagtttactttcctcaaatcctttcttaatccactttgatgtgacttctaagagcttcactcccctcaattagcccttgctaaaataaccaagaaactctctgttgccatatccaaaggaaattattcagttttcattgtttgtagttttctagcaaaatcactacaagggaccacttcctcactcaactttctcttgccttaatttatgcagtacttagattttcttccttctctgtttactctttttacgtttcagcctcctatgccagctggtgaaattcaaaattccacaagccttaatcctaggactcatcttatcttcctctcctgtctttttccacatctatccacgacttggtcaattgtatctaatatggcattcaaaatctacatttttagctttgatatcccctctgaactccagacttaatgtctaacttcatattacagatccatttgaatgttcctcatgggtccccaactcactaggtataatctttctcccctaaaatttgatcttctttcagttttttcctctgtcagtaatgctcaagtgtaaaccagaaaccaaggacttgttcaacctaaacctcttctttttatatttcaataattaccaagtattatgcattacacacacacacacacacacacacacacacacacacacacacacacacacaccccctttgagtttctggatgtctttccatctccaacaccatttccagagtccaagtactgtttccttagactgatgctatgtgcttctaaatggtctttttacatccattgtagtcttagtgatctcttcaaaatgcaaatctgatttcatcatccatagacaatctgcttcataattgccttcacttctcactgctcctatgattaaggcatattttgttcttgcatgttaactatttatgaaacctggaccctggtcagtgtctaaaattgtgcctattacatgaaagtaattcaatacacatattttacttatttatttttattttaaaaatttttaataatttcaacttattttagattcaggagatacatgtgcagttttgttacatgggtacattatgtgatgctgaggtttgaggtacagttgatcatgtcacctaggtagtgagcatagtctgcaatatgttttcaaccgttgcccccatcatcttcctcccttggtaatcccccgtgtctattgttgctatctttatgtccgtgaatactcaatgtttagctctcatttatatctgagaacgtgcaatatttggttttctgttcctgtgttaattcacttaggataatggcctccatccagctgcatccatgttgctgtaaaggacatgattttgttcttttttatgactgtgtagtattctatggtgatacacgtattttaaataaaagagtaacttggctctgtgaaagcagaagttgcactgggaaaagttaaaccaacaaggaagacttttctattccaaaaaggaagagagagatcagaagtcaatctctgaactgggctgaaactctggagagttttaaaggatggtttgggagtttttaagggtgaaagagcttttaacaacaattgggtgggtatgggggattatgaccatatgtgtttgctaattgggattatccaagggaaatataaactttctcatatcttcgtcacagaaagtagttttacaacttggaagaagggaccctctgtctgaagttaggtttctacctttccacagagactggaagatagagatgcctccttccttgatgattacctttcaaagggttgggtccaggccctttagaaagacagtctggtgttgaaaaactgccaagagcctttcaaaaagatttacatttaaaagggacaaataaagaatttacaattacaagaattcggcagtaaattatctacgagaggggagggaaaataccttgatgcttaggctatctgaatcatataagggactgagtgagcttaagatggggcctggaggtcagaaggagcctgcctaaagtttaaaaagctgagggaaggcttcaggtcaccttcattactccttatttattttgctatcattttctagcactctgttccttagctcatggtgccccagccaaagaatactttcttcaattatccctcccatcgagttcatatccaaggtagcatctcttgagtgctttctctcatattagagagttcttgatgttgtaaatgcaagagaatgcattttgagtttttgttttgttgcatttgtaaaatatttcttaccactttgaggatcatttatgccattctgtttgctttagtctttatattttcagttggaggctctcctcaagtatctggttatccttggctgtttgatcatatttaatagattttaaaaggctcactgcaaactctaggtgcttactcaaagctgaaaaactgagtttcactgtggggtatatagtgggtaatttagttagaaaatccatgaaatgtatatttagatagagttggtgtagtgcactgattaagattatgaaacttgtaggaaatcttcccatgtttgagtcctggttttgccactaagtagccatataattttaggcaaatcattaacatcattgtgttttggttttcttgtttataaaaggggtacaaaaatacctacatatttttataaaaattaaaaattttagtatttgtaaataatttggaatagcatctagcacatgctaaaatttatatatgtgtaaacttttattattactattaatatttattttgcttgaaaaaaattctattattctttctggaggaagtatatgaatcaagacagacataaggctgactggtctcaacagtggttatggatttcaacttatttcttctggttttaatatggtcttccctggttcaactgtccagcatgctcttgcttcctctccagagaataaaacctctagtacctgcttgagtgggttgggggagtcatcatgctattcggagataggctgtaacaatgtaactgtttttaaaacatcccttcaataaattctactttttttaaacccatgtttattttggctttgaaagggatctagaactgactatctctggacatttgtggagtgagggtgtattctaaagttacctatttcctggtaggtgaccagcagataatcatatttcttaaactgagctttcatatttattatgagaactaaaacagtttgggtgacttttctatctaaatatattttgccattaaaataatagaaatgcttaaagaaatgaaaaatcagtgctggaaagtatttcaagaattttaagtgagtttatgttttgtaaaattcttgttacaccaattaactgttagtattgtagatcagatatttcaaatgtgaaataatatgatagttcttagtaatttaacatgaaactatatacatttgtaaaggatacagtagcaacatgtcttaaagttggttggttttcagttgtgattaaaaaaaaatgtttgatgtgtttatcacatggattacagtaaaatattcacaatgaatggatttgtgtactattataaaatataattatcttggccaggcatggtggctcatgcttgtaatcctagcactttgggaagatgaggcaggcatgttcagtgtttcactggggagcaaaggtttgcatttctacccggtcttagccctgattctgtccttgtctttatagagcactcattgtacctttttctttttcctagtaaatcataaggtacttatttccattttatcattgaaacagtgccaggatttttctctgtaatattgtgggcctgccttgtagtggaagtagtagtaatatcacatttatttccttgcacatgtagaaataaaagcacacttaaactgtaaaaaatattccatatctatttgcttgaaaagagttttaactttttatgataatacaagcagtatgatgaatatccttcctgtgtttgtaacttcaggattatttttggtatttgtataatataataattaaatgatgataagggtttcacagatgaactttcaaggagcagatgctaacgtttttcctgtttatgttttaccagggccttctgaacaaaacctattttcttcttttagtaataaaattctagtaaagccctcctgagaattttcagttggatataaacactattcaattgtattggtccaggaatctttagttatttagtaggcctgaataatagatttctgaagtccagcttaaagaagtactgaggtgatcaaattgtttctcagtggaaatgtagacatctttatttgtaacatccttatttgtaacacattctgctcgtctcttcaacccatacattttttgtgtatccctgggggttaatgtagcatctgtgttacgttaacccaagttgggggaaaacaaacaaactcttggagtcttacagtgtcaatctgagtgcagtatttctctcttccacgtttgttgtaaagaaatattgacaaatatgaaatactcaggtaagagacaagcacaaagaacttccttataaatcatttgttttctgttgtatgtatagctttcagtgatttactgggatgtgattttaaacatgaagatttttaaaaatatatttgttaaataaatctatactatacctagaaatatgacgagaaattgctatgagacagtcattatacagattcagacttttttggtatatatatatatatatatattccttaaaaattatattaagatggtacaagtaaagtaaatgtagttcattgtgtctaagcattataggagcacatggaaactaaagaataactttctcgtgaccaacttatatttattttcttcagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggtaggttatatgtcagctctttgttctttgttcattaatctgagttgctgtaagacaggggaaaaatagtgtgtccacgtatgccattaggaattttgtttttaccaaatgcatcctgctacctctctgattgtataaaagcaggttatcattttggacatattcttctgaatagataagtcaaaaataggaaaaaataatttctatcaaaatggtcagtagatatttttactgtatcagtgttgaaaaacacacagtataacccagctaaccttctcttttcaatcttaaattcaaaaaatgttttatgagtacactaaagtttttgtaacaatttacttttttaaatttgtggcttacaaatatagtatttgacttagagagttaacgaaaataagtgaggcataaatggctctcatgaatattatcagaattgttttacttaaaagaaggtagaaatagaagactatttaccaatgacatatctagaatatttaacactaaggattatttttaacatcccccttctttcatatggcaaatcatttttagtcaaaataatcaaatgagataatgaattgtaatttccagaaaaccataataaaactcttgattatatatatacaaacatgtatgaatatgtatatgatggtgccgtaagtaaacacacacacacacacacacacacacacacatatatatataaaacattacagtacatgtgtacatgtagtggacagaataatggcttcccagagatgtccatgtcttaatccccagaacctttgaatatgttactttatagcaatatactttgaatatagcatatgctttgaatatgtatcatagcaaaagatactttgcagatgcgattaagttaaggatcttgagatggggagattttcctggattaaccaggtgcgtccaatgtaatcacaagagctcttgtaaaagggagagtgtagggttgagtcatagttacgatgtgattatgacagggatgtgaaagaagtagagagagggagagagaaagagaaagaagagagaggagagagatttgtagatattattttttggtattgaagatgtaagaagaagccatgagccaagaaatgccaggtgacctttagaagaaatacagtccttcagagacatcacttttaggacttctgacatatagaactgtgagataataaattttatattggtttaagtcactaagttgatggtaatattttagagtagcaacaggaaactaattgtacagagggaaaaaagtcatagcatattttaattacatcaatgtactttttgaaagaaaagggaaaacatattcatgatttatcacagtaatatctaataatgctgtacatgctttggacctttacttttgcaaatttgtcaatgacttggttaaaaccgatcattgatttctggcaactctgaaaagtctaggaagtccaataattttctaccaaaaaatttaatattaaataaataatattacatttggaaaatcatctgaaatgtattatggtttaaaaaaagctcgaattagttttgacaaaattttgagatactaattcttgcatttatgtagtagagtcataataaagaataattgtgcagtcattattgaaatgaaaaaaaacaaacgagttcttactcccaaaataggcaagtgtagctgagtccacataattgaggggttaatggtgtaattggaattgtccaattttatttccaggtagaatacaatacttattaaagaattaaatataaatatttgctaatttgaaaaagtcaataaaagctcagttgttaaaactcaacaataattgtttagaacttagaccaacaaaagatattttggaggaggaatattttatattttacatgttttagacttcccagtgcataatgatactggatgccactgtttttaaattctccacagaaaatataccccctttattacctgcaccagggaaaggcttcctcaagctttgtccctgttattccaatattatgtacaaattcaaaattgggcaattaattttaatatactataaatgtattaaaatgattgtgttttcacaattatattgctgagaaacatttttttacttctcaaaatgtgttaaattatacctttatcgccagtaaggctttggtttattgccctagctctgtgtgatgggagtgctcaaatcttggcattctgcatagttaggtcagttatggttctttccctcaataagaaatgcatactgaacccagaaacttcatgagttaatgcaccagttatttggaatttgtgatgcacaacttctttgataatttttgaaatatgttttttcctaggaaaaatcatatactcttaaaagaagaggctgataatgtgctatgaatatcatcatgcagtattctgcacactgatattctgaacttattcttgtcactactgtgctcttggacaagtaacttgaaatttatggcctctaattttttaaactagtaaaagaagaggattgtatatctcaggtccatttaaatgctaaataatttggcaaataatgtgcttgatagattctcagagtttcgtctaagttaggctagactacatggagaaatatggttagctgatgtcttagaatacattcaaaaaatcaggcacactcttaaagtagttatgagaggtggaagcaggggtctgttaggctgccattatcctatagtttcatttgggaagagctgaaataaattaacccatgttttagtatcatttctgaaaggagtgagactcatatattactaccattttctccgggtttgcatcgtctggatgagactcatatattgctatcactctctcctggtttccattgtctggataagggcagagatatttatttgtctctcttttgctgttcattgtttcagccactatcataatctgcatttctcaactgggaaattagcatttgccttttatgttaccattgctgaagcatactgaaaatgataatagtgtgttaatatatttacttacttacttactttaaaaattgtacttaattataaacaacaacaaaaaaaaggaattcattaaggtgtgaaaaatattccttgaggttcttgctctttctcagcaagagttaatgagaatagctatattcaaagcagagcaatatgggctaaggttctgaaaaactcagattacttccagaagttccccaggctttttaatttatatattcaggagctataatccatagtgaaaatttcacctttagtaatatcctatatgtgatcaaagaggggaacttccttttctttgcttttattattgctcagattttgaggtattttcaagaaagcctatgtggtttgatgaggagattaaaacgggaaatattatgagtctttttgagtgggaaatcagaaaaaaaattaaaaattgtgcatatatccacccctgccccattttcccccaaattcatatattatcttcttagcctgccatgcctccttctaattgattcatttaggggcctccccatcaccattcatcactctgagtgtgatcattactgcccaaagtgtgctgtgagatcgctgaatgactcagaataagctatttaattaaggaacctctgtttacacaaaaatagcttagtggagcaatcaacaatgatgtgaaagtaaatgctaaataagcttaagcaggtttaattaagtttggagtgacattaaattccttcatagttttcctgactgcagcaacgttattttaatgtggcatttactgtgtggtagatttttgaagttgcaggagaccttacttggtaagttaactgaacttcttatttcattcaaaacaatatttttaaaggctcggagtgagttaaaagcaaggagcaaaatcatagcagtttcattaaggaatgtctaaattgtgtgagcaggtgccgtcttgtctcttatttcaccataggtgataatctatttatctgaactgggaacatttctcctccttaatagcatttttggctgcattgcttctctcctgactgcctgtacttaaaagccttcttggtttctctttttcaaatgttgagtgcatattgcactttgaggactaggcagactcagcagtccgtgagctggtaggaaagcagcagtctagaaaaaattccattagggccagttggtattattttgctttgctttatgcaatttggtagaaatattatcaaatgactgaagggtctcattaagatgatttctatgtttagcaatgagttagtgtcctctttctttcatgtattagttcctcacaactttaacaacaagcattgtatgtggcagctgaaaaagggatggagggaattgtgctcatatttgtgcatattattaataatgtaattttctataatttcagttgtttctattttacttgtgggattaaatcaatagtgaattccagtcagtgagtgtataattatttaacagtgagtaactatttctgtgaacaaaacccaaaatgaattagtcatataatagagaattactgaaatacacactatacatgaagaatgtaaagataaagtggacatatttacaatgccctttaatatgaagattaaatttaaaaataattttagccatacacaaagctgttatatacattttctctcatatttactgatttaattagaaatattagggtatattttatttagtaattgactttaatgttacctttacaagctaatgctttaaaacaatattatctatgaatatcaaaaagcagtagtaccattaataatcctcaagtaacttttatcaaattataatgtacttacccataattagcctaaagtaaaaaatgtaacattgagtttttatggtagaagtacactactttgacatataaacaaaatgaaatttcctttttttacttctgttttctaatgttaaatgcttaagattcactctttatttttaaatttctcattatttggtgaggtaagagatgtagaattggtaccagtggaggtacgttgtttgtttgaggcagatgccaatgtttgtaaaaatagaaatcagtatgagaagaatgtcgttccctgttttattcaccatccatttctaaaattctcaatttatgatataataagtactgaaatattcatcattatagatgcataaaattgccagccttccgtttttcagctttactgaagtgaatgaatacatttgtcttcattagtttaacataatgcacaaaaattgatgcaaattattcatctttctgcaggtcagcccttccattaaaatgcattctattttccctttgcataagcagcacaattttaatatttgaagtgattttgcagggctaaatctagatctaataattttcagagactgaattaacaaataaactcaaattacacctgttcaagctgtacattcctggcatatttgttaagtctagattatatgtcactgaaaacataagcatctcaataagttatgcctgctccacagacatcattaacaggctgcatgctacaatctaggaggcttcaacagggaatttgatgaattgtgagcaccactgtgaacagccgtgattaatattgtaaatgttgaccaaatggtacccaaacaatgtagaaatggataattctcataaaacagagttctgacagattttatacacaaagattggatcatttaattcatttacttattagtccaagaccatggcttcaaattttactttagatcagttagccacagactgtcagactatgtcagatagttgtccttgggttagcagaggtgggtaagatcaatgaggagtcactcttattagaaaaaagctagtcaaatgtttgttctaaataccaaacccaaatgctttgcatttgctgaccctcatgtgacagacatattcatagcatgttgcatggagtctttggcctttgtagtcagatgacctgtgtgcaaattttagtttcacctggatgaaacctgaagaagttactgagtccctattacacttagtgtcctcatgtataagcagatataaccatgttcacataattggattgtgataaagattgagcatattatatttttagtacttgaatcagaataggtagcataaagaattttaaagaaatgttttgatcacttctaatacgaggttttagaaaattaaaaaaaaaaagtgttttgaagaaatgttctctaataattgaaagaatatgttagtggtctctatttatacatttttagaactgtcttgtctttgtatgtttagggatattaaatatatagccgagaaagcagagtattagtatgacccactgttaaccagctggaaacctgtttctaatgaaacctacctgggattttaccatcagccaatcagtatattgtaattagataactatcattttgtgggaagagagtgattgatatctactatataaagttaagaaaattcctatcataaggcattatctgaacaagcaaaatggttttccatttccaaacatgtcttgaacttttagtaacagagctcaaaatgtattaggagaagtatcatctctaaagacatgtttagtaaacaatctttttagtaaacagagctcaagatatactaggagaaaaatcatctccaaaggcctgtatattttctttacatttgaccaatctacaagaatttcattactctttctttcctgcttagctctgtaaaataatgaacataaaatataaacataaatcatctttcttttttagaagaaagataaggaaaaacaaatttgacataaaatagagaaaaatgcaatattggacataaacaaatacctgttattagtgcagggacttagatagctggagcttagtgagaccaaagcagacagaccaaattgcaaaagggacttcagcaatacttaaaggatgggtagttcactgtcttgaaaaagatatatttttttcttccaattttagggttcttaatgattaatcaggataatgatttaatataaaatggtccaactcttataattctttccttggaattttacattagatttggaaaaaagcataatagtaaggaaatcattgctgacataaccattcctaacactattctaatgattgctgatggcaaaatcataagaaaggtagggtttataggataaaattatttctattttcatacttagtgtcagagtttcatggtttaatactcaagaaatatgacagcaaatctatttcaccagtcacttttaactaatatatatgaaatatgtcagaaccagtaaaaatagttggctgtttcattacaggttgataacattttctttttcacaagttagaggatatacagaatattaataaaaggcaactgtctaatacatatactctataatttgaattcttcattgatacattttatatgccatatataagcatctccctttatgatcttaggtacctgaatattttcctgcatattctataaatattccttcaattagaatgcgtttatattatttaaaaaaattttttaaactaaacagttataatgtgtatatttatgacgtaaaagtgacattgtgatttatgaatacaataaggaatgattaaactaattagcatatcaatcacctcagatacttttttatggtgtgaacatttgaaatttattagaatttttgaaatgtacagtacactgttactaattatattcaccatgttgtgcaatagatttaaaaagaccctgttcctcttatctgagattttttaccctttgaccatcatctccccatttctctcaaccctccagcctctgctttctgtttctatcagttcaaatgtgttagatcccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggatctttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaattttatagaagtataagaaattcatgagcaaaaatgataaggatacaaaaagagtaatttcatctttaaaaatatatcaatccataacattttaatcaccaaatggtgtcagataaaagtgaaccaatctttctgatacctaataatcttttcacattgtgtatctgttcaatcagtaccttgctgaaaattttctagtggtgctctcgagctatcagataaaatactaactcctaacaatgtcatgcaatccctttcttttacctatcttaagattcctgtattagtctgttttcatgctgctgataaagacatacccaagacgggataaaaagaggtttaattggacttacatttccacatgattggggaggcctctgatttatggcgggaggtgaaagaattattacatgctggcagcaagagaaaaatgagaaaaatgcaaaagcagaaactcttgatgaaaccatcagatctcgtgagacttattcactaccacgagaacagtatggggaaccacccacatgattcaattgtctcccactggctccctcccacaatacatgggaattatgggagaacaattcaaaatgagatttgggtggggacacagagccaaaccatatcatttcctttctgaatttatcccctcttccctacatctaacctgataacaatacaaacaagttgggtttccttctgcctgagtttaccttttttcactcttcctccaattttctggttgaattctctcatccaaataaatttcttatgctgaccttttcatctctttacacacttttcctaggctgccacagaaatatatatgatctctctcttttggaaccatagcacattttcagatattcctatatagtatttggtatataatattacaatttttaaagtatctttttctccattaagatgataatatgagtgtcctaatggcaaggaccataaatgaatcaatttttacccatactgtctcactattgttgagtacataaatattacttagcgtagctgtgagatcctaagtatataatggtgaacaatataaccatgacccctgccctgctagagttctcagtgtaacaaagactacataaaatttagcaagtttttacaaataaacaaggtaatgtgttacagaattatgtgacagatgaaactataataaattagtcttcaggaaaggtaagcaaaaaagattacttctatttgataacaggcgtaagaatgataactcttcttttacttttgctacctttttcttacttctctctcttctctttccatctacattccagttttggaaaggtgtacatagaaaaggaaaaagatagtgagagcatctcaaatccattttgttcatttcttctagatttagaggataggatgaggtacaagatatcaggaccatggaagaatttagccaactataaatgacactgttcatgtagaaatgagagaagagaggttaaaaatcatctggtatcaagagaagaaaaaaaatgtactaaagacatacctaataaataattatctaataatgcaaagaacttttaaaacacaatcataataaacaaccccactaaaaaatggtccaaagatcttaacagacacctcatcaaaggaaatacacacataccaagagagcatatgacaagatgctccatatcatatgtcataaaagaaatgcaaattaaaataatgctttatttaaaaagcaatgaataaaaattgcaagagtaagttgttacctatcaataataaccttgaatgtaaattaattcttccatcaaaatacatacagtggctgcatgtatttttaaaaagatcaaattacatgttgcatataagagattctttttagctttaagagtattcataactgaaagtgaagtgatggaaaatgtattccatgcacatggtaaccaaaagtcagcagggatggctatacttagagttcaagtgaaaaacatttataggagacaaagaaggtcattatttaatgataaaggaggaaataaatcaagaggacataataattgtaaatatatatgcaccaaatattgattcacctgaatatataaagcaaatattaatggactgaaaaaagaaattaaaataatagtaaaaggcaccaataccccacttttattaataggtaaatcaaccagacagcaaattaacaagaaaatactgggcttgaactgcacttttgatattgttttgctctgtccccacccaaatctcatgtagaattgtaatccccacattttaaggagggacatggtgggaattaattggatcatgggggcagatttcccccatgctcttcttgtgatagtgagtgagtgctcacgagatctgatggttaaaaagtgtgacacttctccccacaacctgcacccactgccaccatgtgaagaaggtccttgcttccccttagtcttcttccatgattgtaagtttcctgaggcctcccagtcatgcttcctgtgaagccttcagaactatgagtcaattaaaactcttttcttcataaatttcccagtctcaagtggttctttatagcagtgtgcaaatggactattaaaactttatatggaatgaacctaacaaacatatatagaactttccattcaagaacagtagaatgtgctttcttctcaactgtccatgtaacattctccaagacagggcatagtttaggccatgaaacaaatcttaacaaattcaaaaaggttgaaattatgtatagtattgtttctgaccacaacagtatgaaactggaaatcaataacaagagaaatcttggaaaattaacaagtatgtagaaattaaacaacatgctcctgaacaactagtaggtcaaataaaaaatcaaaaggagtgttaaaaaatatattgaaacaaatgacagtagaaacataatatatcaaaacctacagaatgcagcaaaagcagttctataagggaactttatagcaacaaatgcctctacttaaaaagaacgaagatcccaaatagcctgacattatgcctcaaggagctagaaaaggaagaacaaactaaaccctaaagttagcagaagtaaataataaagatcagaacagaaatacatcaaacagagaatagaaaaaccataggaaaaaaacccaatagtcacttctttaaaaaaataaacaaaatagacaaaccttttactaggctaagggcaaaaagagaggcgactcaaaatcagaaagaaaaagaaggcattaaactgaaaactctaaagcattactgaaagagattgaagacacaataagtagaaagatatctatgttcatagattggaagaattaatattgttaaaaattttcttcctggccaggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaatatttcttcctacccaaagctatctacagttttaatgtaaactctcttaaactttcattgtaatttctcataaaaaatagaaaagcaatcctatagattatgtgaaattacaaaaaggcctaatactcaaggcaataatgagcaaaataaaataaagctagaggcatcacaatatctgatttcaaattacactgcaaatcaatagtaatcaaaatagcatggtactgcccccctcccaagaaaaaaatagacatattgaccaatggaactgtatggagggtgcagaaatgaacccacactgtatggtcaattgtcaaaactatcaagaacacccaatggaaaaaaacagttcttcaatcaacggcgttgagaaaactggatatccacaagcagaagacgtaatttggtctttttctcacaacacatacaaaaatcaactcaaaatgcattaaagaattaaaagtaaggtcagaaattgtagaagtactagaagaaaacatagggcaaaaactatacaacattgagttgggcaatatttttttagatttgaacccaaaagtgcaggcaacaaaagcaaaaatagacaaatgggattacatcaaactaaaagtttctgcaaaggaaggaaaaaaaataatagtgcgaagggacaacctagagattgtgagaaaatatttgcaagccacacactcaataaggtgttaaatcaaaactatattaagaactcagacaactgaatagcaagaaaaaattatttaaatgagtaagggacctgaatagacatttctcaaaagaaaacatacaaatgactaacagatatatgaaaaataattcaccattgttaatcattggggaaatgcaaattaaaaccacagtgacatatcacctcacactagttagaatagctgtaacaaaaaagacataatgtattggagtaatgacaagctagaagaaatgtaatattattagtagtctacttcataaaaatattttcccagaaccaaagcgagcaactagtaccaaaccactacctaatgctaggtcatatacagcatgtaatataatataattacaatatctgaataactaatgaatataaaataaaagaaacaaatgtcctttcggaggtggccagagaggatatgtcatatgaaaaaaaagcaatacccagtaagccctttagacttttaacaaaatgtatgaaggatttgggttctattaaggaagaacaaaaagcatatttttattatttttttcaaaaattggtttcatcaattttagtatacagctatatttaaagtgttcttataactcttgtcccacaaaattatcttgcaaatagacttcaaagccagttgtggaactgtgttttaatacaagcagtgtgctgtgaattcttatgaagcatatggagcaatagatgaaaaagggaacctacaaaaaatacaaattggtaagctgtgagttcacaatatgtaagttcaaaggcagaaaggagagtacatagggtcagacagaaaaatctaatgaaggggcaacatattttccacagagagaacacatgtaataacaatagtaattgttatctaaggttatcttactttacaataagtattaatagtaattattgtttctaaagccatacaaattgaatttaaaagaaaagaatttatggggacattaataagcgagagggaaaaattcttccccgacaataaatttaaacattagaaacaagttttatttaattttttctgttctttcctttaatagatagatggaagcctttactttgctaatgtataatgtgaatttgcatgagatatatttgatatgtagtattaatcaagattatttgtacaagtaatcctttacaaatcaaacagatgtacatttaccaaaaacagaagtgcatgtgggaatagccagtttgggaaatactgttgtaaagagttttagaaggagatatattataaaaagcaagaatgattttgtttctgacccttgtaattgattaaagcatacagaagcttgatttgaaagtaaagaaacatttgaaaggctgaatgagaggtttccagaatgtaagataatgcaatttcagcatgttaaatataagatacattgatttcagtatatatttttaaatataggataatgtgatttcagtatattcattattggacaatttgctgtgcaacctttaaagaaaagttatttatcaatgaataagcctccctcagaattaaaagaaatgctgactgcatttactttattagtcctatattatctagacgtaatgaaataagataaagagaaaaatgttggcatgtaaaattgagagtttgtacagggtagtaaaagggctatagaagaaataaatcaatatattgtatataatagacttaaactttaaaattaagtatttagaactacgtgcacatttcattctacaagtaaggttcctagaatgatagagaggaaagaaaggaagaaggaaaaaagggggaagggaaagaatgatagagggggaagggagagaagagcacaggagggaagtggaagttagggaaggaaggggaagggaacaaaagaatacagggccccagcacggtggctcaggcctgtaatcccagcactttgggaggccaaggcgggtggatcacgaggtcaagagattgagaccatcctggccaacgtgatgaaaccccgtctccactaaaaatacaaaaattagctgggcgtagggtgcctgtaatcccagctgctcgggaggctgaggtaggagaatcacttgaaactgggaggcggaggttgcagtgagccaagatggcaccactgcactccagcgcctgggcgacaagagcaaaactcggtctaaaaaaaaaaaaaaaaaaacggaataagaaataaaaagagagtacaggaaaggcaaaaaaagaaaaagaaaaaggaaagggaacacagaggaatgaaaaagtagggagggaaaaaaggagaaaaggagggtagagggagaaagggagggagggaggacagaaggaaggaaggaagcaaggaaagaaataaagaagaaagataagaataactcaatttaataaacccagcaagttagctctgaaatatttggtgagatttgtgtttactgtttataataatcacagtttaatctcttaaggagttttaatctatgtcttgggagagattctcatgaaatcacaatattacataaaaatatttgattaaagtttaacataaaagggacatttagagacaataactctattgttgaggaagttctggatagatacatttgtagtttttatgtgcccatccatacgctgtcattgtatgtcacttgaaactgcctctatacctcctttgagggctcatttggagcatcaggtcttatacatctgacatatgaagaggtttcactatgtaataactgtatgtactatgactgcctgcttccctccctcccttccttccttccttccttccttccttccttccttccttccttccttccttccttccttccactctctgcaagctaggacttttttttacttggtaaaagggatcttttggcaacttgtaaaaagataatttacaaacatgagttccttactgtgaatatggagaatttgtttaaattatcaaagaaagtcccactgagagcagcgatatagaaagtaccaaagattagagattgaaatgaagattcaaggcctaatttggctttaaaagtgttgggtttatcctgaattttttaaaataatttatttgtcaatgttttaaatgtgtgaattttagacaaaatatttcatatgatctgacaaaaaagtgaaaatatatggtcaccctgtgaccatatagtctcacaaggttttagtaaaactgcaactgaaggccgtctattttgagtgttgcagttttccagatatttttgtctaccttcctccactcatttatggttgtctgtcctcctaacagtttgaaaattgactctaagttacaatgatgcatgttctaatagacacatttataatttccttagtgttttctaattaaagttagaggccccttgaaaacatatacatatttcttgaaggtgaccttacagtgtgactcctgagcttctctcagttgacattcagcaacatcagttctttgtttgccaacatacagattcatgtgggagtttgaacttgggaggaactgtctctatctacataattaatgagtgttcacttcattagagttaagtgcatggctgttcatgtcacagggagaatggaagattctttcgttctttggtctcaatgtgtccttgagatttttcatctagctgaaatttcagtccacatttgacttcagctggcatatttgtagaaatacttccaaaggagcatcaaattatgtatcaaataagtaataattcatttttaattacttgtccttttaaaaaatacttaaactagatcaatgatggaaggacaagtaaaacatgtcattgatttattggcattgattatattccttatattatttcatcttgtttaaaaccttaataagcccattaactttgtacatttgattcaaatcaaatatcatttaaacattcctatgttcataaaagcaagtgtgctgaggtttgctagcaatgggaaatttgtatattcacattcaatgctggaaataggaagttcagctggcgaaaagtcaagcggtgtctcacttgctgaaaagtaggttgcttttgtttatttgtgtcttattttgttcttgagaatgtaatggagaatatagtgtttgaagatactggaatagacatcccagtgcagttggtgcatatagtgagttggcaataatattatattctttcaatagttctcaaaatgagaaatgagctctcacaaaataaatacttaagtggattaagaattttctatatttgaaagtctactttccaagtaatcacccttcacaaatcttgcttataattatatttatataaaagaaattacagtctgggcaccttggctcatgcctgtaatcccagcactttacagggcaggtggattgcttgagctcaggaggtcaaggccagctgggcaacatggtgaaaccccctctgtactaaaaatacagatgaggtggcgggcacctgtcatcccagctactcaggatgctgaggcaggagaatcacttgagcctgggaggcagaggttgcagtgagccaagatcccaccactgcactccagcctgggtgaaagagcgagactctgtctacaaagacaaacaacaacaacaacaacacacacacacacacacacacatacatacacacacaaagaaaagaaattacaactttttgataaccaggtgtggccattttcacaaacactatcaacacaagatttgttgcatatactgtttctaattcaaagaaatttgataaactatcattctgtttaaaatggagatactcttccccattaagtaagcatttattttgcagggaaaatatatcattatcagaataaaattgatctttcaactggcaccatgctagatatagcaaattaataaatactgaatagtcaagcaaaatgaccttagtttatggtgttttattacatatcacagagactcaagcaccatgttattgctcttacgttatgttaaaatgcttttagtcagttattatgctcctcagaatatgcaaacatttgctgagagcctatgatttgaaaaatgattgagaattcagatggatggatgtttcattagtgttctttagtgtttatgctaatggatgtagatattcatctgcattagatattacataagtgatatttttgttaatttgttgaccagaaacatataaaaataatgaagcacatgcatctttctatatctgttagatggatggatggatggataaatggatggatggactgattggacagacagacagataatagatagcctccatacaaaaaagcttgtaatgtatttaggaaaatagaacatatctcaacaggtaaataataataccagggaacctaggctgaatgcccagtgagtgatcaagacagaaagtagtataagttgggctaatatattgaaatctgaagtggttaaggggcagaatttacactgcaccttcatgttagattagtattttaagaagagcacaggggagaaactgagaagcagaaattcccctaatatacttaagaattcttgcataatgaaaataaaatatttgagttctaattataggaatgggcaatgcccctatttaggaaggctgtaaaaaatgtagagaagccataaacttctacagcttttaagtagagaaaagatgatgttaaacaacttttcagttgagtttggtagatcttcatttgtccaactttttaaacaggttacttacattctatggttctcgtctttctacttttacattgcctactctcactaaaagagatgtatagatgtggacacatttaaatcaaaacaaaattacaggcaatgttgaatacaagctgaaatgtttaatatttttctggaagcaggaaaacactatgggtgaatttgtacacaaaaaatggaatgtgcagtatagtgtcttaggaaaaagatcacactttagaagcaggctatttctgggtgggggaaaggaataaaaccaatcccttggaacagatatagaaaaatgcatgtgcttcaatatttttatatgtttctggtcaatgaattagcagatattacttatcatgtaatatctaatgcagatgagtatgtacctccattagcataaacaatacgttttatttatattgttgcctccactggaaaaaaacaaaataaaaccttgtctcctataaaataaattgataaaggaacaacgccccaaatgtttacaatacgtggctgtatgccccttgatttataaagtaaatcaccataatgatttttaaattatctaagtccatacaacctgtgacttctgttatgcacatcacataacagatactagtgactgcccattatctgctaagtaaaagataccattgaatacagcttattagtaattattcccttaaattactgcatttaatctttggaaacaccaatttttcacaacttttctggtctaaaaatagagatagctgttttatcagtgctctggtttcagtgtagaataaattgtagatatgaatgaaacatctttgcactctatccgttttcctttgtggattctttcttactgttttacaatgctgtaagctgagtccaccttttaggagacatattctttcttaaaacaaaattcatttaattcctcaatatctagcaaggctatccattttaatgatcttgttaaacgtctatgtgttttttccagttgtttttctcttctgaaaaaacattggcacactttgaagcattttgaaaaatctctgccctcctctcatcttgctaacctttaattatgaaatttcaggttccttgaaatacttaacataacctctcctttcttaggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggtaaatgttacttgtttcagtttaaatttaaaacaatttttgttgttacaataaaacacaaaccaaaagagtttttatgttaccaactaatgataatgcatagaactattgctctaaattgtcttatgtcattcattacataacaaaatattatattttgtgaaatttcacagaaagactcatggtcacctttatgattttttatttaattttaatatgtttaattgtagccagcttcaggaaaaatagctatttctactcttattacagacttaaaaaataaacttttgttgtttgaatttcatcgtggtatatgatgagatacagttaattaagtgagtaaaaattagaaactaatatgaaagaaaaaatactctgcagattaaaaatgaggttttatatacaatatgggttaacagtttcaagttagagagtaagtttttatctgaatagctttagtccaataaatttctagtttaagaaagatattagctttcactggagaaattacagttaattttctacattaatgagtgtgtgaaaatagtatagtttctttttgccatttaatagtattcttaatcagttctttgtttttttgtaccagagtccttctaaaaatatgtataaacttcaaaaatattgaggctattgctatattttgcatttgaatgcagtcatttgtataaatgctttttgtattatccttgaaaagtttgtcacctcattcagattctatatttctagtgctataatttcctcatttttataaatatgatgaagactaggaaaataactctttcagatgctacatgatactttttgtatgcaaattcattgctctggatatgacaaaaccaacagtttaaagtcttctagtacattatttaatcttttgtatgtaaacatctcttttgtttttgaagaaactcacaatattttagacttaactttaaccactgtggcagagtgagatgatataatctttaatatttaagaggtttatgaactttagttggtaaatacaaagagcgaaaaagaggtattttgaaaataatgccatacaggaataccaggtaaatattttttctaatattctttgaagtgtttgtacctttagaaatatttttgaaaataaaaatgctcctttatctctaataacttatgtcataattatttatccttcctggaatcagaattttggatacagtatttgtacatttttgcttgattacagtacttgacactgaggaatgttatcataaatgtatatttttataaccccattttgtctatgactgaaataacaaattaaagtttttgaagaattcagaaaataacatgatttgttttcacaacacattcaggttgttatttatgcttgcttggctaactcaaatattggttgcatttgtgtgtctaagtacactttttatgttataatcatttttaaagtgtcaaaatgaactttgaaactaaatctaaagagctaaccaaagaagaaatattaactcattaattatcatttcaggtttaatttgtcagtaaatgtggtatttaaggcattaatgtgtaatataagaatgaaaatcatagaataaatatgggttttctacttggaacctcaaataatccatatgtaataattttctttaagttatagctcagtattaaagtaaaacgaattagtctcttgatgatatgtggtattctattgtgcttacctctatgtgtcccattcatttgatttagctaggccgtatctttagtgcagttttgttttacaagtatctggttaaaacaaaaacaaatgatgcgaggatttaattttgtaacgtatcgtgcttcattgttattacgaacacgtttagttgaatttttcagatattacccagatctcttgacattctatggatctatatgatcctctaaaaattagaaaaataaaattaatgtaccttttcaaacggaaacaatgaagcattaacattgcactagaaagaaataactgagtggatattacatgagcattatagtcacttcacaatgctttgcacactgtttctacatagctgccacaaagaaatccaaattccttaggttagcagatgagaccctttcacacctgtccctgtccactgctgtagctttatcttttgctcctctccaatttgcacctttactacagccacactacattttaactctcaatttcccaagtttatactctcccttttgactggagtaaatcttgtctattattttaccttgcaaactctcacaaacattttatattaggcacttaaaatgagacattaacttgcccagaaagctttccctaatcaaaaggtataatgggtttgggcacagagcatagcttgtttctaagaagtggaagtagattttcatttcctattgcaatgaaaaaaaatgtgactcatatatctcatctttatacttagtttatttcaggtactgtcataatctaaaaacatgtatctccttttgagaaagctgggaaggtattttgctcatttcaaaccattttcagcattaagtctagatatcttcacgctgcgaacccctaagcacatctccattatcccattaacagtattgtattcttgtttgttggcttctgtgtatgggtgccttttcacatattaaattcttcttgctgttaggacaaatacctagtattttttgtttgtatctccaaggcctcaattagtgcctggtggcataatatctatctacctatctatctatttgtctatctatttacctacctacctatctacctatcatttaaattaagaatgaagttgattgcagtaactttttaagaaaagtatcataaagaaacaaattatttttctatacaattcaaaatagtaaattaaataattatggatttaatggaaatgattcattttatttattctgataaattaggttcttgggctcagttcttcatttttcttaagaaaatttaggttggtctatatgatctatatggctgtttaacacattacttaatttattaaaattagccatacgatagtcctagattttatcatacatttgagaacatacagaaattcagtttacttttacttatcataattgtgtctttaacctagatgtcttatatttcaaaaataaggtaaacacttgtgagatccattatttactcaataaatatttattgataaataagtctacaatgaattgtgttttgcccattgaaggaaagcacgaatgtattggtgactaaatagtttgtcagatatgtcagatataatatatatgaagtttagctgaatgtgaactttgtgaataaaatttataaataatgaatatctttccatattaagtcttacttttaatgatgataaaattataatatattaatttatgggtgaaaataaaatgccttttataatacatattgtaaatactagtgaaaacaaatagctcttgataatgataggctttctcataagttgttggataaagattaatatgcaaagtttcacatttttaaatgagggcaggttaaaaataaaaacagaaaataaagctgaaatatgtggaccttcaagcatttaaaaatggaaattgcattcctttcagataaccacaagatggtgtatcataatttttataaaaaatggctttaattgtgatgtaaatattaatgcctcaaggacacattgctttttatttattcaaacttttaaaatactcagaaccttttctcatctgaatgtgtctgaaaaggtaactaatcaacacatgcattttataattatttttctttttgccttatctcttctgtgattttaaagatatttctactgaagtttcactgagaaagcaatccaagaaactgttgtgtatctgagacaattatcacactttgggtgtatggatttggttgaaagatcttgtgtccctcttctaagacttacttttggctataacaagctgcttaatatactgaattttgttgttttctctgataatatttataatatgttggctttgtaagcaagaattataagatataataattttaatttttataaactttttataacatggattgtttaaaattctgcatttcttaaatatttgcatatgtctacttttaacagacatacataatttttctttttttaggttttcagcaagaacagcaacataacttctatagtttgatctctttttgtgtgttttgtatatagaaagaatatttttcccatgtatttgaaaatgtatttgcttatacaaattgtttttattgaactgtctggatataaattattgagtttcctgacataaaaaaaatcttaagatgaagccaaaagcactccatttcttattaagtgtaaattaagtaaatatgtctaagaaataaaatatatatatatataaattattgctcagatactgaatttgtgcaataggtgtcccatcttgaacacacatttttgttgtctttaaaatggttaaaatgtatttttaaatctatgtggtattgttgtttttttaggacatagtctactttggtcaatgtagctgtttctattatagaacactggcaaattttacctaagacaatctctaaataattatatttttttctggtgcactgatagttcaaaaacattttgtgagggaacatagaatgttcttcagtgtttagaggaataaccaatttggaatacagctataaatcagagtagtagaagcacaaatgaacaaaacatttcaatttgggggatgataagaagaaaatcagagggtttagtttaaacacgcaagactagggatcctattttaaaggtcatttataaggaaaacacgtagcaaagccaactaattctgtatttcatggaaacagaagaatgaaaacaggttgtttacagatagctacgtataagctgctgttaaaattttaaataattagttctaacaggagcaatgctttttagaagaatatacttttggggtaaggtataggaatgcaaacagtgttataaattatcagtaaaaatgttatgtcaatatttatgttttgcccagtaatgcctttttagaaactataagatatctatactttttattaattacatttgatgtaagaaattttagctgaacttaattttacagaagttaaaatttctaagtaaattttcagtgtaaaaattatagctgtaaagcataattatataataatatcatattactttttcttaaaatgcgtttcacagctatattgactaaagttgtgttgattcttgtcagaccttatgtattaattttttaacttgttcttcacaagttaaaaagtataaataaactttggacaaatgtcaatttttttattgtttttatatcactgcctttctttgagagctgagtgtctttcaatttccatgaatgatctatataatgactaattggatgaatttttaaaatgtcttgatatacaaatataaaatactgtactttgaaatgaggtgtcaatcttcattttgcttactgatctacttccaaatcagctaaaggatttttaggtcatttgtttatgataacccatactctttgtatccccacaaataattatttttaattaaaataatagcttaatagataattttaccaccttatttttataaatgactttagtttttaaagtgtaataccacatttgaatacaaaactaccctaagagccatgtaaatattatcatctatatagtacagatgaggataataagtatctcaagggtgaagttgttttccaagttcaaagatgcctagtctaacagtgtttcaaccatatcaagctgtacagaatggaggcagaatatttaactattcttcctccttgaatttttcactaaggaaatatatggattaggagtttgaattagataaacagattatgggctttggtcataagcagcctaataatttcaccttcctagatagtaagcatgagttatggaattaaaaagacttggaaacataactttgtttaaccttagataaaattacttagcctctctattcttctttttaaataaataaataaatgaaacaatgaataaacaagttatgaatccataaaaacggtgttttaagaattaattaagatagttaatatacatagagggcttctttgcacataactggcttataacaagcagctcttttaaaaataatatcattattattatttgtaaagctgatacattttaactgccacaccttatgaaaagaaagttttctagcttaagcattagttatttggatgtaactcttaaaaaaaatcgtatcattatgactactagcaaaaatgtgatgattagtattattttttctaaaaatgcatttcacagctatattgattaaagttgtgttgtcagaccttatttttttttttaactagcttaagtaggggaaatttaaaagtgtataatgatcctcaatttttctccatcccattgtgtttgcaaaatacaatatgaggatattgggtaactgtttctgttagagtaaaggtttctgagaatattttaatatttgataatgtttatcattgtgaaataatccaggctaaagcataacatgatttataatttaattcactaagaaagatatgtatttcttttgccctcataatttttttctgtctgctgtataatttagtattcaaaaaatttacatttagcaagaatagagtccaggtaaaaagctcagctgagaatgaaatcatcattaataaggcaggctaatatgataaagctttcatagatggaagttaagataatagagttcctgtcttagctctgagactagttagatatataacttgacttcttaagttttaattttttctagctataaaactacagtgatcagtaggatcacgaaagatgctacatgtaaagtttcttttgactgctgaatagcttatgtaaataataaaacttttttttaaagatagctgctctaaaaccaaatatcaagaacaaggttgtatatatttttttaacatgagtgatttagccagtcattttccatctttcattgcttcactgttatattcatatagccttaggtcaattcatacttctgatgtatagcattaactgtttgatgtttttaaaaggctgccaatcaaaacagttatattcacaagaaaaaatttaacgggtcacattaaatgacatttatttttgttatttaacacaccaatattatgtaaaatattatatcttatatcctatgaatattttttccattttagttattattattatctaatgtggtagaataattttctgcaactaatcacagtgactgttttgatttgtttccactacatgtgacttactattcttgggcaaatggcctatagagtcagaaattaattggagagtgtctaagaatatatagtatatccataattagttaacaaataatttaaatgacaaacacaaaataaaagtttggttgatatgtactagaatatattagaccactgaggtacaatagtatcttatagataccattgataggagtagctcaaattttggtaggctccaagtaggataagtagaaattgtatgtagaaatggttaggaattattctgaatgaatactaaaatatcatttagttattttatactatcaaaattaggccagcgagatacacaaaataggatttcctccttaaaaataaatactaaatgcaggcttgaaagtaacatattttatgatatttcttgaccaatgaatacatatattcaaaaagagagtgatgagcataaaagttaaatcatgctggttatttttcttcagatactgtttttcaaaaataagtatattgctaaacataatggttttaactttaaaatgaagctacatatgtcaattatcaatgtggagcatgatttcaactacacttctaatataaaaagaaatctgtgcttctccaaatgctgtcacatcatgttattataaaaatatatcttttaattaggaagttaagcttttaagaataaatattctgtaacatcaacaatgatattcttgaaaacatttacctgtggactatttatgtattttcttattacatccaaaatacaaaatagagctctttaaaaaaaaaaagctctataaaaaagcaatgtaaatatggccaagttcatactatcaagatttccagatctacattgtttcaagaattagagatgtgtaaatataaattgactaattaaatataatgaattttattaagagttttactaatttaaatgcaattatacatgctaacagctcaaagatttaaattttcattttcaggaatcttctatttggttagtgccaccataccatccagacactgtttagtaatcttttgaaacttactaaaagaggtttttaataatggttagtatccttgtgcctttcttttttctttttgtagtctgttatattaatgtggagaaacatttttattgttgttttcatcctaaggaactgaccttatttaatgacacagtgcgtgggtttccacccctaaatagtgattttaaaagcaagatagttgtctttctctttcttcttccctccagctttccctttcttcttctcctccttctcctccctctccttctccttctcttctccttctcctccttctcctctccttctcctcctccttcctttcctttcctttctttcctttcctctttccttccttccttctttctttctttctttctttcctttctctctctctctctccctccctcctttctttctttctctctttctctgtccatctttctttctctctttccctctctctctttctttctccacttcttttcttctttcttctttttttagtataaccaggaaaattactgcctagtgcacttgggttttgagacttatttcatagtccaataaaaagatttaaaataaatttcaatcattatataaagtataaaagacaatttgtctctacttaatgataatacgttagaattttacttaaaagttagacacagtaaattttgggcaatgtacagcacagggaaacaattatatttcacaaaactctgtatagtttcagctttagagacttatataaatcaagatatggaatttgccttgtaaacctttaaacaaaaagaaaagaatgtatatttgctctagtaccataaatgaacagttctttgtgatatccttgaatttgtttaatttgccatgttaattgtaaaatcttgctcaaatctaaagattatcaagttttaaaatgggttagaattattctacaaatgagaaaagaacctatcgtctcacagtaactttatcaataacctaaataaacctatttttcatgtaaacttacattgataaataacaaaagagctggcaaaattcatcttattcaaagagaaaattaataaaatttgtattttgtcattatgtaatcgagaccattgattgacttatgaaagattgcttgattaaatttttactttctaatggctttgtaagctaaataaagtctatgacgacaatggtgatttacatgtttacaattttgagatagttgtaaaatttgtaaatataatttatttaagacaatttcaaattataaaagataatactattctggtaattgattagaatgggcttttttcaatttacattatctattactcagcaatataaacttaatattatatgaaattgcttaaaatggttttaaatgttcttatttgtagtctgaagtaagtatggggtactaaacacagagtttacctcttaaattgctagaaataatattgagtcatttcatagttgagcttgtatgcacatgtgtaagattttttcctaagaaagttagttacttagcctactcccttactataggcaaattattaattaacatttatactctattctgttttgaaagtaatgtaaccaaaatatctgaaaattgagattgccaagaagaaggtgtcataaatttttgaagatttgggaaatttattggttttaaatgaaggtttatttcaaacgattcaatgttacacgtcctataacaattttaaatgtcaacgggatcaagttttgaccatgttatgtcatctaattaattcttctgttaaatgtttcaacagagagccaagactaagttacctcaagactatgtattcctccctattttggagtcagtttccatttctacagtgttgtcatcatcaccatcttcatcatcattatcatcatgttcttaataagtacatctaatagtaggtattaagcaacaagaaacactgtttccatatactggctgtcaggtgccacataaatcctttaatagaaatataattcatgaattgcagaactgcataatttaacacataatacataatgcatggcaatgactctgtagttaatggggaattcacaagtcacatttaatcatcacccattacaagtgctaatatattaatatttttattaatttaatgttattaaacaaatgctaaagttttgcctaattttattaggcaaaattaattgtatgcaatatattttcactaggtttctaaacctgaaaattttttaagcaattgaattagaaacattgttaaataagaattaaaatattagagtcctgtgtatctattgttaattcaatcaacatttaaagagcttatgtgtgtacaagcagtgccgtgagaacttgacctctgctctacacaattcagggagagagatacatagagcactggcaggccagacagaaaaacaggataatgagtggaaaatactgacagaataaaacaaaatcaagttgtgaaaacaaaagaatgtgcctggtcaagtggaaagggcttcctaattaagttaaaacttgagccatgtcctgaggtaggggataaagttgggatgatgtgaaagatgaaagaactcagcagggtaccagaacaaggagaaacaaaggaaaaatattaatggaagtcccaccaataaagggagtgtgaggagaaagagagagagatggaagcagtggggaagggagaagagggctagatcagagaagtcatgatggaaaaaaataatagatttgagtttgacttgtttcctaaaggagaaaatgctattaataattgatattttaaaaatagattatccgggtaattgtgaacctttacagaagagtggcgtagacgtagaattaggaagaccattaaggaaactctttaaggagtccatcaaaggaaaattaggatatagccagagattgacaggaaggtaatagagcagtgtcaaaatcataaaactagatatatcaggatatgttgctggaatcttaggtgtgaactgtagaaagttatccaacctctctctgaatcagttttctctgacacacagatacctaattaattcaaagtatgtttagactggcacaaactgttatgaaaacaattttttaaatgtatttttaagttaacatataaaattgtatgtatatatcatatataacgtgttttgatgtatatatacattgtggaatggttagatatgtctaattagcaaatgcattacctcacatatttattatttttgcaatgagaacacttattcactcttttagcacttttcaataatatattattattaactatagtggccatgctgtggaacagagctcttgaaatttttcttcctgcctaactgtaaatatgtatcggaaaatgacacacatatggtcttaaatattttcatcatgttgtcttagaaatagtctaagttcataatcaataaagcagctaacgcacaaataagtcttcacatgtatctcaatcagttggggagagacactaacaaaattttgtttcatatatatgactctacaatataaattttgaggagctgtaacaataagccccagataaacagaggttctagcaaatctatttccaatgagatgggaactaagacaaaagcaacatagggtcatattttttctcatttgataaattatcagctctcagttatcaagctaatgatgacaaaaaagttaatatttgtttgtagatgtctaacatgctataatttgtcatttcatgattaagtcatatttgtttgtaatcactgtcaatgtttctataggcataatcacaaaaaagacataatgaaatgccagaaattgttttccatattttatgtctgtgtgagtgctatctttgttttgagatgtacaatgaagaatcaatgttcaaacaacatttgcatatctcatcttgtgatctgaaaagtagtatgatttgtctatttttttgtatcaagaatgggtttctggtatagaattgtcattgtatttaaattttaaagtagatgtctatgtcatgctaatcatttttatataatgtcataggaaaattttatttaatatatgtgtaatatatacattactagctggttgttcatttcagtatcgggtggagattttctttaaactagcccacttttatagaatattttaattatcatgggttgagtgtttaaagtgtgacatttgttataacttttacaatgaaaattttcaaaccttcaaggatgttatgtgacaagtctgttgaggatgattttaatattgatcttggacagttacagtttatgtatcttgtaatatttaatttttctgtgttcttctgtagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 366 - DNA, 671070 bp, Homo sapiens; identical to SEQ ID NO: 365

SEQ ID NO: 367 - DNA, 671070 bp, Homo sapiens; identical to SEQ ID NO: 365

SEQ ID NO: 368 - DNA, 64297 bp, Homo sapiens
ttccacaaacaaagatggtttaatagatttcagcatgtttccacttgacaatgttatacgaaaatagaatctttattaaaatagcaaggcataacaatcactgctactcaggaaacactgtgtttattctttttaatcatcaaaatcaatgactttgggcaagacctgtgaaatctcagagcctgtttctccatctggagaacaggcaggtagggcattgccagctccctgtgagtgggggccactggtgggaggagatggccctggtcgcccatgggatgagaaacttactcctgcttctgtccctggagaaggtcagggagatgccagtgtggccttaaggcaattctaacacttgcttatctcgttttgtaacagagaagagagagctctcagccttggccacaccagcatggagcccccttccccagcgaatttatttttcatggtcactttctatttttggcagtgagtgatacatgttatccactattggcagcaattggggggaaaaaaagttcattttaaaaacaaagtttaggccgggcatggtggctcatgcctgtaatcctagcactttgggaggcccaggcaggcaaatcacgaggtcaggagttcgagaccagcctgaccaacatggggaaaccccgtctctactaaaaatacaaaaatcagttgggcgtggtggtgtgcgcctgtaatctcagctacttgggaagctgaggcagaagcattgcttaaacccaggaggtggaggttgtggtgagctgagatcgtgccattgcactccagcctgggcaataagcgtgaaactccgtctcaaaaaaaaaaaaaaaagtttaaaaagcgagtctgtttaaaggagaatatttggtaaacaacaatattaaaatatagcaaataatagtaacaataatcacaatggtaaggaaacacttcattagatcaacttaagagtattttattcttggctgggcgcggtggctcacacctgtaatcccagcactttgggaggccgaggcgggcagatcacgagctcaggagatcaagaccatcctggctaatacggtgaaatcccatctctactaaaaatccaaaaattagccgggtgtggtggcgggtgcctgtagtcccagctactcaggaggctgaggcaggagaatggtgtgaacacgggaggcagagcttgcagtgagccgagatcacgccactgcactctagcctgggcagcagagcgagactccatctcaaaaaaaaaaaaaaaaaaagagtatttcattcttgccactgagcttaaaaagaaagaaagaaagaaagagtattcctaacatatgtccagtaattttgattcttaagcaagggatgaagaaatacaatggcatccaggtaacttcctaactagcgcatagcaggtagctaacccactcatctctccctcttttctttatagcttctattttttttaaagagaaaaataacgattaaaacaagggcaggtttaaataatcgtctcctgagctgcacttcagtatctcaggtaacagctggagctgcctggtgggagcacatcttttccttgagtgtaattcactaatgactgtggttccaaggaggtgcgacctttaaagggaattggcccttctttgaaggcaggtgagaatctagtctcagtgacaacccagcctgatttggaaggggggagtcataagggttttcgcccagcacaccagggttgcagcctgcgcaagaccttccatagctatttctgccggcttgcttccttcccttcccagccacgatgaggcagctgagggttgccacggaaaccggctctgtcctcccactggaggctgccagctctgatttcctgcagagttaagaaggaggcggcagtgggggtcacccaggcgtgaagatgggtttccctggggatatcctgcctcctgccaatcacagcgtctctctgggaatcctgggggtgcctggaggctgaggcccagggaagcccccaaaccccagtgctgctctgagaagagactagcctctgggacattcagaggtctggggttcttttatctccctccagctaaagctagagggacctcattatgtgtcttacaagatgtacccaagtttaggtgcctctggctctgtcagctcctgaagtcgagaagaattgtcccatcaccagtccccttgagcccaaagaacaggagttgctcatccagcatttgctcctgggacagtaaatctgcctgcagagttctacagcttatgagctatgtggccccaggcaagtcacctcacctctcagttttctcatctatgaagtgggcacaaccctccttctcttcatagagatgctgtgaggagtagacatactgtctgtagggtctctcgcaggcatttaaagggtctcaataaacaggactttatattaataaaaatagcatcataaaaaaggtttgcaggccatttttctctttaagctgttttttattttaattaattatttatttattgagacagagtcttgctctgtcgcccaggctggagtgccgtggcgcagtctcagttcactgcaacctccacctcctgggttcaagcaattctggtgcctcagcctcctgaatagctgggattacaggcacgcaccgccacacctgactaatttttttatgtttagtagagacggggtttcgccatgttggccaggctggtcttgaactcccgacctcaagtgatccgcccacctcggcctcccaaagtgctgggattacaggcaagccggggcaaaggcaaattttcatcactgatacatttgttcaaagggtggtgcactcaggctgggttggaccaattagctggtccccaccacctcttacaatgtcacttctaagagttagaacagggtctcacactcagatgccttcaggtccaggaggcgctgtgaatgcagaagcagacccggtcagaaccctggtgaagccgagagcacatgtcctgcataagggaggcggctgccactcagctctggccaagagttacccttgggaatgtgagcccagtgtggccagatataccaagttttcaagagaagctggacattttgaatgaactctcccaaagatgataacaactaaggcatttttttaagtgaagtccaaacaaaacacgtctgcagactggatcgtgatcacagttggggcttctgcactagaatgcatgaaatcggcaccttcttttttggcttgatcagtctaaggagtcctggctggctccttccagccatcttgtctgggctgtgtcttccttagctccctacctgagtgctgacactgagaaagcccatcccatctggtgcctgtcactctagaacagagaactccactcctcagagcccagtgtttggagggtgcccctgttctgcaccgggaatgcatcagccttgggggaagctctcctgcattttctcaagtagtgtgagcaatggggcaatctggcaaatggggccccagggaagcagatcttctaagggactcctttggttttagctagtttaaggattattgggggactgactgctgaatgacatcaatggacacaaaggacatcctgagtggcctttctgtggccagcatccgctttgactggataaggcccgggccatgctagctcataagaactaggaaggtgacacctccgggagttgggggcagagcagtgaagactcctagttctgccttatctgaatagcatttgtggatatcacgaggtgagagtaacgaggtgaattgggagcagacaaagcctgattttggaaagaaaactttgcagtggataatccatagagctttcaatgtcttttctttgttcaccctcttagcttttccctcccctggacccagccttctgggagaaaagcagggaagtggtaatgctagcacctgcacccgggccaactgtgcacacagaaagctgggaggctggggcaggctggggcaggctgggcagaggcgagcacgtggatccatctgctccctgtgtcatgggcggatgcggtagcggacgggcacgtcgtgttccggctgcatcagaccgaagccgtacctgctgaggtcaaactcagggatctccacatctgcgttgatcagctccaagtccaagtgcaccagcacaaggaacacaaatctgcagagagatggcatggaaggtgtgaaggagaggagtagggcagggggttatcgggaacaaggcaggggagccatggctgcctcctaagtctgactccaactttgagtaaagtgaggagaggagtgaggaagtagaagaaacgcatttgctgctcaccacatttgccagccccctgtaaggttaggcaggcccgtggatgagttctggtgaatgggctgtgtgcagaagtggcctgtgtcactcctgtgtcaaagcattcgcgagccagtgtgtggctctccagctgtccctcctgcctggcagccatgcaggcttcacattgagacggtggagccgaaagagggaaagagcctggcccgagtctgtgcacagagtggggaagccctccaatcccacagctgataccgtgtgagtggaactacacctctgttggtaaaagccactgagactcggcaggtgcagagctgagcctgtgctgattaatacggcgactcctctggatcctccagcccacacactttgccgcctttccccacactcctggaaccctcactgtctatcttggccaggactgctgctaacccttaggtgtctttgtgagattagaaacaggcatcgctctcaagacattttactgccatctctgagaaaattgtcctaaatagaccaactttgcaagaacaagcactctctactgccatcttctgggaaaactgtcataataactattcgcagctgccatgcctatgatgtaatcagtgcccccataaatgtggaggcagccctacgggggatgtcaacggttgctgcctccctgcctcatcttaccaatgcccatgttcgtaagggtcaggagaatatcttatgactcttttcccaccactattccctaccccaacccaggcgcccgatgcagcactgagcacatggtggggattcttttgtctcactgaaggagtgaagaagagggcagatgaggagagaggggagttaacactctggacagatctgggctgtgccgcttatgggaatgtggccctcgccaagttcttacccactctgggtctcagttctcccatctggtcaaagaggggaaaggcatgttgagtctcttccagctctgaggctgtaggaaactagagggtgagtttctaagggatggcggttttgtgcccacccctggatttgaactcctgcacctccacttcctgggaacacggcaaatgatctgacctgcctagactcggttttagatggaccagcagggttgtcatgacaattcagtgagataaaaataacaacaaattagctaatttattggaacactgtgcgctaggcaccatctaagcatttagtacccgctatctctttttatctgtccaaaaacttgatgaggtaggaatgccagtcggttctgctctaacacttgttttgaacaggtgaatttgttccaataggattgatatattagggcaccatttgaatataatgcaagtttcacatttgctcacgtgcaatttcacttgtgagaaacatgaggtgaagacgaaagactgcacccagctgaacctgggtgtgcagaaatccataaaatatacacatgcacacaactaagcatcgatctacagccacagttattacagcacttacatagttcttagccaggtaacatgtataaaactttactaccattttttttactgggttcttctctctctctcttttttttttattatgtcactgatgaggtttttgagtgttggccccagtcccccttttccctcaatccctgcagttttttctttctttctttcttttttttttttttttttttttctggagacagagtctcactctgtcgcccaggctggagtgcaacggcgcaatcttggctcactgcaatctccacctcctgggttcaagagattctcctgcctcagcctcctgagtagttgggattacaggcacgctccaccacacccggccaatttttgtatttttagtagagacggggtttcaccatgttggctaggctggtctccaactcctggcctcaaatgatctgcccacctcggcctcccaaagtgctgggattacaggcgtgaatccctgcagtttttgttgcatgatttcacacagcaaggtgattttaaggaatgcatatgagctgtattatgttcataattgactccattttcttgaggaaactgaggctaaaggtttatgtaacgtgcccactcacttagcacaatgcatgcacaataatgatattaacaattatggtaataattaacatttttcaaatgcctacaatgagccagacagtgggttaagaacttagaaagatccaattcatttatcctgacactcctggggtatagttataatcagaaccctcattttacagttgaggaaacaggctcagaaggtaacccagcttatgattgcacaggggctggacaggaggacagggcagatgtcataacccctggtccaatctgtttgtgatcctggtggccaaagctcctggggttcaagggagataatttatgaggctctcggccccacaggtattaaaataaccaagtgggaacagtgaagttcggccagttcctaacatgaagttctgaacatgcggcagcagctgcagacgggtagctacggtcagctgaaaggaatgtccagtatttggaatctggacaccagtcttggagggaagaacctgctgccagatctgattatttcaaaagaaatccgaaatctggcttttttacacgagctcttctgatttataaaagcacacagttgtaaaaccacaaataagagatggctcacgggctgtccatgtgaagcctctgccaaaccattctcctggctgagccctcagtcccaggagagaagggcgcctgccaaccaggggatcaggagccaccctggccctgccctggccccccactcactgtttgatgctgttgaccgcataactcctccccaggcagtgattgtgccccgccccccagggcatgttgtaattcttcagccgtttcccatccttgtaaaagtctttcttctctgatccgtcagggttcaggaatcggttgtatttaaatacctgaaataggaagaaggtccttttctgaccccattcccagaacaagctcacaccaagaaaaatgtatgaggatgttcatgacagtcatgtttataagagggaaaaactggaaaccatatacaggtcaattgataggggattggttaaaaaattatggcaaaaggtttgtgtgtactgacatggaaagaatttctacaattggttgttgagtgaaaaaagcaagtttcagaatagtatatattgcatgatcctatacacacaccaatcttttcatggcatgtgaatgtgttgtgtgtatgcctgtaaagccatgaaaacaattcgcaaggcacactccaaaccttggtcagagaactctgtagaactggagaagaagggaaatacatattttttacatttaagtatatatttctctgtatttctttatattctatgatatatattacttttgtaatgtaaaataaaagaaattaaaatattttttaaaaagaaaatgccaatttcctttggttacactgcacagtggtaaggcaagggttgtagctgagcacagagcttggcatggagtagctgccgactgaaagatgggtggaaggataggtgaatgaaccagtggatagactaagagatggaaatgtggatggaaagatggatgaatggagggatggatagatggatggatgggtagatggggtggatggatggatgggtagatgggtgaatgaatgggtagattgatgggtggatggatgaataaatggatgaatggacaaatggatggatggatgagtagatgggtggatagatggatggatgggtggataagtagaagaatgggtggatggacatatgagtgagtgggtagataaatgagtgggtggatggatggataaatgagtagatgattgaatggacagacggatggatagatggatggattcatgggtaggtgggtggatgaaagagtagcttcatgggtggatggatggatggatgggtggatggatagattaatggatgggtagatgggtgagtatgtggatggatggatggatgcatggatgcatgggtggatggatagattaatggatggatgggtgaatttgtgaatggatgaatggacagatggatgcatgggtagatgagtggatggatggatagatgagtggatgggtggctggatggataaatgaatgggtagatgggtggatgaaagggtaaattggtgggtggatggatgaatggatgggcggatggatagatgaatggataggtagataagtgagtgtgtggatggatggatgaatacatgaatagacagatgcatgagtagatgggcagatgaatgaatggatggatagatgagcatgtagtttagggtctgacacacagtaaacacccaatctgttagcaattgtgaaagtttacttcttctcaaagtctggggcaaggcaaaagtgttgagaaactgacattataacaatctgaaataaggaaaatggctgagctatcacaaagcactcagtgtgaatgaacatcccctcatgttctagggttcctcagagacccttgaacatgaggggatctgggtctgactccaagagaagctgtgaaaaaaggtaggagccaaagagatatcagaaggctggggagagagtggggccatcaatatctgcttatgcatgatcccatttaatcttcctatcaatctcatgaggcaggtgctattatgaggtccatttcacaggtgaggaagcaaacacagagaggtgaagcaatctgggcaatgtcacatagcaaacaaagagcagagccaggctgccactcagatctggctcatcccaaagtcactgattgttctcccacagaccccatatgaccaggcgcccctgccatttacctctgggtctgtgtagatttctgggtctctctgggggctcaggaaggggaagaggaggaggcggtcaccacgtcgcaggttgaattctcgcccgtctgccatgggcatggccaggtccaccacaacctcgcgggtgatgaagggggcagctgtaagcctgaggctctcactcagcacgctatctgcatggggcaggtgcaaggaagagtcagcgggctatcccttcacctgctcatatgccaaccccagctcttattttacagaggaagatgaagaggctcagagagggtgcctgcctcgcccacacagtcacatagcaaggtgaaaaaggacacacgatgacatgtggtctctgtggtccctcagagacgtttgaacatgagggtatccaggtctgaccccaagagaagttgtgagggaaggtgggagctagggagatatcagaaggctggggagagagtagggccatcaatctctgttcctgtctgcccggcatatatttctcttctggaaacgggcccctgattttcctctagggtccacccctctctcattctcaggggttagactgctgcttctatgctcaactcctgggatggggctgtgactggccaatcagagcatccctctgagccctgtgattggttcaggatggacacatgacccaaagaaagccaatgagacacagtcttgggactcttggtgggaacactgtaagagattcagagtctcacagagccaggaggaagtcagccttgagctgccaacagctactgccagcctgagactggagccaacccagtgggaaacagggctgagaggtggagaggaactgagtagtcctgacgacattgttaaagtgcatggatccacctgtgcctgaagccaatcctctgggctttttagtgacatgtctcaaagtaccttttcaccttagtcaattgaagttaggttttctgtcacttgacccctagctgaggctggagtatggagatgccaggtgtgtgaagataggaggcttagggagaccctaggtcggaggacacactgatggaccctggaagacaggagtccatgttggggagggctttgggggtccatgatgacgcagtcttaggggctatcttggagggtctgacgatctcaccaagcacaggtgtgctgtctagaaccttctgtgggagagtggtcgtctgcgagacaggctgctccgcttgccaaaggatactctcgagctctccgcggacagcagccagggcttcaggattcttgagaaggaagagcaggagccagaaggcagcgggacccatattcccctgcaaggagaagggcccctgttatgccattatgagggcagagctgactcgtctctgccagggacacagctcgggccaagacagaggggccagtaggcctgggttcccactgctgccaaacacccaggcatgaccagtgtctatctccagcctcaggacatggccaaaactgccctgtggcccaaaatacctacttcaaggccactcgtggcatccctgactgtgtgcaaagtcactaatcctaggtcacacaggtaatcttcatagctaatcagcaaaacagtgtcagtaataggaacagggtatatcagttaagactgttcacatctgagaatgatcacattgttggccccaattcttccccaatcgcagaatccacgctccttaccatgtgaatttgctgttcctcctattcaagagccagagcgtatttcccctgccctttgaatttatgctcagccgtggacttgctttggccaatagattgaggtggaattgaaggaacagccactctacgcctaagccgcgagagactttgtgtttccacttgctcggcaagcccactgatcccaagaggaggatgagagactcatggacagagctgagctgccccaatgagccagacccacagacccgtgagttaaataaatgctgatgggtgtatgccgctgatgagttgttatggatgtttgttatgcaacaatagctaactggtgtgatatctaaagatttgcttccaaatataatcattcttgatgtagtttgggaagcaaaaagttccctatatgctttgtatcttcaaattctatcagtcacttgaagaataaatgtgtgtgtgttgtgtacgtataaaacaaagccgcaatcatcattgatgactgaaagctatgaataaaaattatttaaacttcccaatagataaacacttaggaaaacgagtggaatttcttgcttcaaggcttcagtcttagctgaacattttcatacacattttagcctcagctctttggtatgtggctaaaatgtgtatatggcaccctttagtgatccagatatgggaagaataccaactaatctcaatttgggggaaggtttttgtctgccgtgactattctattcaatcataataatggaatattaaatcatcattaaatatcatgtttacccactaatttcattacagacataattacacatgggcaaaaggacatatgcacaaagataattattgcagtgctcatgtaatagaaaaatgctggaaacaatctcatgtctatcaataagagatcaatgagatcaatgaagatccatccattggatgatgtgatgcaggaagtcattaaaaagaagctggctctgtgtgtaccgatgtgggactgtagccaagacacacagaagcatgcaaacgcaaggtgcagggtggtggctcagcatgctgccatttgtgtgtttgtttaaagagaaatatacatgaagaagtacagaccatctctttttttttttgagacagggtcttgctctgtcacccagggtggaatgcagtggcacaatcatagctcactgcagcctcgacctcctaggctcaagtgatccttctgccttagcctcccaaggagctggggccacaggcatgtgctacccagctaggttttttttttttttttggtagagatggaggtctccctatgtttcccaggctgatctcaaactcctggcctcgagcagtcctcctgccacagcctcccaaagaagcacagaccatctctaagagacaccagaaacgggtaactgaggttaccttgggacagaagctgggaagacaagaggataaggaggaaggaggctgactttccttgcaaataccttttaaactgttcaaaattttttaatggacacactaattttaagtgaaacagaagccacccaggctggagtgcaatggcacgatcgtggctcactgcaacctccacctcctgggctcaagtgatcctcctacttcagcctcccaagtagctgatacaagcatgcaccaccatgcccggctaatctttctattttttgtaaagatgaggtctcactatgtttcccaggctgtatccaaatcatttctacagtgatgtacaatgtcatgagagatgctcatgttacaatattaaaccaaatagaaggttagattaaaacagctgcatgatcttaaccacagaagaaaaacctatggggaaaggctggaaagaaatgcaccatagcattagtgatggtgagatagattttgccttcctctttagtgcccgtgaggccaggaggaaccacactcctctgctcaatacttccatcacgcaggtgccattattaggccttttactgaaaaggaaaacgaagtactccccggtcactacccactgcccagcatatagtggaggctcactgatatttgtcaaataaacatctgcatccctttggattagaggtggagctccaagacagcctgggaggtgggctagaagatccctggactgagaccaggtagaggtgggttcaaatcccagctccccactttctgtgactgtggacaagtcacgtccccctttgggtctcaacactgggggtaacattgccacctcctgggtggacgcaagggtccagtgaggctgaatgcaagcaatcccacacgtgctgcgcccatagtaggtgctcagaagtggttactcctcccccactggcccctcccctggatttgaaaacaagtcgggggggcctccggccctttctgagagttccaccagcacctcaggtccagctgacacagcaaggtcacctgctgtccatcacttaaatagccaggcaaatgcggatgataaataattcaacaccagcttagctcagcgccaaggccattttatctggcccagatggttagatgggggccaccgctcattaattaccaagcaggagtggaacacatgggcgcttggctatctctgcctgcaggaaaaagctgtggcaagttagggaggtgaccaagaccgccttttacccaactgcacagatgtgagtgtgagtgtgtgtgtgtgtgtgtgtgtgtgcacacacaaccataagagatcctgaatttgccaccctggaatttgagctttcacccacggagccttgcctccgtttactcaggaagacacttcttgtttgtcttcattccctcctactgcagccaaaggccatgacccaaaagcagtgccacccctgttctagctttcctgtgaatggcagtggctgacctctgggaggcactgactgcgggccagaccacacccttggtgattcacatgctccttcttgttgcctcctgacaacatggcccatcagtggaagtgggggacttccgctgcccgctcctgcctgcatccgcttccttgtcgttggtaacagcaccccactttccttcaaagaaccacctcctcttaagtctaagtccatgtgggccatccaggactgacccatccttccagacttcaagtgtgggcatgggacccaggcggaggcactgagtgatccacgcagagtggggcatatgacgtgggctgggccagtgagtatcagtcttgggagctgtgctagaatttaggggaagggaagccctcctccatgggattgctaaattgcctagagctactggaggccattgtagtcatcccccagggggagaccctctgaggatgtagcctggcagaagaagggagacctgagggatgggggtcacagattgtgtttcttttaatttttatgatttagaagattccaacggaataaaagaatatcccgagtgtgatgatgtgttagtgtaggtcataaattgtaacaaatgtgccactctgctgagggacaccagcgatggagaggcgaggcattgggagaagggggctaagggagatccctgcacctttccttcaattttgttgtgaacctaaatctgctgtaaaaatagagtctatttaaaacaaacaaacaaaagccctaagtgcaatgtgggattgtggattggctcctggaagagaaaaagaatattagtagaaaaactggggcaatgtgaataaagtatagactttagttactagcaatgtcccaatgtgaatttcttagtcttgatgaatgtattgtggttatgtaacattagggaaagctgggtgaagggtatttgggaactcctgtactatctttgcaactcttttataatctaaaattatttcaagataaaactactgaagacaaaaaaaaaaacaaacaaaaaaaccaaccctctttacagatggtgaaacttaagcccagaaaagtgacttgtttgaggtcacataactagtttagtggcagaggtgagattccacccgagtctgtctgactctcaatactgtggttttgctttctactccgttgtcagatgcctcaaggattcttctcgatgatcactatctcagcggagctatgtgcaggcccagcagctcccgtggccccctcccctacctctcaggaccacccaggaatttccagggatgtgtggctgtggctgctgaggatgtgatggggtgaaggccaagccagatatcgggaaggaagagaaggatcagatgtgatggatggggctgagggacatcatgtcaatcaatggtttcagtcctggcattaccagcatcagtgggctcagagctggcagggaagcctgacctgtgtttggaaactctcctccgtctgccccccaccaccccaccccaccttcccttacagcctcctcttccccttgcctggaccttaggtctcggcccacagagtcctccctggatgcctgagactcccactgctccttccatcactctcgattccaggttcaggggttctggattcaggaagctgttgtgaggatcctatgagatggtggttgcaaagtgctcaacaggatgcttggcccagggtaagtgctcagtatcttttgagattattattcctgactcatcatctccgacctgacagcagcaatcacagctaccatttttcagcctctctgcagcatctgacccagcttcccactcccggctctcctcccaccttcctggcccctcctcctcacccttcccaccactggagagccccagggatgcccccttcttcacccaccctcgcctgcagtatctcctccagtcctgaggatttaaactcctctatgctgacaactcccaagcctggacctcaaacttgaactccagactctcttctccaggtgtccactcccccatctccatctcaaattcaacatacccaaagcccaacccccgatcttctccctgaaacttcctcctcccgccatctccctcttctgcccatggctctgccatccctcctgtcactcaggcccaaacctggattcatccttgatggcctcccccaaggtcccatccaacagcggatcctgttggctttactttgatatatgttcagaatctaaccacccctgaccctggcccagcagcaccctctcttgtctggatcctgctgctcctctctgctctccctgcctctgcttccccaccccctacagtctcttgtcagcgctgcagccagaatgatccctctaaagcgaaagacaggccaggttcttcctctgctcagagccctacagcaggcacctgtctcactcacagtaaaagccaaagccctccccatggcctacagggacctgtgtggtccggcagctctgcctccccaccgtgtcacccttagtcctgcctcagggcctttgcacttgctgctccctgcctgggaaacttcattctatatatttacatggttcacccctcacttccttcagtctctgctcagatgtcacctttcagtgaggccttcctgggcctgccttcctgctgcatctcttctccatagaacacattccctctaatacttttttttttttttgagatgggagtctcactctgttgcccaggctggagtgcagtggtgccatctcggctcactgcaacctccacctcccgggttcaagtgattctcatgtctcagcctcctgagtagctgggattacgggcctgtgcgaccatgcctggctaatttttgtatttttagtagagtcagggtttcatcatgttggccaggctggtctcaaactcctgatctcaagttatctgcctgccttggcctctcaaagtgctgggattacaggcgtgagccactgcgcctgacttctaatacattttagatgcttacttgtttgtttatttatttatttatttttgagacagggtctcactatgtcacccaagctggagtgcagtggcacaatcatggctcattgcagccttgacctcctaggctcaagcaatgctcttgcctcagcctcccaagtagctgggactacaggtgcgcaccatcacgcccagcttttctacaaaaaaaataaggtagtttttgcagagatggggtcttgctatgttgcccaggctggtcttgaactctaggactcaaatgatgttcctctctaacttcccaaagcactgtgatgacagcttatgtgtttattaattgtctatcttctcccaccagaatgccagctccctaagggcagggatttttgtctgttttgctcaccgctctatccccagcttctagaatggggcctggcccatggtaggtgctctaaatatttgttgaagatgtttcttgagcacttgttatctgcaaggcacagttacaaaattgcacatgtattcctgcctcctttcatcttcacaaccacgtcttgaaacgggtgctaccatctccattttacagatgagtaaaccgaggtgctcagaggttaagtgactgacttgccaggaagtgtcaaaatcaggattcaaactcaggctgggaggtcacagagcctgtgccagaaactcctaggccaagtaccctcttggctccactcccaaaaggcccttgaaaagttttcccacctgcctgaattctggacgctgtcaacgactcaacctcagaggacatcttgtccccagctcctgcccagctctcctggccctgccaaaggctgttccctggactttctgccactcaaacccctcagccagcatccagttttgctgacaccagtcattcccacgagagttctggagacactttggagctccaagtcatctctgcacataaatatgttattaggcactgatgtgggggacaactgccaattgatcccagtccccaccccttgccagtctctgcctgcaaggacagttaatggctctgaggaaactaaaaataagctgcaagtcgatgggagaggaattacccagaaatgtcagcttgtgcaactgtcaccgtcgaagtggggccaagagaaagatggggcttggggatcaggagagagggcaggaaccaggcctggagctgtgcagcatggaaggctaccatctttctctcactccaatatctggtccatgaccaagtccactgactctgtcttcctgaaatttccaaaatctatccacgtcctcatcacctccatggccaccacctgaccctgccaccacagtttcctccttgttgccctgtttttgcttttgcccccaagatcctgtccctcctctgctcagaactctcccaggcccccatctcgcccagagaaaaatcccaagtcctcatttatgaggacccacaaggccctcagtgacctcttccctcggtctcacgccccctccctcactctgcttcagctgtgtgatccaactctactctgcaagatccaaccccagggcctttgcacttgctgtttcccttatttggaatcttctatccccatatcttctccaagtctctgaatctagctttcttatcatccagggctcatctcaaatatctcagggaggcctccctgaccaccccagctagagcagacccgaaagtctctctattcacagccctgtttcatactctacatatcatcatctaaaatcaccttgtatatgtttccttgactctctgccccctgtcctcctgaccccccaaatggtaatcgacacaacacagaatctttgaggtctacggtaagtactcaaaggattttttttaagaggtggaatctcactatgttgcccaggctggtctcaaactcctgggctcaagcaatcctcttgcctcaccctcctgactagctgggactacaggtgcacactaccatgcccagtgtctcaatggaacttctaaacaattcttcaaaataactggtctgcacacttcaaaaaatgtaaatgtaatgagaaacaatgaaacgcacagaaaccgtgccagattaaagaaaatgggtcgggtgcagtggctcatgcctgtaatctcagcaccttgggaggctgaggctggtggatcacgaggttaaaagatcaaaaccatcctggccaacatggtgaactcccatctgtactaaaaatacaaaaaattagctggacgtggtggcatgcgcctgtagtcccagctattcaggaggctgaggcaggagaatcgcttgaactcagcaggcagaggttgccgtgagccgagattatgccactgcactccagcctggcgacagagcaagactccatctcaaaaaaataaaaaaattaaaagaaaagaaaacagaagagtcagaatgactaaatgcaacgtgtgattctggattggatgctggaccaagatgaaccaaaaaggacattattgagacaactggcaaaactggaatacagattgtttattagataatgatcatgtatttgggctcattatcctgaaattggttattgtactgtggtcatgcaggagatgttcttgcttacactcaagcaattagggataaaaaagcatgatatctgcaacttattcccaaattatttcaataaaataatcccagtggggaaaagagagcataagagagagagagacagagagagagaaagcaaaggtggtaaaatgtttaaaactggggaatcaaggtgaggcatatataggagttcattaaactatttattaaacttttctataaatttaacatttttccaaattaaaaaaaaacaaaaacaaaaaacaaaaaacaaaaagaagctgggcgtggtggctcacactgtaatcccagcacttccagaggccgaggcaggcagatcacttgaggtcaagtttgagaccagcctggccccatttctactaaaaatacaaaaattagccaggcatggtggcaggcaactgtggtcccagctactcgggaggctgaggcatgagaatcacttgaacctgggaggcggaggttgcagtgagctgagatcgagccactgcactccagcctgggcaacagagcgagactctgtctcaaaagaaaaaaaaagaaaagaataccgaatgaatgtttctgttcgtgatgctatttgacagtaaaggaagtcagggaactggtttgggcagtgggtatgtgtgcacacacccacactcacatcagcacacactcacaaatgcacacctacatacacatgcacacacaggcatagtcatgtgcacacctgcacaggtgcacagacatgcacacacacatgcgttcatatcgcaaccacacatgcacacctgcacacacccacttgcacattcacacccacctgtgtggcccacagctgcagcaccagggcccgtgcctgcatctcctctgacacacccatctcctccaggtgcagcaggtaactctccagccatttgctccggtgggcccgcctggccagcctggctggggatagcagcttccacaggcgacttttgacactgcacatgtggtccttgtcccctgcagggacagagcacagagagtaggggttacagattcaccatcccacacccagggctggccaggcatgacctcccatgaggccaagggtcttctgaatgtcactcattgagggtggggagttcctgtgggaaagaagctgcaggacaggcccacagcaggaagccctttcaataccaaattgcttattatctgtcttacccccagtaaaaagaagcaaggggtcttgtctcctgcaggtgggagcctgatctatttcaatcacctctatgtccccatcacccggcccgtagcaggtgctcaataaatatgcattgtattagtctgttttcatgctgctgacaaagacatacttgagactgggtaatttatttatttatttattttttaaaaaataggtttaatggactcacagttccatgtggctggggaggcctcataatcatagtggaaggtgaaaggcacatcttacatggcggcaagcaagagaaaatgaaagccaagcaaaaggagaaaccacttacaaaatcatcagatctcatgagacttattcactacaaggagaacagtatgggggaaaccacccccatgattcagttatctcccactgggtccctcccacaacacatgagaattatgggagctacagttcaagatgagatttgggtggggacacagcaaaactatatcatgcattaaataaatggtagttctttccagagcaggagaaggaacactaaacactgagcagcattctccctccccagggtccaaccccagagcaatgccagcccatgtgcatgaggaggaggccactgtgagcaggctcagcacagcagcaatcacagaaagacatcagcaacaacctaactggcagattgggctggagtctcaaactcaactcactccagagaaggcaggccaagtaaaagagagacgggccagaaaggggccatggcacttagcccaccaaccagccctcggcaggagagggaaacaccccagcatggccagaaggcctgtgctttcaaaggaagctgataatccagacaattatgtataaccttctgatgttttttaaggttagcatccaagtaaaaagtttttaatcactgtgcagaccacagaagcatctctgaaggtcaactttggcccacagatcactagcgtgcatcaccattaaacagacaatggtgtgtttatgttctggaaacatacagcagtgaaagtgagttagtacattttacctacagacacagagagttcccaagggcagactggtaaggggataaagccgggcactgaagaatgacactatttagatattgttttcttttctacttctttttttttttttaaaatattttcatgaaccatacatgagccttaatatacattgttttaaagctccacggtaatgctatttatatgcacaaatataaagtttaaaacaaaaatataaaatataaaatttggttttctccgaaatcaccccttggaaaagtgagagtcattttggattgctctgaagtttcaaagtattggaaactccctcactgactcttctgaaccacaagccgtgtttcaggaagactcgccccaccagcgattctaaacctggctgcacctcacagggcatttgaaagggtcgaaaatgtagactatgttttttttttaaagtatgttggcttcattttcaaataatacgctgaatatgtttaacttttagacttcaacttgagctcattgttttacattgaaatgaatgtcaccatttcgggtgacatttcaatgtaaagcaataagcttaagtgttcaactgaaatacattatcttcctatgtttctccacttttcaggctctctgaagaattacctgggagctcttaaatctctggatgcccaggtgccaaccccagattgatcatgtcaaaatcacgtgcgtgggaactgggcatccagaggtttaggcctgcagggcgcgggcagtgttgaaaccacctcagttgatgccaactctggatacttctaagcatcatctgatgggatggctaaaaaaagaggcaaagaaatttaacacagctttagaaataactggcattctttgaagtctgaccacacaactgcaatcttgaatatcactgtaaacacggcgtttacagatgactttaaaaagcaaggcaggaccattctccacttttcccctgtgcctacagcagttctgagtacataggaggcactctatatttgcacaatcaatgaataattaagcaaaaaaggtaatgcagtatgaaaagacagctgacagaaagtgagaaaatatttgtaaataatatatctgataagggtctaacacccaaaatatataaaagaactcctacgactcaacaacaataaaaaacaaacaacctgatttgaaaattggcaaaggacttgaatagatatttctccaaagaagagatacaaatggctgataaacacatgaaacaatgctcaacaccattagtcattagaaaatgcatgtaaaaaccacagtgtgataccattcacaaccatgaggatggctactatttaaaacataggaaataagtgatggtgaggacgtggagaaattggaacccttatgcattgctggtgggaatgtaaaatactgcagttgctgtgaaaaagagtttagcagttcctcagaaagttaaagaattaccatatgatccagtaattctagttctaggtatatagcccaaagaactgaaaccagagactcaaacagatactcgtgcaccaatgttcatagcagcattattcacagtagccaaaaggcagaaacaacccaaatgtcggttgataggtgaatggataaatagaatgcagtatatacacacaatgtattcactcttaaaaaggaatgaaattctgacgcatatgccaggcatggtggctcacgcctgcaatcctagcaccttgggaggccaaggtgggcagatttcctgggctcaggagttagagaaccagcatgggcaacatggtgaaaccctgtctctactaaaatacaaaaaaaaaaaaaaaaaattagccaggcatggtggtgtgtacctgtaatcccagctactcaggaggctgaggcacaagaatagcttgaacccgggaggcggagattgtagtgagctgagatggcgacactgcactccagcctgggcgacagagactctgtctccaaaatctcatataatgagaatcctagaacaggaaattcagagacagaaagtacaatagaagtatactattcgacagaaagtagaatagaaagtagaatagaagagacagaaagtagaatagaagatatgtcgggctgggaggaaaggcaggtggggaattattgtttaatgggcacaaagcttttgtttagaatcatgaaaagtttctggaaatagataacggcatggttatacaacattgtgaatgtatttactgccactgaattatacaattaaaatggttaaaatagtatattttatgttatttattattttaccacaatttttttaaaaggcatatgaaggtcatttggcaaaaatgagtcaaagatagtgttgtataacaaagaatttgcattctgggcgggtgcagtggctcacgcatgtaatcccaacactttgggaggccaaggtgggcagatcacttgagttcaggagtttgaagccagcctgaccaacatggtgaaaccccgtctctactaaaaatacaaaaaaggataagctgggggtggtggcaggcacctgtaatcccagttacttgggaggctgaggcagcagaatcacttgaacccgggaggtggaggttgcagtgagctgagatggagccactgcactccagcctgggtgacagagtgatactcaaaatacaaaagaatttgaattccaaggtttcagttacccatggtcaaccatggtccaaaaatattaaatgaaaaattccggacataaacagtcataagttttaaattacatgctgttctgagtagtgtgttgaaatcttgtgccatcctgctctgtcctgcctggcaaaaaacacaggataaaaatatagcagtgggctgggtgcagtggctcactcctgtaatcccagcacttggggaggccgagacgggcagatcacctgaggtcaggagttcgagaccagcctggccaacatggtgaaaccccatctctaacaaaaatataaaaatacaaaaattagccaagcatggtggtgggcgcctgtagtcccagctactcaggaggctggggcaggagaatcgcttgaacccaggaggcagaggttgcagtgagcggagattgcaccactgcactccaggctggacaacagagcaagcaagactctgtctcaaaaacaaaaaaaatatatatatagcagtgattggatcatggatcaaatcagtttacatttgtatatcccttagagcagtgtagaggacacactaaaccttacccaagagttatctattgctgtgatatattgttagcacaaagcaaagtgccagcaaccacgtgtttagtatgcatttgtggaaaaaaagaaaaataagaatatagtcacattcacttgcacttgtgtgaaggaactctagaaggatccatttgaaactaataaaactaatcaattatgagcagtgggaattggtggaaggggatgtgacaagaaaaggaaggagacttaccactgttattacttaatttttttccagccttgctgaggtataattgacaaaggaaaattcttatttaagttgtacaacatgatgttttgatacacaaatatggtgtgaaatgattgctgcaatcaagctaattagcatatccatcaccttacataggtgcacactcacacgtgcatgcatggtgagaatacttaagatccactctcttagcaaatttcaagtatacaatacattgtatacttgtatattaaatctccagaacttattcattttataactcaaagtttataccctcaaccaacacacccccatttccccacctcctgagccctggtaaccactgttctactgttcctctgaattcaacttttttagctcccacgtataaatgacataatgcggtatttgattttctgtgtctggcttatttcacttacaatattgtcttccaagttcatctatattgttacaaatggcaggatttctccctttttatggctgaataacattctttcgtggatttacatacacagcagtcctgtcttatccagtttcactttccaaggtttccatcacccatagtcaaccatggtccaagaatattaaatgaaaaactccctaagtttgaaatcgcacaccattctgagtagcatgatgaactcttgtgccatcctgctccatcttgcctggggggtgaatcatccctctgtccggtgtatccacactgtagaccacacctgcccattagtcacttgggagccactgtctcagttatcacgtcaactgtcatggtatggtagtacttgtgttcaggtaacccttattttgttttcattacagtatatcgttataattggtttcattttattatgttgttaatctcttactgtgcctcatttataaattaaactttatcaggccaggcatggtggctcacgcctgtaatcccagcactttggaaggccgacgtgggcggatcacctgaggtcgggagttcgagtccagtatgaccaacacagagaaaccctgtctctactaaaaatacaaaattagctgggtgtggtggtgcatgcctgtaatcccagctactcaggaggctgaggcaggagaatcgcttgaatctggggggcggaggttgtggtgagccaagattgcaccattgcattccagcctgggagacaaaaacgaaactctgtctcaaaaaaaaaaaaaaaaaattaaactctgtcatagttatgtatgtataagacaaaacagtatatacagggttcagtaccacccatggttcctgacatccactgggggtcttggaacatatcccctgaggttaagagggggccattgtaccactatctctgtatctgttcatgcactgatggacacttagtttgtttccatgtctcagctgttgtgaataatgctgcaatgaattggaggtgcagacatctcttcaagacagtgatttcatttcctttgaatatatacctagaagagggattgctggatcatgtggtagctctatttttgattttttaggaacctccatactgttctccatgatggctataccaatttaaattcccaccaccagtgcgaaagagttctcttttctccacatccttgccaatatttgtcatcttttgacatttctaacgggtgtgtggtgatatctccttgtgattttgatttgcatttccccaatgagtagtgatgttgaacaccttttcatacctgttgccatttgtatgtcttctttgggaaaaatgcctattctggtcctttgtccattttgcagtcaggttatttggatttttgtgttttttgaggcagagtctcgctctgtcgccaggctggagtgcagtggcgtgatctcggctcactgcaacttccacctcccgggttcaagcaattctcctgcctcagcctcccgagtagctgagactacaggcgtgcaccaccacgcccagctaatttttgtattttttagtagagacagggtctcaccatattggccaggatggtctcgatctcttgacctcgtgatctgcccaactcggcctcccaaagtgttgggattacaggtgtgagccaccgctcccagatgttatttggaatttttggtattgagttgtatgagttccttatctattttggatgttaaccccatatcgggtatgtggtttgtaatctactttacatttttaatgtttaaaccacgcgaaataatttttaaaataaaataatagaaaatctggcaaaccccccaaaaataatttccagtgaaacatcatatactgtagagattcaaggaattcagtgcatatgggagtgaggaagagaagattctggaaaactgagcttggtggctcaacctggggccctgcagatgagcaaagctgtgtagttaaagggggagtctgcataaagccccctcctgaaatgtggtcgtgggaagaaagcaaatgttcgaaatggttacagcacatttatacaattcactacagacgttcaacaaaacagatacggagaaatgcaactatttacttccattcctaattatttcaatatttaggttgccccaaaaatcaaaaaaagacaaaattttaaaaatcttcccactgggaaaacagaggcttgctgtctacttgggattccagtacaatttgctattttgttgttttttttcttttgagacaaggtcttgctctgtcactcaggctggagtgcaatggcgtagtctggctcactgcaccctcaacctcctgggctcaagtgatcctcccacctcagcttcctgagtagttgagactacaggtgtgagccaccacaactggctaattattattattatattttgtagagacaaggtctgtctatattgcccaggctggcctcaaactcctgaacaaaagtgattctcctgccttggcctcccaaagtgctggattacaggtgtgagccactgtgcgcagcctcatgctgtattttaatgtctgcataaaggccaagtgttgttctgggaaacagagtagccgcaagccccagggagttatggagcatttgaaatgcggctggctcgaatgcagccacatttaatatagggtaggggagacactggattccagagtcagcatgagaaacaaaatgtaaaatatcttatcaataattttaacattggttaatgctaaaatgctaataatattttagatgtattggcttaaataaaatgtattattaaaatcgatttcacttctatttttcttttttagtgtgtctaatagaaaattttaaattacaaatgtgattcccattatttgtctatgtacagcactgttctagaaggataacagcaaacagatagcaatagttacctggggatagatttagagggaatgtggtcaaaagagaattttcctttttgaaatatttgatttttttttaacaaaagtcagaggagcccagttaagaggcccagtgctgtagcagagtgcctgaccttgaacaagtcacctcacatctcagcatctcagttttcttgcctgtaaattgggataataaaagtacccaccacagagggttatatacagatcaaatgcgttattaacatctaaagcacagagatgactgacacagtcctaataaacgctatattattaaataacaaatcttactgaatgttagcaaattattagcccaaggagaacatgttcatgaattgcttctttaattaagaaacaataataaattgcgaaatacagagcacaaagtttgaagacagagagcattgaaatcccagctcttccctttctaacgagatgaccttggccaagtcactttgcatctctgagcctcagtttcccccatgtgtaaaatgagggccatctagctcataggatggtcaggaggattcagaaagatcacacacagaacacacttggtatcggtagaagtttgtaaaatgctacttgctacattctctccattattacgaggtatttcttattggtgtgataaccggatgccatgaatgagggctgccaggcccacggtgattggcagcccaccaatttaaaccagattggtgtatctggtttaaatcccagagtccccatgctatgtagcctcggctgagcccctgcccatctctggacctcagtctcctcatccaaaaaatgaggacccagacttgaatacctctcaagttttttctgggaaagccctctaggccctctagatttgggggcatagtacagagaggcccccagaagacacatgtctttaaagtcttgtgttttacctttgaaatgcatcagagttttgcatcagactctgtgattctttgatataagaatgcctttttccccaaaacaatgttcaaataaacagccccccaaaataatccagtaaaataaatgttccagacagaagcactatgcttagctagggggtctgtttaactgtcccctgcccccaactccctactgtatgagaaacaccagactcaatggcctaagggttctcaaaggattaactttcttttaaaatatatttatactttaaaaagtgaaggaagaataatgtatgcatacagaaaaaaaagaagaaaaataaagaatctaagagttcaagtccacatcttgtaaaaaatgattttctctccaccccttctcggccttcccaaaggcaaaaatctatacatactcccacatttttaaaaatggccgggtgtggtggctcacaccggtaatcctagcactttgggaggctgaagcaggcagatcacttgaggtcaggagttcaaaaccagcctggccaatgtgatgaaaccccagctctactaaaaaagtacaaacacattatccgggggtggtggtacgtgcctgtaatcccagctactcggggggctgaggcaggagaattgcttgaacctgggaggcagaggttgcagtgagctaagatcgtgccactgcactccaacctgggcaacagagcaagactctgtctcaaaagcaaaaacatatatatatatatataaaatgtatgtatatatagtgatatagtataccctctgcctgcagcttgctcttttttgtaacagtagatttcattcactaccagtatgtcccactctgttttagatgcatagatggcctttagatgaatgcataatttatttaatcagcccttactgatggactttaaattgtttctagcatttgcaattataagcaatgtgacaatgaatatgtttgtgtatctgtagacatgtgcaagcatttatgtaggataaattcctagaagtggaagtacaggatcaaaggaatgtgcattttattttatgtttcagcaggttctgccaaaagaggctgcaatgcttcaagcaccccacagcaatgttcgggggctgctttgcccacatgcctctggtcccaattaagatgagaaatcaccgtcccacattgccacctgctgctcatattgagaaatgcatccttcctatagccagcccagggctgctcccagagtgatggggggagttcctctgcgtctaatcagactcctctggagcatctgtgtggaggaaatggtaatggagaaacccaatttttcctggggaagcaatcagtgctaggatgtggcaggtgctttatgcacaggattttgcagacagacagaccaagtttccacctaccagctgcatgtctatgacaagtgatctcacctctctgagcctcagtttccttatctgcaacatgggtatgtgaataacaaccttccagcatggatggcaagatttgataagctcaaatgagttcctctaaaaagataataaaggacacaaacagccggctcataaacaggaaatgcaaatggctactgaaacacaaaaaaatacaaaaattaaccaggctcagtggcacgtgcctgtagtcccagctacttgggaggctgagttgggaggatcgcttgagcctgggaggtcaagattgcagtgagccgaggtctcgctactgcactccagtctgggtgacagagcaagactctgtttcaaaacaacaaaaaaaccacacacacccagagatgtttcatcacagtagtcagtgatatgccacatagagccagatgtccttttttccatcagattggcaattatttaaaggctgataactgcatgttggcaaggttgtggtaacatgcaaattaaagcaataagttacccacctctgcccatcagattagcaaataaatggaaagattgatggcatctggtggagcagatttcttccctttaggtaggcggatgaattgctctgtggttttggaaatgatgtggcagaagcagataaaaattttaatgtatagggcctttgacctggcaaaaccacttctaagaagtgggcagagagaaatgaaataaccagatggtagaacagatacaagtacaatgaaatggtataaaagcaaaaagaaagaaagatagaatattgacatctgtcagagggaaatggctaactactgaaacagccatgtgagggctaaaaaaatgtattggttttttgtttttgtttttgttttgagatggagtcttgctctgtcacccaggctggagtgcagtggcgtgatcttggctcactgtaacctctgtctcaccaggctcaagtgatcctcccacctcagcctcccaagtaggtgggattacaggcgcttgccgccatgcccggctaattttttgtatttttggtagagatggggtttcgccatgttggccaggctggtcgcaaactcctgacctcaagtgatctacctgtctcagcctcccaaagtgctaagattacaggcatgagccaccgtgctcggccagatgtcttgtatttttaatgttaatttcatatccttctactttgctggattcatttattgctggagtttgttttattattgattttctggggttctccaggtacaatatcagatcatctgcaaataggaatagttttacttctttacccattctgatgtctataattggtttctcttgtttaattgcatcagctaatatctctaaaagatgtttatatcaacagagaagaatgtacagctatattgttaggttaaaaacaggttgtaaataacagatacaatttttctttgtaaacacagagacactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcagagatattccagagacctactcaaatgcaggccctgaaattttctcctaaaacatctttgcaggcgggagcaggctttcttcccctgcctttctcctggctgtggccggagctccccagcgagccaggtgttattcctggcagctttcctctttccccagaaaagtcccaaggaggcgcagacaaaggcaggaagcccggagcccaggcgcctgacccctgatgttggctcctccagccttgggccctcaatccaactcaggccgtggtcacattccagggtgactcagcctgcagccagcgggggcgaaggaggctctgttttggggactgtgggctctagccccacccacggacactctcacttttttttaggtactgccaggccctggcgggcagggcggtgggccctgacctttccatccccggctcctgcccacacagccggtttcctgcccaccctgggtcagatcccaaggcatcttttctgatttccgactggagccccatcacatgggttcctctaaaaacggcctattcctcactcactgacccctgtcgcctgccctggatctctctcccacttgaccctttgtgaaccagggaaaggagtcaaggatgggatgtcacccgcctccatgccccctgacgtatcgcatcttcactagatggaagagccatgaagggagggcgtgttgttcactccagcactcagaacagtggctggtctgaatgaatcatgtatgcagtcggtgctcaatgggcagcacctgcctcccagagttgctgagagggttaagaaagccaatgcaggttaagcacttgacacagagtccatcttctagattgtccagagcagaggctggcatggttcagctgtgcaatgttgggtagactgcccaacctctctgttcaatcatttcaactcaatgcagggccttaagctctgggaggatttaatggggaacaaaagggggcttagttgcacaggtgagctggagcaacccaaaattctgtttaacctgcttaacccattcttcccccagggctcacccacaggcctccagggttttcagtctgccattaacagggtttcccagatgctcttccatacctgccccgcactgctaccactgtgcataaaaagcacgtggccttgccctagtttttgttttctggtttttgaaatagacacaaattcacagaattatttctcaacacaggaaaaaacagcagaggaagtacagtggtaactagaatagctgcatgctggagaggcaatagggagtagtggggactgtggcaagatttagagagggtgctaccactgagtcccaggaaagtattgctagatcttcccatttttcagaagaagttggaaatctagatttttgtgtatggaatcccccaattttctccccatgtcccacacagcacaaacccagcccatccagggctgaatccagtcacggaccactgttgggtgacctctggtcagtgcatgttagaatgagacagatttatttgtgcctacaaattctgcatcctgcaagggcccagaccagccactgggccacagtgaccctcgcttgatgccactatgccttccggacccccagaaaaggagcctcccaaccaagagatctctctcagtgctccctgtggtggtcacacaagcccaaaggaagagatgcagtagcctggtgatatggctggggcttgagagaccacctccatgagccacctcgaagtacagataaactgaggcctgggaagcaggaagaatgcttctgatactcacaaggcaaatcaattagtttcaaggggcccacaagccatactcctaactctcagctcaccaccctcatgttcaccgaatggggctcgaaaattcttgctgtaattgcagaaatttgaatttgaactgggaactacatgacattaagaattatctttttatattctcaggcaagaaaatagaattgtagttgtcagttttatatgcattctgaaatattcaagggtggaatatcatgacatctaattttttttttttgagatggagtctcgctctgttgcccaggctggagtgcaatggcgcaagctccgctcactgcaagctccgcctcctgggttcacgccattctcctgcctcagcctcctgagtagctgggactacaggtgcctgccaccacgcctggctaattttctgtatttttagtagagacggggtttcatcgtgttagccaggatggtctcgatctcctgacctcttgatcggcccgcctcagcctcccaaagtgctggaattataggtgtgagccaccgtgcccagcctatgtctaatattttttaaataatgttaatgactgtcaaatcaaggtataggtacatggggcttcttaccgtattctttttctttttctgtatagttgaaatgtttcctaatttaaaagttttaaattaaattctaaaggtaaagacggagttgctcactcccagaagtagtggtgtcttactgggataagcatgaattttggaggggcctagatgtggagtataatttttgtatgaccttgggaaagtcacttcatctttttaaacctcagctgtatgataagggtgatggaaattacctcaaggcttggtcaggataaagaaatgagacaagggagctggagagccttgcttattttaacccaaactggatcaccattcagacggcatcagggtcacccacttgtttcacttgtttgcccttttttttttttttttttgagatggagtcgctctgtcgcccaggctggagtgcagtggcaggatctcagctcactgcaacctccatctcccggcttcatgccattctcctgcctcagtctcctgagtagctgagactacaggcgcctgccaccacgcccggctaattttttttgtattttttttttttttagtagcgatgaggtttcaccgtgttagccagaatggtctcgatctcctgacctcgtgatccgccctcccggccattgtccttctttaagaattttttgcttgtagttgcatttcttagtatctaaaagtcacatggttctaagacttttgagtgttcagattaccagtataatgtgtgggaagactgagaattcattcttcctgtgaattaaaaattcttgcaaagccaggcgtggtggttcacaccggtaattccagcactttgggaggctgcggtgggaggatcgcttgagctgagtttgagaccatcctggacaacatggcaagatgccatctctacaaaatttttaaaattaactgggcatggtggcacacacctgtagtcccacctactcaggaggctaagatgagaggatcacctgagcccaggagttcaaggctccagtaagctataattgtacactgcactccagcctgggccacagtgtgagatcctatcactaaaagtaaaagctaaaaattcttacagcccagagttttaatccagacagaccttgagcaagttgcttagcctttctgagcctgtttcctcctctgtaaaatggagataaccagagtgtccctagctgaactggaaggagaaagtgagattggggatctaaactggggtccccagggtccatgcacctaccctcaagctgccagtgaccctcattcccacacttctccccactacccactgttgacccttccaaggtgcccacaggtataaaaatcaaaggctcagcagggcgcggtgactcacgcctgtaatctcagcaccttgggaggccgaggcaggcagatcacctgaggtcaggagttcgagaccagcctggccaacatggagaaatcctgtctctactaaaaatacaaaaattagctgggcatggtggcacatgcctgtaatcccagctactggggaggctgaggcaggagaatcacttgaacccaggaggcagaggttgcggtgagccgagatcgtgccattgcactccagcctgggcaacaagagggaagatccatctcaaacaaacaaacaaacaaaaaaagagcccataacgtattcacatgatggaagactccagagaggatcaaaagaatggattcgatctccttgtagcaaaaagatctgcttgtagcaaaaagaacagatgtcaaaactaaaatctggagtgaaaagagcaagcaacataatgtctgaaaacatttctatacagtgtattgagaaagcctgacaggaaaaataattcatttcttccctgagacatttattcactgtctttttcttttcttgttttaaggcaaatgattgactacacagttgtaaatttcagctgaaaagatgtctggaggttgaagaaaaatacagtgagcttattgtttgaaaattcaactaccatattgtttaaaaatcaaaaagttcccaaggtttccggaattttcagacacgaatgtaaactaactctctcttacgtggctctgtattagctacaagctcatgtctatgtatgtaagagtaatttttatgtaagagtaatttttaaaacatctgggagactgaggaggtatgaaaactaaaggcaatgtggtaacttggggccggatcctggaacaaaagaggacagtaatgggaaactggataaaatcccgtgaagtttgaagtttagttaagagtaacggaccagtgttggtttttagtggcgacaaatgtcccataacaatgtaagatgttaacaatagggaaaacggggtgagagaaatacaggaactttttgtactatctttgcaactttctgtaaatcccaaactagtctcaaataaaaagtatatttttttaaatatggaaggttctacccagactcagcaacaggagaggcccagagagggagagaggactagacttcaggggctgggggagggttaaggggcttcggtcttacctataacaggataaatatttgtgttaagtcgaatgtattcagctattccttatgcaattcaagttaacttaaaaaatattttatgaaaaggagagctacagctatctccttgatttgaggctgtctttactttttctcctaaatcacagatgctcaatggagctggaaaacctttgggaccaggaggctgtgacatctgaccctggctccgttctgtccaggctgtgggacctcaggggaaggtagagacttcataggcctcagtttctccctggcaaatgaaattactaagcccaccgacccccgtcttccagacggggaatcccggggtgggtggttccagggcatgatcaagacatcccccaggggctctacactccgctggctcaacactcccatctgtgtaatgggttgaggagcgaggctatccctataggactgccgaaagcaaggcagggtttgacagcgcgtaggtgggtgccaggtgcaggcagaggctggagagtggagagcgcttcttccacccgggccacgcagaggctgtccccgcacggctccccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggctggcggggctggcggcctggcccactcc

SEQ ID NO: 369 - DNA, 791587 bp, Homo sapiens
gcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgtaagcgccgtgcgtcgcgtgtgctgtcaggggaagggggcgtcagggcatccactagcggggtccgggcagagtgacagcgggcagcggggactcgcgggcggggcgagggggtgccccctgaggatgcgggaggagcgggcatcaccaagtgtgtgcaggtgtgcgtgttggggcgagggaaggcaagggcgcgtgtctgtgcgcgcgtgtggaaagctagaggatggagcgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcccgtgggggcgcggggagcggcgggaactcgggctgtttctgggaataccgccgccgggaggtttcttgggctttcgggctggacccgcgcgttgtcacggagcgaagacgttggttcgcttactccgtgtagcgtgcggcgcagctgaccgggggcgggggtgatggtgcaggacgctgcgcggaggtttcccccaagtcaaggtgctgcgaaagcggaggaggagtcgcctccgtggtccccgcggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggctccacactaatacaattctttctccttaagtacctcttggcactgctccttcctttctctcatttgttcgaacactgcagatacttcccaggctgaggcattgcacacctccaagctgggactggagagcctctccagaaaagaaaatgccctaacttcctgctaataataacctagttagcatcctttcagtcgttccttctccacttctgtcctccttcccgaaggatgttcccttgcaggattccccagacttccccaacctagaactgcagcttctgctggtacttctttcctcagcagtacaaaaacaaaacaaaacaaaacaaacaaacaaacaaaaccacttcccggttacagttacctataatcacagaaaatcgtagatacggtggaattttggaatattaacttttaggtgtgaaaatagtcttgatgtatttgggtactaaacatatgaaaacagcgaatttgcaaaggaacgttgtaaacgactgtctctttctcttttgtgcattaaacggactgggagaaagctttgggaaggataaaaacccagggtccacatcagatgacaacctaatagtaatccagtctaatagctgcaggttatgcaccattgcatatgctttttgaagtactgttggcccaagaccgggcttggaagagcctcttcactaataccttggtcacggtgtataaacctgctagtaatacagttgtctttttcatagaaaatagactataagggtttttttttttttaagtaattaacaccacattagatttttctcaaaactaaggactattttattcaggtggacaaatacggttgctgtataatttttcaatcaattcgtatcaaactctgtggggttaaaactagctgggacattttggtaggcttcatgcactcaagggcttcctgcgggcttaactgttaagccgagctcatggaggtggtgttatcagaatgcttaatggggaccgagggaacgtgctggctgatgaggttctgcacatatcaagtaatgtcaactctgtgccactcagcagctgcctgtcagctagagcagcacctttgataagtgggtcctgggtagagatctggcagtcccaggctgggatttttcttttaataaaacatccgtaggttgctgtgctgacgacaaatgaccttgaaggaggtgacacagtggagcagggggatttttttttttttggtatagcattaacatctaaaaggaaaacatgcctttcctcacaattttccaattttcatatggaaattctcaaatcctttaccggcttctccacccattaccctccatccttccctcccccaccccccttttttttctcttaacctgagaatgttggtggttcagaaatgctgatggggtgaataatggggagactgtagtatagttcccacattgaagtcgcttcttttttttctgagggcatttatttctctgtcatgtgcaagcttgtcaatatgagttatttcttcttcttcttctttttttttttttttaaagcaaatagcccaaggagtattaggaatctgtacatcttgataaaacagttgtagatggaagaattcttgatagtgatggatgaagctgttttgcatagaaaaacaaaaacagtcattaagacaccgtaattgtgaatttgatgggacatttcatatgtcctgattagaacatctggattattatcttgagcaggtcattgtctattggatttgtattcagcaccccagcacattgaggcatctttttgaccactgtccacagaaagcttttttgcttttctttttttagaagaggtgtgagatcactgttaagggaagtagaggtgaaatctttaatgggctgtatctgtgagttatgtatgctgctgtaaattaattcctcatttgcaaaggggtttgtcactgtttagcttgtacctgtctctctggcatctctgttccatttgctgctgcttgtcgagttggctcacattccttccaaatagttatgtagatgaatgatcattgattcagtggctcccccatctgttggaaacctgcccacttgggtctgtttatctttgagagagattgaaaatatgtttttgtaaactctggatatgctgggacacttattttatgagagaaaaatcctatcataaaataagctgtcagcttgtaatggattcattcactgtcatatccaaacatatccatgatttggaatgtgtgttttattttaaagattttattaacttaccaatgtagcatcaaactgtcatttggcatttaaaaacacgcatctttttcgttatggtcctctttttttttttttttccaacaatcatacagaatgttatagaagatattcctctgactttaggaaaaccatggtataaaatgaccttggtcaaggttttttttttttttttttttttttttgagtactttgtctttctttcatttgtctaagcacagttgagttacccttgtggtgtactgtgtcatgtagttttgtatttacccatagattgagacttaaagcttagtcctggctgtaagaatgatcctgataggaatgcttacggtcttcctcctgtcttcttttgcagaatgaagtatttcattatagatttcttctcagtgttcatacatcttgttccacaatgacaagaagcatctttaaatatactcatctacaaatggtgacaattatgcagtatagatgctggtgtacaacactgcatagtagtttggatgggaatacttagccctagtttgtagaggtccaggaaggttaatggtatgaagtcagtactcagcagtgcagaacgaggactaaaattcaaatcttaggctaatagtgttctttccaggagagaaaggcttctttatctgctgttcaagtatgttttaggtttatagcaaaagaataccaagtcagttttctcagctgtaggaatgtcacagagtacaaaggaaaagatggaatgagcagtggaaattcgcactttttgctcccttcataatgaagctacgaggagctttagatagatatgcactatggtattttcccaaggaactgatggaaagcccacccaggcttacatcatcagacttattttattttaacttagaaattagcatgtacacattggcaggaagggcaagatctaaaacgcttagggcactaatttatttgacattcaattgtatttgtactttggcttcagataagtgtttttatcacggctgaattacccaagaaaggactccagcagcactgggtgactgtgcttctttagatagctttcgggagagagggagaggtgatgaagcacacatttttcctgaaactctgacattgtgggaattagattaattcagaaaacatttgttgaacaccgtctgtatgcatagcatgttaaggaagtattccaaataagtagggaagtggtttgcagctgtaattgcaaagaatagatatagaggatggcatggagcaatcagaaggaaaaatgcataaacaaactccaaaacattagggtaggaagaggcctttagaaaacattaccctgtccaccccatgcctctctgatattgcagataaggaaacaaaagctcagaaagccaaatgacttggcccagtgtcacactccaagttagtggcatttagtaatggagagtatatgaaaatctgtgaagaatttccagaaaggaggtttaccagcacatcattctttatagagtagatttaaacccacttttccattttatccttaacttgaccttcatagagttctgtctccaaatctgtcctcttgtccttccagccagtgaaaaggaggtttcttttgtcttttctaatgttacagtccctcacatggcctgaatcttggtcctggaagccaagattggaatccatcctttctagcctttttttttttttttttgcctccctatccacttactccttctggtttatcttgaagcctgttaatttctcccatcttaaaatgtctgtctttgacccggataccttatttggttgctcccctcctgcagaagtggtcttctcccactgcttgtacccctctccatgtaattatctagcttctcttccttcttcaatttactttccaggatgttgccagtaactccctccttgccacgtctaaatgtccctctctgtccctattcccttagattccttctcaagctctactaccctgactttcctttttgaagctactcttttgactttggggacatggtaccttctgggtaattttttacatttctgatcatgctttttccaggtgcttttcattccttttactccaagtgtgtggttatcccaaaagattctgtcctatttcctgttctggctcttctgccttcatgagcttatctatgtcacaaaatctgggatctcttgaataacagagtctgaaaagacttaacaatgacttcatccagctctgagagccagagagatgaaaggaatgttcccaaagcgactcttttttgtaggagaaacccaccgtagattcgacagccctgggccttcacttcaagcctctgtttagacttccctcttgcctctcggaccccagaaacaccagcttgacatcattgcctgttcggttccctaagcgactttccttcctagtgtctctgctgatcagtggcactgccgtttgtggctgtggctccagtgtgatcctaaccttcagaagacctgagtctgaggccggaatccaccagcacctagctttacggacttagaacaacagtgcctggctcatgggagtggctcaatgcatttgtctagttctctttcttctcttctgcatctaatttgtcatcatagcccatcgtgtttctctttgcaatccaactcagatttcgatgtgtttcatactccgttagcttcttgttctgatcccagtactcatttcaaccttcgtcatccttcctcctgcaacaaatcggcaacccacctagaatccgcctgccattttagtcctcctgaaaccctcgtgtccatctcccagcctcagctcacatccttgcatatcctgtctaatttctctacttggccttttatgatctgccccttgataccttgcttatgcttttcatcctacacagagttttcttggatcactctaaccaattccgattttacctttctccgaccatttatcactaataattaataaaatgtatggaactgattgggaaactcaagcaatggtcagagaatgctctgaccctgatgctctgtgggtgagttgggaccgtgttgggcatcggtttcccatgatgcttggtgcactgttaactacaaggacagacttgagagaaatcttgtggcaaggagaagatcgggacaagagaaaggatcctcctgcccacaagtttaatgtgaacatcacttgaatgcgtccaaatgcagaaagaaggaacctgctatgaaggaagtaggcaaagatagtgggggtggaagaatagaggtaagatctcttctggaagcagaagagtaggagtgttggtgggtgaaattctgagatgaggacaccggaggtgtgtagggtgagagaggccaggtgatgattgctgctttgggaggccgcagtggctcccaggtccagtgggaggggacacccggagaaggcaattagagagagggaagttacagtcactagagcaaatgaacaaaggagagtaagagaataaattaaggattaattgagtctgagtgattagggctgcccaaaagaaatactggtttagagtcagaagctgtatttcaaatgagcagctgtcagggggtgaggtgacttccaggggcactgttagagtgtccagtggatcagtttcatccccttactttcctctttattaatcacgggaagaacattgggatgaggaccctgccaacaaatggttgtgtgaccttggggctggtggggtcagatagagatttgtttgagagaggtaaaatggggaggttgttttctcagagggacttgcggtaatttccattgtcatgttcgtagtcttagggtcaaccagactcaaaccattctgcaggatgagcataacaaaatctcaccctgggactggaaagaaaagctttgaatgatcctggggtccctggaaatcctcatcctggtggattacaggccctgaaagctgacaacaagctttgagccaggattcttgatgatgggtggttttctttcagggaagaggagatgttaacaataagagaagcttgcagacaggcatttagaaggagctaggagaagaattctctcatgtcagtagccctcttagggactacttaggttcggatccatttagtaactgaactcctagtgagcttgtttgcaaatcctctctattgtcccagccgtgaagtacttctctggcttccatagttaccttctccctggctggtgaagaagtggcccatgtttctggggtttcccagaatgttacagtcagcctcaaagcccatgtggaaggtatatttcctggtttctattgcaaaagttctgtagtggtgttgctgcaatgaaatggaagtccaaggcattccctgttagtgacggagtgttcagaggacctacacgtaattgctttcatgttcgttacccaagtaggggacagagagagaggagccactgacacgtgaacccagggagacctcccctggatggctgggtgcaggtacttaccacccaccaaccgatgatgagtatctgccaatttactggaagaaaacctgaaatctagctgtggagccaagatagatgcagaagaaagcgagtggaacaggagaaagtgtataggaactcagaggctggcagggccttcctgagtctgggaagggctgaggcgggaacgaggacacatttgctccctgggacacgtggttcttagtgtgcaggggaaacccgcatgtggtcactgagggagaggcacaggcccacacatctcatcaccatgaaggaaggaacaattcaatgtggccaatttgtttttctactatggcaagcactttttttcctttaacatttttggtattttaagagtttttgcacatttattctgcttctaatgaagttttaattgtttctctttcctcctgagtttagaatctgattcataatgtacatgggaacccatgaatttcactcatatttaatgcataaccaaagatataaactgaaatgatacattttgagaagatcaagaaaagaaaaagaaagcttacaggaaaaatgatatccttagtcttgagtcaattgggatattgttaaaatgaagccgaacagcacactgaggtgatagccactagaagttgtattctcttcttttccacagcaggtttctggttttcaaaataaaagcaattatgatttaaattcttctagcttttgctagagtttatatttatttcataatcaaagaaactttacatgaggaaagttcggtctcacacacacgcacacatgtgtgcacaaatgaatgaaagatattccaccatattttttttcaccaattttgactgtggtgtagaattcagttaaattagttcatgtgtagcagtgaattgtctgttgatctctgttatttcttccagtgctttggggtttttatttttatggttcctttccctttgtctttccctttccctcccctcccttcccccttccctccttttcccttccctccctttccctttctctccccccccttcctcccctttccctccccttcccctccccttcccgttccctaccctctcctccccttctctctctctctctctctctttctctttatctctctccctcccctcccctcccctcccctctcgtcttctctcctcttctctcctcggggctcatgagtgagttacttttgagagatgctattttgatagtggcaggaccagcaacaaacctgtaccatctcagcattcaggaacaatggtgtccacatgtctttttgaggttgtacagggcattcttaaggcacatttgaatagtcccacaggctgagaggagttcctctgatcttaaatacagcatcagcctgaggagtaaccatttctagtcaggagatcagagcttttttacgccgtggcctacctactgctgttggcaactttatttcttgtaggtgcattgatatgtaattgtctggcaggtctgttctaagcattgcatgtgtattttctcatgaaatccctagaaaatccctcagaggtagctacctgcaaagaagtgaagtgagcccagtgtttgcagacacaggcagtggagcgacagtttcagacctgggcaggctggctctagaactctcacttaatcttgccatacaggggccctttctgctggagatggacatattttaaaatgagagggaaacttggtgccctgcttctacctgcaggaagttactttataatatcaaatgtgaatttcttacattaccagagccttgcaggctgtgtgccacatcataggtcctgtgtttaatgtttgtggaattgcatcgaactgattccatgagatagtattttacataataaatacagagtagggtaattatatgcagtttactagggtaccttaatgcagtgtgtgtgaacgggatacctcttttatctgtagcattataccaggtacctaagagataccatgaaggtggaagccatagttcccgtagagttcagatgctcaaacagtgaaaccttatatgcatcaacctgggaacagtaagcttatggttctagggggattgtgtcctgtgtaaaattcagagggtccaaaaggtgaagagatgatggatgtggtcatgatattgggctccaaaactcacggagtaaatggccaatggtgaagtaaatggtggtaaaagcagagattctatttcattataaaatatgaaaaaaacatgaaaggcagaatccagactatagaacaacatgtaaggcaggaattaaagtttcaatgaaatgccgccttgatctctaaaagtgctccaaaatctcttttgtagcgtttcaggaaattttgattcattttatttttgaaacagttgacatttgggggagtgggctaagggatgaaaatatgttttaaagtgcttgtttttttaaggacaatattttcaagaactgtacttcaggagcatgtcacagttatgagcctgtaggcaagaacagggttttttttttcctctccttttagggaagaacaacatattgaaggatgattaagacacttgaaaaatgtaacagaaacatacacacacacgcattgcatacacaggatccaatccctgatgccctttgcctctcttcttgttttatttcatttatttatttatttttagacagagtctcactctgttgccaggctggagtgcagtggtgtgatcttggcttactgcaacctctgcctcccagcttcaagtgattctcctgcctcagcctcctgagtagctgggattacaggtgcccgccaccatgccaagctaatttttgtatttttagtagagatggggtttcaccatgttggccaggatggtctcgatctcttgacctcatggtccgcccacctcagcctcccaaagtgctgggattacaggtgtgagccaccgcacccaacccatctcttcttattttttagactatcccgttagttccctttggtcttggacatgtctgtcatgacatgtttccaaggccaatgcccacagctgggagtcatgatcagcttacacgtcctggcttgtaggttcgacgaaacgtcaggagaacatttcttcttcagacaaatgaaaagctgagatgaaacgtttttgattgatggctgtcagagaagcgtaaaaacttcagcttcactgccattccctttgtgacagggaaggggccatcatctcctgaagatgggggtgtcattattaagtctaaatgtcctgctcccgtcatgaagaattgcatcacacagaagcctgcaaagtcagcccgacttgagtcagtcctactcacaccaaagaggatacggaaactggtgaaggataagagacaattgtgatttcacctcttcctgcgccagcgcccggtctcttctccttcattctgaaatgttcgtggactgcctgctacgtgccatgcttcttgctggacttatatccacgcttgtcctgcctttaaagagcttattctgtctctatgggtgggatagggaataaggaaaacgcaaatattctactacacagtggacataacaatcagaaaaccgtcagaggaaaggatgttgaggagggagggatccgtgtcccaggagtaccattatctaaggcttggtggaggaggcagcatttccagtcacagaattctcagactgaaaaggatcttcagggatcagggtctaacccctttatagtgaaggaacatgaaaggacaagtatattggcccacattattccgctcagacaggatagctgcaattcatttgattcctggaacaatccatttagtctataaagcggttaattgcattaatacagatcaggaaactgagttgcaaagaggtgaaatgacttgttcaagggcaattaatgagtaagtgatgttgctggcgagcccagggttttcagatgccaaagcccttctttctccttcctccctccctccttccctccctcccttcttcccttctttcctcccttccttcctttttcttccctccttctctccctccctttatccatcacttcctcccttccttcccttttcctccctccctcccttcctccttcctccctcttctcccctccccgcctcccccctccccccctccctccatctgtcaggaaaaatggtaaaagactgtaaattggattataaggaatgatttatggctgtcctatcacatttgtccatttaggttatctgtgcttttcacttgtctgggagctatcttactgctcttaaattgtggaaaactgatagtaatgattcctgaactgttgattcttgattatagaaaatgcaaattgtgtctactagaatgcagttgtagataccgagtgggtttattcttctcaagcaaattcatctcagccttcctgatgggctgatatctctgtatgtcctttggagtctcctttgaacctgctgtgataccacactggttctttagtgaagaaattaaataaaatctttgatgtgttcattttgtctttgtttgagtcgtatttttactttaaaaaaagttaccttcaacaccactactatgcctcctaaagtaaaagtgagtgggatcttgctgaatttgggtggggagggcaggaagacaggacagatgaaagaggaaggtgagtgggggccatgtgttgtttcttctgtctccccatccccagggccactttccagtcttctctgccctgttctatgttcaggagcctcctactctagatggtgccgggagcactgtttcctttccttgttggctcagatccagggctggggacagtttcccactgttgctggtccctagaagtcccacctctgtcggatcctgtcacgctcccagcccgcaccttggtaaatgatccctcattcacctctcttcagttaaacccttgagagtgccattcccttccttgatgagaccctgatgcgaaggcgggaagcacggtgacacgtttgggagagagatgacgggcgagtactgctgtgtcatcctggggggactggggagccctgagaccagggtcagggatttgttcttaattcataaggtaaaaggggccctggaagttattcttttttctccttctcaagggagaaaaatgggtcagagctgtccattagaaagattaatggggcagcaatttataagataaattgggatgtagagagatcagagcgggaccggagctgagaagcctattaggagacagtcaccacggagctggtgcaagataattcgggcctaaatttgggtggtagttgtgggaatagaaaggagcgggagctttaggacacagtggagaaagggtttatggggttggtaactgattagatacaagaagaggaaaaagacaaagctgagcttcagatggtgttggtcatatggaaatcaggaggaaggggaggtttcaggggaaggcagtgggatttattttggatgtatttattttgagatatgttatggactgaattatggctccctaaaaagtatgttgacatcctaatccccaggaccttagaatgtgaccttaatgggaaatagggtctttacagaaggaatcaagtgaaagtgaggccattaagctggcccctggtcctatatgactagtgccctcctaacaagaagggattaggacgcaggtccacacagagggaagatggtgtgaagatacacagggagcacacctgtgaggactggagcactgcacctgtgaggactggagaccgtacttgagaggactggagcactgcatctgtgaggactgcagcactgcacctgtgaggactggagcactgcacctgtgaggactaaagactgtacctgtgaggactggagcactgcacctgtgaggactggagcattgcatctgtgaggactgaagcacacttgcaaggactggagcatcgcacctgtgaggactagagactatacctctgaggattggaacactgcacctgtgaggactggagcactgcacctgtgaggactggagcactgcacctgtgaggactggaacactgcatgtgtgaggactagagactatacctgtgaggactggaacactgcacctgtgaggactggagcactgcacctatgaggactggagccctgcacctgtgaggactggagcactgcacctgtgaggactggagcactgcacctgtgaggactgcagcactgcacctgtgaggattggagcactgcaactgtgaggactggagcactgcacctgtgaggactagagactgcacctgtgaggactggagcactgcacctgtgaggactggagcactgcgtctgtgaggattggagcactgcacctgtgaggactggaacactgcacctgtgaggactgcagcactgcacctgtgaggactggagcactgcacctgtgaggactggagtactgcagctatgaggactagagactgcattgtgaggactggagcactgcacctgtgaggactgcagcactgcacctgtgaggactggagcattgcatctgtgaggactggagcactgcacctgtgaggactagagactgcatctgtgaagactggagcactgcacctgtgaggactggagcattgcatctgtgagccaaggagcactagggctgagagaggcatggaacaggttccccctcccaccctcggaaggaaccagccctgctgaccccatctcggactctgggcctccagagctgagagataatacatttctgttgcttaagccacccagtctgtgatacgttattatggcagcagtaggagtcgaattcaaggcacaaagctagaagtgtggatttagtgttttggagagaggagtgacccagtgaggcagattggaggccactggtgtgattgagaaaccacaaaaatggaccagatgatctgggaggagcatgtagaggagtcagcaacagaggctcagacgaaggtgactgaggaaacttcttttttttttggacggaatcttgctatgtcgcccaggctggagtgcagtggtgtgatatcggctcactgcaagctccacctcccgggttcaagcgattcttctgcctcagcctcccgagtagctgggactacaggtgtgtgtcatcacgcccggctaattttctgtatttttagtagagatggggtttcgccacgttagccaggatggtctcgatctcctgaccttgtgatccacccacctcagcctcccaaagtgctgggattataggcgtgagccaccgcgcctggccctgaggagacttttgatgtgatcattatgggagtctctgcgaggaggttgaaagtagactcccgattgccagagacccagaagcaacagagcagcagtaaatagaggcagatgatatagacaatcttttcaccccatgtgctgaagaggaagagaggaggtgggagcttgaaaggggaggaagggtaaaagttagggatgcttttcttttctcatgaaagagaccataatctaaggttgtagaggagaagtggtgattgatgttgcaagttcctaagtacaagatgggatagagatgccccccagccccaccaacacacatcaccattgttgggcacacgcctaagctgatgcatcgcctctctttgcagatacctaattactgcttttcttaattcgagagcacatacgattttcatttgcctttggtttagctttgcatcatttcattttctgctagggaccttttgatcattaaaattagagctctataaagctttgttggttcaaagctgggcgtgttttgtttgcaatttgcagtggtttggtgatgaaataatccagctaggcttgaagcaagcatgtctcattaagacaaatgggagaagctgatattgctggcgggttttttctcatagctgttaactcaaaaagaaggtagggcttatataggtaattatgtatactattaagcaaatagtcagtctagggatatattggagggattttctgaaagctcaggtcaggggaaaatgttgaaatatcttaggaaacagaatgattctgctggtagtgactgccctcagctctcctactatgataggatctggctaagaaaattccagtaatttttcagaaaattagcaatttatattttgagagttttttcctccacatttttgtgtaattggcactatgctgtacatataatttgttgcttgcaaagcactgtctttcaaaaaaatctaaccagtaaatctatacagtatttacatgtgtaaattccacatttgttccatacttcacactgttgatttaaaggtaaaagctttcaacaaatgtctgcacttaacaacagagcatatatcttcatctcttttgtgttctgaatgagcacctataacactttctcaaaaggaatcttccttggaggcggggcgtggtggctcacacctgtaatcccagcacttttggagccagggcgggccggattacttgagcccagaagcttgagaccagccttccttcctccccggagacttcaccatcttctcacctggttaaggtgcttagagatgctggtctggagaaggggcggggggccggggggcggggtgttcagtaacaatcaggtagcaattagaaggtgggagatagcgcctcacattttttactgtagagtgataaaaaaaaaacctgccatatctactgcttattgaacattctctagttttggtcctgactagtacattttctgcagaaatttttttttgaatttcacatgtctagcagaacgagaaatctggcatacattacaaccaaccaaaacattgctctggacaggcctaaaacaaggacctgaacgtcagtagagaatggaatcagcgattccataaatgacaccagtttcatgcagtcacacagtagggagggaacagagatcatttccgcatttccctctaaatgggcaaactaaagcccacagttttgttaagagggtgctgtgtataactcagatgccttactgggatacagaaatggactttaaaatctcggggttaataatgatgatgccattgccatctaacgtgaataatggggcagactaaaatctgacccaaacagaatctgataaataaatcaaggagaaggacttgcaaatctttgcataagagaggagatgagtaatgacaccctcttttgcttgttgttcataccaccaggagtcgagaactctgcataacttagcagtacagcttccaagaagggccctgatattgtggataaatggagtctatttttaaggttagataaatccagcctatttttgtgggcagggaaaaattattgctgaagtgtttttgataagattcttctgtgccataaactgaaatactgagagtataacagtttttcataagaggaaaggaagaaaaactactgtaagttatgggagactaaggccatgtatttatttggggattgcattaataagttttcaagcattcacttttatttagctacatgatcggctttgtggttgtcccagttcatgaagaatgccataaatattggattgaccacggttgataatttttactgcatgataatactatgaatgtattggatggaaccatgattccaatatatgtgtattctttcattcagcaaagatatatatactcactacctcctgtgtgtcaggtgtctgtagggtgctgtagacttatacttaaagcgttcttcttcatttgtgttttaaaatggtttccacatagttattaataagactcctaaatgggaaggtgctgaggctagaatctgatggccaaccaggtaagatttccttcaaagtctgtgtcaaatcagttctacatttctctacatccagtctacatttttctattttattcatagggatattaacaaggaagattaaatgctggctgaaagctctcatatttgtatccacagaaatacaaattatatataaaattatatgattactaccattatcatgattatgttcttagcctttccgaattcctgttatacgcaaagcattctacttaactccatgggtataatgggatatataatccttgcccacaagaaactattaccaacactaatttattagcctttcatagactgtttttttcccctgctaaatctttcttaagtaactttaaaggaaacttaaaaattgaagtgtaatatattaacatacagatagtaaagtacataaatcttaagtgtacagcttgatgaatatttgcagtgtgaacgcagttgtgtaactaccactcacattaatgcattgaatgttaccattacctgcaagcctctctagcaccccctcccaagagttacctgcctttccaaaggttactactctatggacttctagaaaaataaattaattcggcttgtttttccactttgtgcaaatggaatgacaatgcaatatgcactcttttgtgtctagtttcttttgcttcatttatatcagagatgcatccatgttgtagctcctggtggcttagtgctgtatgctacaattcatctatccattctgttgatagacaatgggttgtttctggtttcactaataaaaacaaagctggtactaatattctcaaatatgaaagatttaaatatttaagtgaacacctgaaataagggtatgtatacatttctgctggatatatacctatgagtagaattgctgattgggttatatatatgctcagccttctaaacacttttccaaagtagttgactcagttaacatttccactagcagtacttagtaaatgttggtttcaaaaaagtaggaatcattatggtggatgtatagagggtttcattgtgactttaattttgcatttcactgacaactcatgatggggaacacctgctttgtatctttaatgtccatttggatatactgtattcttttgtgaaatacctattcaggctttagcctgttttaaaaatacggttgttctatctatctatctatctatctatctatctatctatctatcatctatctatctatccatctatcatctatctatctatctatctatctatctatctatctatctatctatctaatcatctctctagacagagtctcattctgttgcccaggctggagtgcagtggcacagtcatagcttgctgcagccttaaactactgggctcaagggctctttctgcctcagcctcccaagtagctaagactacaagtgtacaaccatgccagctaatttaattttttgtagagatgaggtcttaccatgttgccaaggctagtctcaatctcctggcttcaagtgctccttccaaagtggtaggattacaaatgtgagccatggtgcctgaccagaattgtcttttttaaacattaacttttggggagtattttatatgatgtgaataggaatcttttgttagatacgtctattgcaaatatcttttccaacactcttgcttttcccccctctgttactgatgttgttagtgtcgaagagcagtttttcactttaatgaagtccagattatcagtttttttaaatcatggtttgtggttttttttttgtatcttctttgcctacccaaaggctgttctcccatgttatcttctacagcctttactattttaaggctgatatttaggtctgtgctcttagaattgatattttgtttatagtttgaggtagagatcagtccctccacctatggatgtccaattgatccaggactagttatttaaaaggctaccttttcatcactgcattgcagtggtacctgggtagtaagtcaggtggctgtaagcagggatatctattacttgactctcttttatttcattggtctatttgtcttttcttgttccaaatttataacttttaaattaactccagatttctgctgttttgttatatgttggtgttcatcttctaactttgctctaagtcttcaaaattatctttgctattcttggctcctttcatttcagtttaaattttagaattagcttataaatctccacaagatgagctgctggaatttttaatgaaatagcatcaaatctgtagacccgtttgagaagaattaacatcttttcgatattaagactcccaatctatgaacatggtatatctttcttttatatatttagatattttaaaatttctctcagtatttgcacttagttttccatgaaagactttgcacattttgggggtcagatttatttctaggtatttgatgtttattgatgtcaatgcaaatgtatctttaaaaaattgtttcttagactgtaaaaatataattgactttacatttgaccttgtatctagtaaccttgccaagttcacttattaattctaatagtttatagattcttttggattttctatatgcccagtcatgtcatctgtacatactgaccattttattttttgcttctcagttttcatttcttgttattgcctcattgtacttcccaggatctttgtaaatgctgactagaagacatgatagcagatctttgatcctttccctcagtttcagggaaaacttaagagaatttcatcaaggattttatgatgcttgctgtggtttactaagctgttttgttttgtttttgttgtgtttggcagctgaattctgccttgtattgggagtcttacactgtgcatatgcagcttaaaaatatcagtttagaattatgattttactgtttttttttttctgttagtgcaatggactgtttgtgcctacccccaaaattcttatgttgaaatcttaacccccaatgtgatagtagtgggagatggtagatgattaggtcatgagggtaaagccttcatgagtgcaattaatgcctttataagagagatgagagagctctcttgctctaccatgtgaggacacaatgagaaaacagcaggcagtctgcaacccagaagagggccttcaccagaacctggccatgctggctctctaatctcacacttcccagcctccagaatggtgagaagtaaattcctgttgtttataagccaccaggtctgtgggactttgttgtagcagtttgaactatgatatttattttatttattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaatttatttatcctctctttttgtgctcttctggctatgtattttaattctacacacacacacacatacacactctctctctctctcttcaactccttaagacattattattattctttaacagtcagaattcatgtagatttacttatatgttgcactgtctagtgcctttccgttgtcctgcttgccatgctgtcatctgggatcattttgctgctgtctgaagaagtaccttaagatttattttatgatgggtttactgacaagatattctctcagtttttgtttaaaaacatctgtgtttctccttgtttgcgtatggaattggcagttgttggtgatccacccccgaccccacccccagcaattctggcttccattatttctctttggaaggtcagctgtaagtctcactgttttcctttaaaggtgatattttcattctatttatcctgcttgaggtttgtggagtatcttgaatctgaggcttggtatttttcattcattttggaaaattcttggccagtatttcttcaaacattgcttctgcctcattctctctctcccttctttttgggattccgatgatagatattttgctcctttttctcatgtctcttttacattcttttctgtattttcattccttttattttttctttgtacttaattcggagtatttcccactgacctttctaccagttcataaatctctttttgctttgtccagtcagctggtaagtccatctactgaattcttaaattttgagctgttttattttttagtaattggttttacatttggttctttttccagattcaaattctgttgtaacattcttcctcttcatctattttcaaatatatttattattgtaataaataagcataatacatgtatcacatttacgtttgtttctctttccttttcttcctcttggttttcagatatttggtcttattttctggcaaaaatggtatttttaaatgtattggacataatgtaagaaaagatatagaggttctagatgatgttatcttcttccacaaaacattaattttattctggtaggtaggtagcatccaggcacatcattgtcatctcattgaggcttatttgtctccatattgcccttcctagtaggtataactcttctgaggtctcatgtgaatacctgcagttttttgtttttgttttttgtttttactagaacctgtctttttttttttttttttttttttttttttttactagatcctgtcttgattgtgaaatctcaattcagtatattgcatgcaagcccatcacatcctatgatttggttgctcttcagcgacttcaaataatcttctacttaaactagtttttatagttattctcagcgaaagtttagttcagtaccagcgtctctatcataacctggaactgaagtcccccatgagaaactaacttttggtggcacgtaacatcgtattgtgtgttctgttttaacttgttcttaagaaactttttaggttgaaataatgatagagtcacagaaagctgatactctccagtcatttttctcattggttatattttacataatatagtacaatattaaaagcagaaagttagcattgctataaagcgtgtatatagttttatgctattttatcacccatagattcatgtaatgaccactgcaatcaagatacagaactgttccatcctcaaagagctcttgtgtgctatcctttttttttttttttttttttttttttcgagagggagtcttgcattgtcgcccaggctggagtgcaatggcgtgatcttggctcacctcaacctccacctcccgggttcaagccattctcctgcctcagcctcctgagtagctgggattagaggcacccaccaccacgcctggctaattttttttggtattttttttagtagagacagggtttcactatgttggccaggctggtctcgaactcctgacattgtgatccacccacgtcagtctcccaaagtgctgggattacaggcgtgagccaccgtgcctggcctgctatccttttatagtcatacacttcctccttagtgccaccatccctagcccatgggagccactgttttgttctccatctctgtaattttgtcattttgacaatgtaattgtattagtccgttcttgcactgctgtaaagaaatatctgagactgggtaatttgtaaagaaaagaggtttaattggctcatggttccacaggctatacaggaaacatgacagtttctggggaggtctcaggaaactttcaatcatggtggaaggtgaagggaagcaggcacgtcttacatggctggagcaggaggaagtgtggggaaggtgctgcacacttttaaacaaccagatttcaagagcacttgctcactatcaccagagtagcaccgagggggaaatccccacccatgctccagtcacccccaaccagaccccacctccaacattggggattacaatttgacatgagatttgggtgggggcacagatccaaccatatcagtaatataaattgaatgatacaataggtgacctttgagattggcatttttcattcagcgaaatgctcttttcatgctatggacataccacattttgtttggccatttacaaaatgtcttgcaaaatgccttttctcatgtctgtttacattcttttgtaagacatcttggtcgttttcagtttttggctattacaatgaaaatggctatgaataatcttatacaggcatttatgcagaaatcagttttgtttctttgggataaatgcccaggaatatgttttgttggttgtaagttatgtttggttggttgtaagctatgtttagtttttaaagaattgcagtattttccagggtggctgcagttttagattcccatcagcaatgtttgggagatccagtttctccacaccctcgtcagcatttggtattgtaactgtttttaaattttagctgttctgctaggtgtgtagtgatatctaatcatggtattaatttgcttttccctaatggttagtaatgttaaacatctttcatgtgcttatttgccacccgtgtctttcttttttttttttttcttcgagacggagtctcgctctgtcgcccaggctggggtgcagtggtgcaatctcggctcactgcaagctccacctcccgggttcatgccattctcctgcctcagcctcctgaatagctgggactgcaggcgcccaccaccacacccggctaattttttgtatttttagtagagacggggtttcaccgtgttaggatggtctcgatctcctgacctcgcaatccgcccgcctcggcctcccaaagtgctgggattacaggcgtgagccaccgcgcccggcatctgtgtcttttaaaagtcgaatgtcttttcatgtcgtttgcctatcttctaaatggactttataaaaaatgctgaatttcgaaaattctttatcaattttagatatgggtcttttgtcagatatatggtttgcaaatgttttctcctggtttgtagctcatcattttctccctctcaacagtctttcaaaaaaacagaagtttttaattttgatgaagtaaaatttattggtatttttcttttatggattgtgcttttttttgccccatgcctaagaactctttgccaagctcttggtcttgaatattttctcttatgttttcttctaaatgttttatagttttatgtttctcatcgatgatctgattttgagttaatttttgaataaggtatgagactcaggtagagattctatttttttcctgtctccaattattccagcagcatttgttgaaaagattaccattcctccattgaattgcttttgtacaaaattatttgttcatacttgtgcagggctatttctgtgttctgtattccgcttcattcgtctatgtgtctagctgtccaccaataccatacagtgttgattactgtagctatatatgtcaggtagcgtgttttctctcatttaattcctctttttcaaaattgttttaccatttcctttgtctttctatataaatgttaaaatattcttgtctatatctacaaaaaatttcaccggggtttcgataagaattgtagcaaaacttgtgtatcaatttgggttgaattggcatctttattattttgtcttccaatgcgtgaacactgtagcaggtgtttttgatttggcttactgtaacattgtggaagagttcttcctgactaaactcttttctgttaacatcctgcgctttaattattgcttcctatttcctttagctgagtttttaaacctgcagacatgtcaatttcacatcatttctctttgatggtagtgaacctccattgcattgtactatacacagtttgtggtataattaatcatgccctacacttaaatcactagcagattcaacattgcataccttgatttatccagaactttgattttttttttttttttttgctaagaactgtacctatttttagactctttcactttctcatcatgtcaatctcagaatagatagcactagtacttggctttctggggcccattttcctcaaagaaacaaaacgtttcgttgttttttaaaaaaacacttcttgaaaacaagtatatacagtatggtgattacaataaagtcacactgacatgcagagacgaggacattggtggggttatcaaaatacagccagattatcagtaaacaacatataaatgggatacctataaataggcaaaatttatgcctcagcaaaaatattagtttaatagctaatgaaatgttcttatgttcttggcatggctcaagaacagttgacattgttatgttgcccatgtgctgttgaagcctttattctgataacattggtaaattgtcccttaccaacgtggccatttgtgtaaatacattctttacttcagtctgtggtttcacattttcactggtggatgaatattctcaattcttaggggcttttaaaaaacacttcccatgtgttaatttagtctcatctaccctgtattattcttctcattacatttgccctgacttttgcaaaaatgggttggttatgagaatttcctcaaaaaagtctttactgtgttatgattgaagcaaatatgtaaattaattcttcttcaccatcatttatttttactttgagctttaagtggttttgctgactccattttctggcttttggtgtataaaatgaacttccctttactgtttttagatctccccgtactgtggcctttaactgacatttttcttccaacctgctcctaggtgagccagttgagaaaaaaatacatgtaatggtaacattgcactggagcaaaaatcttcctgtatctcttaatatttggcataattgcagcaactctagtagaattccctttttcagaaaagaagttataaatgtaagaaaagttcaatgatgggtggaggaaaatagctcattaggacattatgatctcttgaactgtgaattgtttaaaaatgatattaaattctgctcttcattggttgttctggaagagtgctggtgaatgaattttctagtccaggccctagaaaaatccatgcagcttatcccatttatatgttgtttactgataaactggctgtattttgtgataagagaaagtgggaaagattaatgggaaccactcagaggtttagcaatagaacttaaagagagcaattttcaaaaggtaattttgaaatatgtacttaatataggaacataaatggacttctttaggtatttaattttaatattacttatatctagtataagtaaatacatttcaaaacagggcacagcaagttggacatttatagcttatacagtgagtacagagaggacttttgtattggacttaattattaatgcctgtcatccagatgactgaaagtagttcatgaaaatcaggaatgtttatataacatttaacttaagagagaaatatttcccaaggaaaatgcttgatgattttttatcagttaatgctattgcctttcataattttttaaaaccttagtgaagtactgaattattaggagtgaggaatttccttcaatattctggaaaagtccatttttaaaaaatggtgtcaggcaagagtttaggcttcttaaattatgctttattttcaaagctactccagcttatttttattaggctatttctcaaggaatagattttattttattggttttcacgttaatactgtttttccctaacaattgcattttattagaaaatttttcctgaaaacttaatgtttgaaatgaaatgcacatagagtatggcatgatgtgactaaatattttcctttattctcttaaatttttaattgttttccattgctcattataaactggtccagttaagctactggaggctggtttgacatacctgttggtgttttaacttttttttttttttttggagacacaatcttactgtgttgcccaggttggagtgcagtggcatgatcatggctcactgcagccttgacctcccaggctcaagtgatcctcccacctaggcctctcaaagtgctgggactacaggtgtgagccaccatgcctggactgtgtttaactttttacctttctattttttatgattttttcttgcaggctgacttgaagcaaaattggcagcaagatcctcctgcctcagcctcctgagcagctgggcctacaggtgcatgtccctgggcccagctaatttttaaataagtatatcaaaccatcctccaacagcttaattggaccagttttatgataggatgaataacagaaaacaattaaacatttaggagaataaaggtcttatactcctggtttcaagcatttcttctgcctcaacctcccaaagtgctggtgtcacaggatccttagggtgtttctttaccagctggaacctctgtggccagtggtgcctctgcttgggttttgcttgctcccactgggcttatttcgcccacatggcccggcaggctgtgcttggtttgcactactgtcccagatcccacacctgccaagggcaagccaggtgcaggaggccagggttgtgtgagcaagtgagtgtggggtccagccactgtgtgtagccaggcatgctggctggggtggggtgggctgctccaggtgctggcacaggtgccagctccatgtgaggctgtggctggatcagacctactgcaagtggcttctgctgtgggcaccagtatctggacaaggagaatgcaatggtgccaaaagctcagagatgccaggaactgcagagccccaaggagggtgttacagcatgtcacagccctggctcagggagcccccaagggccactgctcttctctccttgttgcctgcaatgtggtgagtggggggcatgtttccagcctgtttgtgttacaactctttcggtcctgccaggtcccaagttctagtccagcgtctgggaagaatgaggtatgcagataactggtgggtgagttagtcggagaggagcttcattgagtaaaagaacaactctcatgagacctgaagtgggcagctcccttccgcaggcaggtcttcctgacgagtgtgcgagtccagctgagtccagggttttgatttttgtttttttttttgagacgaagtcttgctcttgtcccccaggctggagtgcaatggtgctatctcggctcactgcaacctctgcctcctggattcaagcgattctcctgcctcagcctcctgagtagctgggattacaggcacctgtcgccatgcccggctaatttttctatttttagtagagacaaggtttcactatgttggccaggctggtctcgaactcctgacctcaggtgatccacctgcctcagcctctcaaagtgctgggattacaggaatgagccaccctgcccggccgagtccagggtttttatgggctcagaggggaggaagtgcgtgctgatgggtccacggtcggccatggcaggcctggaaaaaacactataaactcttactctgtgttggggattccactgggaactggccccctggcccccaggcttcaggtcgtgcctggcttgaaggtgaggcttcaccagggacctaccccttcctgcctaggaacctgtttgccccctgtggcaatcaacattctgtccaagatgcccaggctgtgcacaccgaggggtgcctgccgagctgctctcagccccacccggctccagcctttctccctgagcttgaaactcccccagagtttcagagggggatgaggcggcgggggtgctggtgtgttatcgctgccttgagcgtgggtatacagctggccaggtcgcgatagcgcccgggctcggcttctactttactctgaaattggagcaggcactggaggtggggaatggccagggagcaggcacttctgaccctgctgggggaagagggtgtcctgggcccccaagagcacatggatgcccaggtctggagccatatccaggtggctgcagctgtgcctgcagcatggggctcccgttctgacaactcagcagggcacgggggtcctgcttgttcctcgtgccctccggctccatggggcatgccgccccggttgtgcctcccccgctgcagctggcatccccacagtggctgctccagaggggccaccgccgccatcactgggattacaggcatgaaccactgaacccggcctgtgcagcttttgagatcagttgcagtttagcaaactccactttccactgatcagggtcggcttccaggcattgagcggatgggcagaggagatgagagacagatgaagagaatactcccagcaaaggggcagagacaaggagacatgagctggtctggagagcaagggttcattagagattttttctttagtgcaccaaccagcaagggggaagtgaatgccaaaaggagctgtgggaggttttctagaatgtcagttataaagctacttgttgcacacataaaatggatttggaaactcgtatttaatcttaaaaaaaatcttttagtgtttgccagagcattttaatctgaaaatatttaaaaatactcgcctgtaatcccagcacttcaggaggccgaggcaggtggattacatgaagtcaggagttcgagaccagcttgggcaatattgcgaaaccccgactctactaaaagtacaaaaaattacccaggcgtggtggcagtcacctgtaatcccagctacttgggaggctgaggcaggagaatcgcttgaacctgggaggcaaaagttgcagcgagcagagatcatgccactacactccagcacgggcgacagagcgagactccatctcaaaaaaaaaaaaaaaaacaaaaactcatctgttagtataactaatgctccaggaagctgccacatatttacctcaggacctatttctatcttcgccccaccgcacgctgaactagacacttaaggacctagtgtagaggactatgaagaggattgttataaggagttaaaggctaaacctgattgtcattttaaggaatttggattttatcctggagtctttagttgattgactatttgacaaacatctacggaatgcctggtttgtggtgggtgttgagaatacagataggggccctgctttggatgggcctctctctcgagcagacaaggaagatcgtgccaggtagttgaatccatatacaacgtggaccacacaggtagtgagagtcagcaaggccagaggcgaacctcataagacaaaggggaccacgtaggaagtcactgtcctgctctgcatttgaaataagcactgttcagagccccgctgtccagtatggcagccactggccatgtgtggctgttgaatacttgaaatttggcccctctgagttgagatgtgctgcaggggtaagatgcataccagatttcaaagacctatcatggcaaaaagaatataaaatatctcattaataatgcttcagggtgggcactgtggcttatgcctgtaatcccacactttgggaggctgaagtgggcggacacctgaggtcaggagttcgagaccagcttggccaacatggcaaaaccccgtcttcactaaaaataaaaaaaattagctgggtgttgtggcatgcacctgtagtcccagctactcaggaggctgaggcatgagaatcgcttaaacttgggaggcagaggctgcagtgagccaagctcataccactgtactccagcctgggcgacagagactccatcttaaaaaaaaaaaaaaaaaagcttcagtagtgattgattacatgttgagataatattttggacatattagattatacaaaatatatggttaaaattaatttcaccttttccttttcgtcgtattttttttaaccatggctatgagaagatttaaaatttttttgtgtgggagccctaaatgatggctcatgtctgtaatcccagctactcagggggcagaggcagaagtattgcttgagcctaggagtttgaaaccagcctgagcaacatagtgagaccccatctctaaaaaaatgaaaataaattagctgggtgtggtggaacgtgcctgtatcccagctacttgggaggctgaggcaggaggaccatttgagcccaggagttcaaggctgcagtgagctacgattatgccactgcactctagcctgggtgacagagcaagatcaaggctaggtttcaaaaaatagattaaataaaattgtatatgtggataggctattgggcagcactgccataacctacgtactaactgtgagatggggaagaaaaggatgactccttgggaggaagatgcggcaatgggaggacactgatggatagaggctgctttacacctctgaggcctcaagcaggattcaccatgatgtcatctgcatccctccaaagtcacctgcttttgtcttattgcataacttgtttcaaatgttctgccacaacctcccccagcccagacatattcatgatgttcttttatgattagtcagtcaccacgggtagaatgtgtgttccagtgccacatcagggatgacttatgcaaacccaagatggccctttggcttagtccttcttcgcccagtgtaagagtctgtcttgtgcctggacactgaagactgggggagggcagtccatcagagatgattcaggcgatgttacgttggtgtgactggaactattgttatattattaaacggtagaggggccatcctgggcaagagttgatttgcaggttaggttgatgagtcaccgattttgaagctggtgtatgtctaggtagaaatactgaacatgcagctggattgtgcagccaggtctcggagagggatctgggctgattccacatgtttgggagctatattgatagagaaaaggctgtgggagtcaccccatgtttaggagggcagagacccaagcgctgaacccactctcattctcatgtaggttttatgcttggatatcactgcgtgaatttaaaatctgagcctctaagcaacattttggaaagcctgtttcatagttctgcttatgcaggattttctgcctttttttttggcccatgcatttttctctatgcttagagggggaaaaatatgagaagaaagtgtgttggaaagaaagtctgcgggaggagccaagatggccgaataggaacagctccggtctacagctcccagcgtgagcgacgcagaagacgggtgatttctgcatttccatctgaggtacccggttcatctcactagggagtgccagacagtgggcgcaggccagtgtgtgtgcgcaccgtgcgcgagccgaagcagggcgaggcattgcctcacctgggaagtgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatcgcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagttacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaggttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgtcctaaaagagctcctgaaggaagcgctaaacatggaaaggaacaaccggtaccagcctctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacatgcagagacacacataggctcaaaataaaaggatggaggaagatctactaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccagaaattgaactcagctctgcaccaagcggacctaatagacatctacagaaccatccaccccaaatcaacagaatatacatttttttcagcaccacaccacacctattccaaaattggccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggcaccattccttctgaaactattccaatcaatagaaaaagagggaatcctccctaagtcattttatgaggccagcatcattctgataccaaagctgggcagagacacaacccaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcagcttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctagcaatgcctttcttcacagaattggaaaaaactactttaaagttcacatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagtcatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacgtgaagaaatgctcatcatcactggccatcagagaaatgcaaatcaaaaccactatgagatatcatctcacaccagttagaacggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataagtcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattggaagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaagaaagtcaacaaaggtctgagctacggactcgatgtacctacatttgctttggttcaggatccacaggtttgtgcccctcagtccccttgtatgggtacccatggcccacacttcagggagggccaggttctaaagggacaaccaagatccacaggaggaccctgtctttctttatatatgtatatacatatataaatacaccccccacatatatatatatatatacatgcatgtatacatatatatcataatttagacatttctcatgcatttatgttccagatatgtgttacatatatggcacacacacacatacgcacacactctctctctccctctctctgtctctctcaatattccatcccaatgacccatccagctggaaagatggttttattggcttttatcaggaacctcgcccttcccaggagacttacctcatttatatggataggaggcagccattccagcctaaagaaacaaaacctttactcatgaaaagtcttcagtttctcctgcggcatggccttcctgtcctagctgcatcctcaaactcttctttcttttaagggtgagctccaccaggcactacttggcgatgatccctgggaggcaggagacatcagcacctgtgcaaagggaaaggctaattactccaagataactgtgatttcttaatggggagaagaacttggtgggcaaagacctctttagagatgaaggtttctgtcctagtgacaccctgtgtcagcgaggtccccagggagaatctcagtttgctatgatctggtgctgataaacattaactgattaaactagtggctgacattattgatcatgtactgtgggacaggtcctattgtaagcagcgttcatgttatattaacttattgactcttcacaggatcatgtgaggtatgggaggttaagccacacagctcatcgttttgtgccagaacttaaaacctgtgtcagagcctaagcactaagcactaagcatgactctattctgctattaagacaaagtccttttgtaggaagccaatgatgatgagcaaagatggcggacatttttaatggtctggaaatgaagtattaaaattgctattgtcgatgcacctttgtattaatttgttggtgctgctttcatgcacctgataactgcctgttatcttgatggaattaaaacccctgtgttatattctttcaaataggaaaacatatatatatatatatatatatatatatatataaaatcggatataaaatcagagagtaaactgcctcttatagccgcccctcctgcagtcttctgtttccaagttctcagtaccataaggttaacccacgaagccttggctaagcagatgtgtgtgggctgagtgcttgttagtttctgtgagtttcttctatatgtaacaagtgttaaattggaccctgctagtgttaagattctttatttgagcaatttaatagggaaagttaggtgtgaatacacgttttcagtctcacctgcagtgtcaggtgatgttaattctttgatctccttgctattatatcgccttgctattcttataaaatactagagaaatcactaaagcctgattaatgtttagtttttgtggagcaaagacttggaaatttttaacaatttccccgacgatttactttctgtaagcccttgcacactttcttctttataaatgtttatagtgacttgttgcccgttcagaattatagcctggccctgcttctgggatgcagtatgggcccactgttgccacaagtcccctttcagaagttacagagagccatcagcagttacccttttcaacattcatttatttgaagactagggagtaggaggagaaaaccctctaagtgttctctggcagtttggtgcatgctttgaagtgagagagaaaattcctcacgaccatgtagaagtttcccgataaatttatgttcaagtggtggcatttgggcagccaacagccagatgaaaagcccgtggaatcccaggatctggtatgtgcttagtggttctcatgccatgccactctcaggcaagccaggtaaccctccctcagcacttctagcctttcactcggggatctcatgcagaatttaaaacaaaaaacatgggagggctaagctccttttttgataaattgcagaatgcctctttattccacagtcatctctcctctctgcttgtgttggtgtatgagcttgtttccagatggttcagtgggactgagaatgtgaactgatgaggcaagtatgtctgtgtctttctggggagagaaggagatagtgggctatttacaaacatctgcaggtcttcctttcagagacaacaaagcaaagtgccctttaactgtgctcctctatttctctgccccaaaatgctagacacagcagtggtttatttacccactgcttcttatattactggccttaccactcactgaaatggcgctgaaagatgaccagggagctctcaaatgctttccctcagtattcatccccttaaacttccctggaggatgtgggacttttgtccacttaggcatgaaaatccagtgtgtatgttatgcccacggcacacctcagtgcagatcagccacatttcaggtgttctgtggacacacgtggcatatggctaccatattggacagtgtggctctgaagagtgattattttatgacccacctctgttctccctgggcctctcttggttctctcactgtccaagtgtgaatgcctccagagtttggtcctcggtcctccatcatctgcccccacattccattctcctctttgaagatctaattcacaaccacaacaggagctcaccgtggaaaggacattaccccagtgcctcatacccattttcacctggatgctcatggtatttcaaattcggcttatcccaaagcaaatccatctgtgtcaagctggcttctccactttcatccatgcatctttcattttcctgacttctaatgctcccgctaatgttataaagcagttaacaaggcaatcaggctacataagcagaaatctgtgaatactaagacccgcgagctgagggtattatggaaattgaatggcacttgtaagaaagccgaacatgtataatgacgtacataattcttataggcagcaaggtgactaggcatgtctagttattcatgaacattaaggttgttattgctttaattcacaagcagagcaagcgttttgggtaacagatggaaaggcgggggaggggtagtttgtggccctcagtcccctccctgatgccaggaggaattgaagctttgctttcatcatccctcctcccagctgcatttccttggtgccttcactgttcccagtgtcactggttagggaatagtcctttgcttttggccaggcatttcttgaatgtgctagtccctttttaattctctaaaaggagaattaaattaaaagctgacttgggtcccgacctaatgtggagttaactgctaatttcaccctctgtgcccatgcaggaagcatgaaagtgcctgattgaagggccggggccggccctcttgtatacataccctggtctcagagagcctggaataaccttgccgacagagctgtattcccccaaatgctgaataatgataggaaagcaccaaattcacatcggctttttattttcattatttcttattttaaaagtaggttatttcattgagttatctttccacaaaaactactcaagggtgtgattgccgtttatgttcattttgtagcatgagtcgtgaaatttgaagtgcaacagatattttagtttctctataggcttacgtagtagagtgcatccaattaatatcaatttaaaattgatctccagggatattagggtagtgtttacagtgacttatttcttttcctaatagaactattttataaaactttagtcatttcagctactgggatggaaccgtgacttatcaaaaggagtcaagtctttggagtcaaaaatatctgagtttcagttattggttctactattggaaaagttactcttgtcttttggagtcccttccctgttgcataaaataaaatctaccccatcagataaaattcttaacttgctccgcatgtgttaatttcctctctactgttcctggaagctggaggaggagaagggaagcaatgagaaagatcaggaggctgaagccacaagggtatacaacagctgtgattttagaagagtgtaattgggtgcacgtgtgtgtttaatctatttgattagattgctttcctaatatcaagaaccaagagcatttgaggtgaactgccccattacttgatctcagttggaggggcctggaatcctgggaacttgagggggagaagagagctattcagacagggataggaagatcagtgaggcacctgcttctgactttttttttgagaggaggtgtccctctgtcacccaggctggatggagtacagtgttatgatcacagctcactgcaacctccgcctcccaggctcaagtgatcctcccacttcagcctcccaagaagctgggaccacaggcgtgtgccgctacgcctggctaattttttgtatttttggtggagatggggtttcaccatgttgcccaggctgatcttgaactcctgagctcaagcgacctgactgccttggcctctcaaagtgctgggattataggcgtgagccactgcacccagcctgcttctgacattttagcctaaggcatgctctgttaatgcctgcattagtttgcctgagctgtcataacaaagtaccacagactcattggcttaaacaacagacatttatttcctcataattctggaagctggaaattcaagatcaaggtgttggcagggctggtttcttctaaagcctctccccttgactcttagatggctgtcttttccctgtgtcctcacgtggtctttcctccatgtatctgtgtcctaatctcttcttcttctaagctcactagtcatattggatgagggctcaccctcatttcctcattttaactcagtcacctctttaaaggacctatctccaaatacagtcacattagagctttaacatacgaattttgtaggaggagggacacaattcagtccttaacccttcttgtctcagtggacaagatttttgaacttttctgtgtttcgggttcatccttcccttcttcccagtctgttacctttatcttactatggtgttatgatggggaggaaaggaagggtgctgacctcaacagggagccagcatattgcttaactaatccaagccagggcttgcatggaggatttttatttcccacaatatcatgggtaccctgtgcagggtggtgaggggtgctgggtgggaccatatcactttacttcgcgatgctggaagtgtttgggctttgggaggaaaggtcacaggcagcgttatggtttgagtatgtagagatattgggccttcactctccagctgcagtagaacgaggttggcaaacagcagtcaaacttatgcttttaaatgagatagagctgatactaatggacaagttggtgctatccccggaggaacatgaactgcctgtatttgagtatgtatatgtctgcagctctcggattatagtgttatggcttgttgtgccagagagttcttctcttttcaggctgcatagaatattttcatggccactgaccttgagaaagcaattctcagcacgcgcaagtgaaaggcaggaggacccctttcacagtaaagctgggattccctgaaggagggactgcattcgggaaaacttccaaattgctgaatttcttttcttccctcattagttgctggtgcttccagatggcacctgaaccagcatctgggccaggagaatagcatcctagccagtcttcactcactgggcttggttttcgtgtgtgtttgtagcaactctgttacatttttttctgtttccaggttcaattccaggtttaggacatactgctcatttcactttcctctcctcctcctcctccttctttgttgctcacctggttacctaccatgatgaatcatctgattttatagcctaccaaaatcaggataaaaaatgtaaatgtttttgtttaaagggagatgcaaaatgtgagaagtataatgagtaatgattcactcttcaagtactatttgaggaggtagatttatttctaatgccagatgcaccaagacatgtttcttttctttgcagcccacagagatgtcaataagcagaaaatggcattcgtatatcttgttagaaaccaagtgcatggaagttgaatttatcagtggatctcaccacattctcgaatttgagatgttggcagaattggtgcccctcttggtgtctgggtggccagcctgggtttctcctcctacattcccccctccacagtggggcttggatgtgtttgtaaaatgagccttaataaaaatgtgagaaagtctccatttaattttgtgtgattttcatctcagaagttctcgcattatttggaatagagaaaacatcttagatcactttagatagatggtattcaacacaattagttctctgtgcatgctgggttaagtcattggtatttgtgccacccatttggcatttgctggcaccagctgagaactatgtcctgtacctttgaatttagaaatgaaatgctgactgcacttgccatttctgcctttggaaattaatgtaatattggatatatgtaatattggatactattggaaattaatgtacatggaagacatgatactccttgactgtacttttttttttccaatcccaagtggcttggggctagccagctgtaaaggcgtgtaaagcatgcatgtctggcatgtttgcatttgtggattggcaacccttggtacgtgtgccaaacgcagatggttagtgaggtcctggccatctccacgctcctgtgaccaccactcatgaatctcaggagagataaagagagataggatgcaagggcttggctacctgtgcttttctttcctttttctactttccttgcaagactaaaccatatttacaagttccttcaacaaatgtgtaaatgtgtattggatgcctcctggaagttgtgtactggaatcaatgcttttcgcaatttattatctcaaactcctgtgccctatgagacaaaacaaaataaaaaacaaaagccaggggcattggtgttgtacgtttctttttctaagtttgctaatctatgatttatcattcttccatgtttttgagttcattacttggcttaggattaaaccagggattcagaaattgtcctgcattggttttatgttgtagaaaatattcgaggggtaatgttaagttttctacctacaaaatacattctttccagccttgtttttgtggtaggtaatcctttctcatagtacttagacagtttaggttaagttgtcatgtgaaggatacaagatatggctcataatatcttaccttcaaaagaggcaaggacagtattcagagacaacattttatttaatttcagttgtttccagtacttacaaagccaaaataaccctttcttgcctgagtttccactgtaacaggagaagccttttctattcccgaataacaaaccaaacccacatgggtcccatagatctggacctctcattcttagattaaaaatagctccaaattcatggaaaggcaccctctggttttttgccctttgcacctgctgagtctcaccttttaaaaacctcagacctctcaggaaattccctgccaattacatccatttcatctgcctccaacttaacccattctcagtgtgggggtaactgtattacataacggagttcagattaatttttcttacacataaatgaagaaagctaatatctaggtaggcctgtttgagaataagcagagccttttcttcccattcctttaattgttagattttaaaatgcatttccaactaagatagtagtgtagaaaagaataaccatttctttccatatactgttttattccttttgactacatttattataggaaattattttttgttcagtctagtactagttcagatatgtccctaagaaatagtgagtcagtaagaggtaaccatctagccacatgattttaaagaaatcagacactgagagtgaaattaaactaaaatgtatcttgtcaagtttatatgtgacctcacatttattgccagcctcccttgagggatacagtgaaatccacactacttttagccaatagaattgtatgttatcttgttaagaaatatgaaaaggtaaatagtctaaactggtttagaaaaataagtcatgttccttttagctaatcccagtgtatcccacgtgatgctgaaatgcaaaatgcaagtggaaaacttcagttggtgggagtatatagtgaatttttaagtaatctctggtatttcagaagattattcttagatagtctgcagagatgagtttataaggctggtgtggtcggctgaataagggcctgtattagtccgttctcatgctgctatgaagaaatacccgagactgaataatttataagaaaagagatttaattgactcacagttccacatggctggggaagcctcaggaaacttacaatcatggcagaaggcacctcttcacagggcggcaggagagagaatgagtgctgagtgaaggcaggaagagtctctttcaaaactatcagatctcttgagaattcacttactgtcaccagaacagcatgggggaaaccgcccccatgattcaattacctcccactggatccctcccatgctatgtggggattatgggaactacaattcaaggtgagatttgggtggggacacagccaaaccatatcagggccctccatggatgtccatattctaatccccagaacctgtaaatatgttactttacatggcaaaagggactttgcagatgtcattaagttaaggatcttgagattatctcgtgcgggggcagtgtaatcatgagaggattacatgagggaggcagggggatcagagtcagaggagatgtgatgatggaagcagagatcagagacagttgaaggtgccacattgctggaaggccaggaaccaacagattttcccctagagtcactagaaggagtgcagccctgcagaaccattttactttagatgtctgacctccagaactataaaataaatttgcattgttttaagacattatgtttgcagtaatttgttacagcagcaacaggaaactaataaaggaaactaatataggaatataggaaactggcatatactttgggtgtccttggttataaatgactgaatgactgactgtcctccctgaccttcaggtgaagtgtagtctggcatttgatttttgaatgcaaaacaacttcagttgcagaaaattcacgagactcttttactgggccaagggtttcaagaggaaggctctgttttgagaagaaggttggcatgaaagttaaaggttcagtagctactatgtcacatgtacagttgacttgagaatattatcccatgtgcattacaaaatatagtaattttgtaataagttaaaccagttaaatgaaaattatgtacttgtgtttaatgtcatacatttatttttggaacgactttcacatgacatttgtgtagagtaagagcttggtttggtgaaggagtgttactattctggaggaagataacaatataggttgaattagatggttaactttgaaaatgtggcttgggacatggactgaatagaaaaaagcctgggatcaaacacccctgctaactactggggggttctgtgaacacccagaaacacaattggcagctcttacagcgtgaacttcaccatcaagcaggttgtttcaggattctgactgagggatggaaactttctcttgtaacctgtccagtgagcttagcatcccttaggaaatgacttaccctaaggagggtgccattcccaaatctctgttggtctggaattcaaactgtagaaacaccagggacttttctttcttttttttggggggggcggggggggatagggtcttgccccattgcccaggctggagtgcagtggcacgatcttggctcactgcaacctccgcctcctgggttcaagcaattctcctgcctcagcctcccgagtagctgggattacaggtgtgcggtgccacacctggctaatttttgtatttttagtagagacggggtttcgccatgttgcccaggctggtctcgaacttctgggctcaagtgatccccccgccttggcctccctaagtgctgggattacaggcgtgagccactgcacctgacccagggacggttctaagacctgttctttaaatcctaaacctgaactctgatttctccttcctctgagtcctatccttgccctttaaattccaggcctgtgctgcctaatgtggcagccaccagccagagcattcctagactgaaggtgccctggaagcagaaagcacagcttttgataccagggttcttggctgagaagatgggaatatgcagagaagagcagagagtcaacaggggatgggttaaaaatggagagatgttttgatagccatatgttcattatttcttttattttgtcctgtttcttcctagctctctctggtcttgatttgacatacggatacagctggaatgacaattacctaaatatactagagcacctttataatactgatttcagagggaaagcatgttgagagaaaagatctaccataaggatgcgttgtataatgggctgtagtctgcccacccttgggttaacaatgggttgatgttacctggtgtgccgtgtagagtggtgttaaggtcaaataaaggaatgtaaaagcaggctgaaatatccttaggtacgctccagatggccattttgatgccttatgagtccctcaaattaaagagtgtttgtttccttgaaggagaccctctgctatcttctcaggcttggtgtttgctcttatgtgactgtctgtgctattctgccatgtgaaatgtcccatttgaaaccatgttattttaaaatatatgtaaacattgtttatatatgtggtatactatacagatcacagatagtcttttttttttttttttcctttttttttgagacagagtctcactgtctctctgttgcccaggctggagtgccgtggtgtgatttcggctcactgcaacctccgcctcctgggttcaagtgattctcctgcctcagcctcccgagtaactgggattacaggcatgtgccaccatgcccagctattttttgtatttttagttgagatgggagtttcactatgttggccaggctggtcttgaactcttgacctctagtgatccacctgcctcatcctcccaaagcgctggggttataggcgtgagccaccgtgtctggccaaagatagtcttattattatttcaaaatctaattcaacttgcttccttcacagcatttcttggataaatcccacatagcagaattgccttctccctccacatgcagaacctcactttgctgaggccggagcagcagtgtgtgggcgtatatgggtgctctgtgacagtgctgtcccgtagaactcccggtgaagatgggcatgccttatgtctgtgccatccagtaccactagccacatgtggttattaaattcttaaagtgtgacgcgtttcaccaaggaactggattttacattttatctaattttaattaacccaaatttaaatacccacaggaggcttgcagccaccttattggacagcagtgattccataagatcatccaagtagagggaataacaagccgagaacctgatgggaggctccctgaaggacatgttgtagtgacattggctgggacacgacctcagaagcccatagtgatggtgggctaggggaggagctgagaagaaactgagactttcaggaaaacttgagaatagaaatagagggcagatgatttattcatgacatggagctgcccgggcagtcacctgggaaagagatgtcaaatatgggagatcaaggacagcacagaggaacagtgacaggagcaggagccccagggggcttctgcaagagagtccaggctgaccctggcctgggctcaggtgactggaagagagcagtttcatccctgaggacttagacctttgtttctctaggaccacaggctctggatgaagtgatcagccctggatggaggtggaaggagaaataagcattgagcggagggagttaggaaaatctcaaggacccttagaaattggatcttaatgagcagctagagtattggcaggcgtgggatcccagaggccagagagattaatcgattcttttgcttagtgaagttaacagtgatgcttttcctgtaattgagataatctgtgtgcggcctgtgtttcctggggttcttctcacgctgctgtgaattaggccaccttgaacagctgactgaacgtggcaaaccagagtggtgcagcgcaggctgtgggcagagagtcgaggggaagcaggagtcctgggtatttggacgatggatgcctgaaccctaggcagtggcgacaggaagagagaaggcaggcagctgggagagcaggcccggagcctctgtttggaagggccagtggggcaggcgagctggcctgactcccttcttcgagtcctccatttcgacctctgtgcctttgcacagatacatctggctttacagatagaggtgttcctggaaaaggaagtcaaatgaaacaggaaaatctatgttcagcttacatgcacttaaggggaagctcgctatatgtaggaagcctgtggttattgctaataattgccaccaatttattggttctatgggggctcagttgtaccgtagttacactttaacttcctctttctgtaggatctgtaaatgctcttaggcgtttttaaaagtgtgtatcactcacccactaggtaatgaaatccttataagcaaaaaccatagtatcgtttctgtttttttgggacgggcagggaggatactgtttctccatgcaatctttgaatgcgaacatgcttaataaatattgatggacagaagtgacttaatttttatcaaactcttcacagttttatgaatgcatcatttgttttgtctttataaatattattattattattttttgagacggagtctcgctctgtcgcccaggctggagtacagtggtgcgatctcggcccactgcaaactccgcctcactgcaagctccacctcctgggttcacgccattctcctgccttagccttccgagtagctgggactacaggcgcccaccaccatgcccagccaattttttgtattttcggtagagacggggtttcaccgtgttagacaggatggtctcaatctcctgacctcgtgatcctcctgccttggcctcccaaagtgctgggattacaggtgtgagccaccgcacccggccttgtcttcctaaatattattaacaaacaacccaagccttcatatatcaattgcttcctggatgccttgccctgtgctaaacatagtgtgtgatttatgtcatgtaaacctccagcaactttatagatgggactgaactttatagatgtgacttctgaggctcagagaggttaagtaatgtcttcaggttatcgttgcaaattaaaatgttgaaaataagaccatacatatggtgagccttttctcccttcagtattttttcctaaaagtgttagagacaacaaagggcagagggcatgtcaaaggtatctaagacaaactttctttattgaatcaactttgtcttggcttcaactgtgaaacttggatgatgtaatctagggttgggtaccgtacatttctagtctctgggtcttccactgaacactgctgtaccacacgcttcaatggtagagggtttcatggcagggccgtgcagcactgttgtgacatagacaatctggaagttacagaacaaccaccctcccacgtatttacaaaaagtgtaacatttcactgggatcgtgtctgaaagcactctgtagctgaaaagtgctatacaaagccaaagggttatttatcataattttagctgacagcagcactgccgacatctctttctcactcaagggaagtacccacaaggcaagctacagagcatccccctagcctggtgactggagatcaaggagctaaccttcagtgttccgtctgtgaggaacacttgccatctgtgaggttttgggagatgctgacaaccatccatttccacagagtggtcccagctggggagattatatgcaaaggagacctctcagaaagcaaggtggcatgtagtgggcatgtgataagctactcactgcatggctcaacatggctcaggcaacaactcaggcaagaggattctgcagaaagagagatggatgtcatcagaataggcggggaagtggacttgtggttgaccttgaagtctgggcattccaggctggagggacagcctgggccctgagaaaaccaccttccactggagccattctactagaatagttttcatttctcatgcagaggtctggtcttcaaataaatgattctgaaaaattggacttagagactatcacgggaaaatgatgaaggtcatagcctctgggatcctgaaaattgtttgggacttttatagactttcacagtcctggatttctgggtgggaggaataaaaaccggattggacagtgtcgtccttcaacagaagaggcctgacgttaagcaatgccctatttcaaatactttccactgcagaaagagtgctgtccaattgccagtctgggaaatctcttcctgggcttgttttgttttgggattaaatcacatggaactcttttcttcagctcatgttgtcatacttgagacactgctatttcttcccttttatttctaaattgtgaaccttctccttttgtttcaacctagaaatgtacacttctcgttaattgttcttatgagaatggtttctttacagcaataggtggcggataacaagactggaaactttgagtacacaggaccacactggtttcagttctaattttcctaagtggctttgctgagggaggcaatatacattggtatatattggtatatatttggcaagggaatatacgttggtatcttatttttctaaccatagtaatggtatctggaattgttgttggcttttaggctaagccattcattatttttaaccttcagaaaaaaatttgaagatacttaattataaaataaaggctgctcagattttaccacttggacaagagatgaaagttccagaagagtacaaactgagctgctctggcatgttcggaacctgttttctatgacatagttggtagagagcaacatctcatgccccctataaatctgtgtgggtgtgtccaggagagcttgcctcctaaattgtattgaattagaaatcctgcaccttgaagcaattggaattggtctgtcctgcaggtcttctgttggagtagagtcccaagagaaagctgtgcagtcgcccatgtgattttagtctattttagtcttgcctgttttttcaaaaccttactgaaattggggttgactaatggcctccttaaaattggatttattttagcttgaatatgtattttctcttctttttcaacttctagatggcatatattccaatgaatatgattcaaatattccaatgcagtacaggatccaaactatgtccctttggtagagaaataaatagagagtggaattctttagagctgccagattgaccttttccatcaaccactaaactgtctgaaaaatggtacaaatggtacaaagatttaagaccttgagttaaaagggggaagaaactgagctatatgagttaaaagatccaggagactctctcctgtttggttgctcattcttgtgtattaatttttaataaggaagtgaaccccagatgacagaactgattttcttttattgggtgacggttgagatctcctattgcttaaatcaggttaaataagagagaatgctgctctgtaagtctggcctctgggtctctggtatatttacaaagatttaaacgtaatacctattcctgtttctcaggcatcctcatgacaccatcttccagtataggagaccaaaatggataagatgaaagcaaaacatcttgtgtaatgcaatcaaagcaactttaattttttggtttctggcaaggaggatatgggcttaagtaaaatactccattgcaccgtttctggggatttatgtttttaaaccaagtataataatattccatgtacatccactaccagtgatattagctattcccagtccgtgtcacccccagggatggagtgggctggagacctggggagggagaaatcaagcctcatatgctgtgatgtcttgacaagtgagtgcccccaatcctgttggcatttgtgctgcaggagtttggttgatcagatttgtattttagataaatatattaggtcacagtttgaatttcaaattgcatgtcctttgccatttttctttattaaaatgtatgcattaaaattgttatgcatgaagacaaatatcaagattgactgatgttttcctccctattaatttcccgtaggaatggtaaaaatgcaattattcatctatgaaaatggtgtttaagaccttgaaaatgaagagaatttggaaagccacttgtgccataaaatttctgaacacagaaacgggccagtgattcagtcgatattgattgattggttgattgattttaatttcttctccagctttattgaggtataattgacaattaaaaattgcatatactcaaaatgtacatatgatgttttgatttcattgtgaaatctttactataatcaagccagctaatatatccatcacctcacatagttgccattgtgtgtatgtgtgtgtgtgtgtgtgtgtgtgtgtgtgtgtgtggtgagacactcaagatgtactgtcttagcaaatttcaggggtacaatccagtattattaacatgctgtccattattcacaaaaggcaagatgaagaaacaatctaagtgcctaaggctggatgaatggataaagaaaatgtggtatatatacacagtggaataatattcagccttaaaaagaaggaaatctgtcatttgtgacaatgtgggtaaacatggtggacatgatgctaagtggaatgagtcacacacagaaagacaaatactgcatgatctcacttacatgtggaatctaaaaaagtcaaactcatagaagcagagaatggtgttttccaggaacgtggtggaaagggaaatgaagaggtgtggtcacaaggatacaaagtttcagttgtgcaggatgaataaattctggagatgattcaatcctgactgaaagagaagtccatgtgatttagagcagactgtgcaaaatattcagcgaggagctgagacggtctcttcccctggcatgtctcagctatccttgcctctgaatcgcatatgatgtgcacaagtacaatgaggagggctcagacaaccactgcgcttctcacctgcggggacaacaagccaccttctcccgataaatgaatgggcttttaaagatcatctttcagcagtgagaaggtagtgtgaacggaaaaaaaaaaacccaggaaattcaatatcagcatacatataacatttaagttaattcagcccagctggtcagcagaggttgctgttctcggtgtgttccaagaccacagatggcaagccagtcttgatggctttttaaaaaaaatatttgagacagggtcttgttctgtgactcaggctggagtgtggtggcgtgatcatggctcactgcagtctcaacctcccgggctcaagcaatcctcttacctcagcctcccaagtagctgggaccataagtgcacaccaccatgcctggctaatttttaaatttttcgtagagatgaggtcttgctatgttgtctaggttggtcctgaactcctgggcccaagcgatcctcccaccttggcctcccgaagtgctgggtttacagatgtgagccactgtacccagcctctcaatagcctctttgacagctctttgccattggttgcaagatgaatccaaggggagggcataatgtacaaggaaaaatgataaattaaaaatcctacactgtactaggagattgttccataccacatgccgcatggcagatcaatagaaccttcttttgctatgaaaaactacattttgaaacaaaagttttagtgtttatttggggcagtggaaaaagaaggaagaggtgagtattgagtgctaggcactaatcaagtacttactcatttaatctttccccaaatattatgaggtaggcactattttttttcaccaatttacaaatgtggaaactgaggcagagaggagttttgtaaatttccccaggttaagctgcagttggaagctgaactgggatatgaacccagcggaggggctctgcagccgtgccttccagctgcacagtatcctcggtgctgcctcagctcctggggctaaggtaaaggctccctcctgccttccaggaccctcctgcctgcccttgttaacttaggttagaaatgggttagcttctatttttcttaggtctctattgggacaagcttggagcttttaaaggaaggcttactaaagaataagtgggggaagtggtaggaaatgagaaaaaaataaaatgaaaaagcaaagaaatagatgaggtgaaagagcatgcatttccttccgtcacctacacattatttactaagtccctcctgcacatggctgggccttcaaggagttcctgatctgggatgggtggactcaatctcgcttctcgattctctcttctctcttcttcttcctcttcctcttcttctttttttttctttcctctctctctctctctctcagagtctcactctttcacccaagctggagtgcagtggtgtgatctcggctcaatgcaacctccacttcccagattcaagtgattctcctgtctcagcttcctgagcagctaggattacaggcgcccaccaccacacccggctatttctgtatttttagcagagatggggtttcaccatgttgtccaggctggtctctaattcctgaccccaagtcatccacctgcctcagcctcccaaacttctgggatcacaggcatgagccaccgtgcctggccctgatctgggatttaaaggggcagttgctgagcaaatagaagccagggcaagaaaggatttatgtgcttgggattcttgaggggttttccagagtcagtccccaattctgatgtttttatacgcaacactaggggtccttctgaagttatcccggcccctgggaaactcacgtggcatggggcccccttctgccctggtctctttcatcccatctgtcccggccccagagcctgtccagtctggtcctctctgtcctgcttggtttgtcaccatgtgatgttgggatggcttgtctttgccgcctcacttcctaagctgacagacgtgtctgctagggaccaccagctcccaagccgcatgacggtgctttccttcaaggttcagaggcttccctttcagtctggcccatctcccacatcctaatggctctgctgtctcaggggcagctctcctttttaacttattggcagagctgggatgacttataggtccctggctcagtgagtaagcaagttcagagacttggctttggccattttgttctcttaggctcatccttggatgccaacagggaaattacctgccagatttcagtcactactttttagaagttaaaaaaaaaaaaaaaaaaaaaaaaacctcacaaacaagatgtttcttttttgtgcaggcacaatatgtagtctctccactattaaggggagcaatctccttagcgcagtggtagatttttttttaacattcttcatctgtatttatttctatttttcattctataagttagtcaattaaataatatttattgagcagttactaggttctatagatgatcaaaagcaaacacacacacactctcgatcttacaagagcaagagctctttttcgtacatataatttctcaatcttgtttaaagtacacacgcacataagaagctaattaatagtacaaggcagaatcagttaaatgccacatgggtggcagacagttttataaacaccacccaaacctttatttgtacaaaagcaaaagcaagcaacctcatcgttaggagaggagttactgccccataacccaggaaagtcttaaaaagaaattataccaagtgtacttttcatctctatttctgtttttcactttttcagtcaatcagccacttactatttattaagtatttcttccatctaagcaaggtgggggagggagagaaagagattattcctacgtttatgattccaatcttgtttaaagtgtattcgtaaaacgtgagttaataatgtggcatcaaatgagtgccttgtgggcctcttgatggtgagtgttataggaatgtagaggtcaaaggaattgctgtggactgtggtgtgtgtgaaagcttcatggtagacttttgacttcaaggtcaaagacattgctgtggactttggtggtgtgtgaaggcttcgtggtagactggggctgagatgagcccctaggaaggaccaggatttagacgggagcttgaggaacaggacagacaggtggggggagtgctccaagggagcaagggatagagagggagtagatcagtctgcctggagttgaggctttgtttacaggcgaggtgctggtgagggtggtggagaggcatccaggaaggttgaaaatatatttctgtagccacctgccatcctgcatgcaggcacacacacatacacagcagccgtcctcttgttgaatgcctcttctcactaaatacagatacatccatgaggcttacacttactgctcatttagtaaagtagtaaagtcacagtgggagcccgggaatcaggaaataaacactcagatgttttccttctagttttgatcagctgccctgagagaatgagattttaaaataatttgacaggccggcatggtggctaacgcctgtaatcccagcacttcgggaggctgaggagtgtggatcacttgaggtcaggagttcgagaccagcctggccaacattgtgaaaccccttctctactaaaaatacaaaaattagctgggcatggtggtgtgcacttgtaatcccgctactcgggaggctgaggcaggagaatcgcttgaacctgggaggtggaggttgcagtgagccaagatggcacccctgcactccagcctgggcaacagagcaagactccatctaaaaaaataataataatttgatagagaaaatttttgttttattataaaatacacgtataaaacttatcaaaaccatttaaaacgatacagttcagtcgtgttaagtatatgcacaccgttgtgcaacaaatctccgaacagtttcatcttatgaaacagaaactccacgaaaaacaaccaagaacagttttatttgaacccaagggtactttctgggatggaaaagctgggagctcaatcttggatattatagtactgtggagctgggattatggatgtctgaggccagtaggagctctgaggccatccaagatagatgtgtccattggaaattgggcttagagttagaaactgctaagtggacattattttaaaatttattttggatattcagcttccgaacactgtcctacgtttgggaacctcactgttgcgtgagtcatggcatcacctacaacggaagctgaaaaggtcagtacctgctttctccatatcctgctgcccagggcatgcaacttgaccttagcacaaccaatcctcctgtagcctggtactttgaacctgaagtaagcaacgtgaagaacaggggacaggttagggctacctcaggtgttggtgctgaattatcgtaactgcttctgtgtgtgtctgggccgtgggccttctgaccaccaccttcctttggtttctgcccattttccaggctacattgtccagtgtccctgtttttttgagacagaatttcactcttgttgcccaggctggagtgcaatgccatgatctcggctcactgcaacatccacctgccagattcaagtgattctcctgcctcagcctcccgagtagctgggattacaggtgtgtgccaccacatctggctaattttagtatttttagtagagacagggttttaccatgttggccaggctggtctcgaactcctgacttcaggtggtccacccgcctcggcctcccaaagtgttgggattacaggcgtgagccaccgcggccagcccctgtcaattctttgaacacctgttagctagcattccaacttggttggtttctgtcatttgcaaccgagaattctgtctcttttgtctggttgtctctctgtggtcaccatgcctttatcagtctgtgtcatcccgggctgaagttcctcacgtgatatttagttgcttgtggccaaaacccgccttcactgcaaatgcatcggttcctcatcatttctcctctggaccagcaaggggctttcctctcgcccatccatctcccaccttttcgttttgtaggtagaacctggagggagcggcagtaattcatcatccatggaacgtgcctgtctgtggcctggacctgtgggatttggccggcgttccctttgcattacatttggtacttggaagcaagcatccctcagtagggacaaggctccagctgtccctttcattagggccctgccaaggacgtttcctttgttcagcacctcctcctgcctgcccttaggaccatcttccaaaaaactctgctctgccctcacccgctgctgtcccctcccacctgtaagaccaggccagctcagcacctttccctgtctccttgtctagcactgctgcttctgtgtgatgctccggcatggtgagttgaccaacaccatcgcttaaatgtgctgtgccttttacaattatgtggctttgcaggtgctgttcccttgcctttttttctttgcccggcaaattctactggtttgtcagtcacttctcctttctgatagcctttgtgactctcccagctgttactgggtcctggtcaccctctagggccttgtgtaaacctttctttcaggttttacccagggcactgtacttacttgtatatgtacttctctccccgcctagacccccatctccctacggataggaaaggagtctcctcctcatctttgtaccgagtttgcaagcacagtgcctgtgcgtggcaggccctctgtacctgttgactatcgtgcagtggagattcaagctggctgatctgtgcctggtgcttaatggctgtgatgagtttgccacattcccttctccctcgaggtcttctcaacggtctgatggtaatgctgggaatttcaggctttctggcagactgtcagggagaaatttcagtgcagaaaggccttctagaacctcacgaataaggggtgctgctcacatcttgtgagtcctcccccttcctgacatgagtctcagtgccggcaaacacggctggttgaaccctgagctagcccagctgctttgttcaccttacgtttggggaaggctgaaattttattgagcaccgactgtattccacacactcttctaggtgcccgaaatatgctgttaaacaaatactcagccctcatggggctgagagtctggtggggaagacctgttgaaaaacaatcatattaaatgaattgcattgcatgttagaagatcgtaagtactctgggggaaaatgagagtagaacaggataagggggtgatggagggaatgagtggtgattttaaatgtagttatcaggctgggcacaatggcttacacctgtaatcccagcattttggaaggccaagacgggcaggtcacttgaagtcaggagtttgagaccagcctggccaacatggtgaaaacctgtctctactaaaaatacaaaaattagctgggcacagtggctcatgcctgtaatcccagcacttcgggaggctgagacggacagatcacttgaggtcaggagatcgagaccagcctggtcaacatggtaaaacactgtccctactaaaaatacagaaattagccagcaatacaaaaattggcagctgtagtcccaactacttgggaggctgaagcacaagaatcgcttgaacccaggaggtgggaggttgcagtgagctgagattgcgccactgcactccagcctgggcgacaaagcgagactctgtctcaaaaaaaaaaaaaaaaaaaaaaaatccaaacaaaaaacatagttatcagagtgggtctctttgagatagtagcagttgagcagcttgaagatagcaggggagttagttcatgggcttccaggcagagggagcagccagtgccagcaccaacgtgggagtgtgcctggagactctaaggaacagagtgtgcagcaggactggggcacagtggtggggaggccagaggggctgcgggtgtgggccgggcaggtggaggaggccttgagggctgttgagaggactgggctcttgctattacttttagccatatgggagtcattgcaatcctttgagctgaggggtagctcgttctgattttcattctgaaaagacccgtctggccactgtgttgagaatagatgttcctggtaaacaggggtgggcagggagaacagctcccctgcaccagctcccgctgggctgcagacaggctctgatgtggcttgcagcacggtggcagcagggggaggtggcaccgagcagcaggaccctggatatttttttggacatagagccaggaggatttcctcatggttctgatgagggttgagagagagaaggggagtccggatcatcccaaggtttctggcagacagatgatgtttcaccagctaagatggagcggtcctggaaagagtgaagatcaagagtttcattctggaaatgtgggggttttcgctgtctgtcagagagtcgtggagctgctgggaggtggttagtgtggacttctggagagagggctgaaactgtccttgaaaaaatggatttctcagtgtgatgtgtatacagtgtccctttttcagacatggcaccttcgtccatttgggctgctataacaaaatgccatggactgggaggcttagaaaccacagaaattattcctcacagttctggatgctgggaagcccaagatcagagtgccagcaatttggtgtctggtgaaggctcgcttcctggttcataggcggctgtcttcttgctgtgttgtcacgtgtagaagggacaaaggagctctctgaagtccctttgtaaagggcagtaatcacctcccaaggccccgcctcctaatgccattacatttggggttaagattttaacatatgattttggggggactgagggacataaacatttagtctgtaacacaaagggaggttaatttggattaagaaatctaaggccatatgggggaaataaaaggctggagggctaaagaaggatgaaccaataaaagtcttataagcattattatgtttactaaaataaaatagaccaacacattaaacaatgacatcaaaacatcaatggacaacatatactttatatatcttaacttagaagttatagatgctgtactatgagccccacttaggagttcttgcttaatagaaaacattgtaggttctgggaggctgaggcgggcggatcacgaggtcaggagatcgagaccatcctggctaacacggtgaaaccccgtctctactaaaaatacaaaaaattagctggacgtggtggcgggcgcctgtagtcccagctactcaggaggctgaggcaggagaatggcgtgaacccagaggtggagtttgcagtgagccgagatcgcaccactgcactccagcctgggagacagagtgagactccatctcaaaaaaaaaaaaaaaaaggaaacattgtaggttctcacttctctgcagctttagttttaccaagttgcttttacatttaccttgctctattataggtaatagatgtgaagcttccgattcctggctcagagttggtgacttccatctcccgtggaagatgcctctgagtccactcaggatcttgtgtggtcacaaaggtgtaggaaacgtctggacacttgaggtggaagatgctttggggcattcccttccagattcacggtgtcctgcagccttagttctttccagaagcacgtcacacgtgtggcatccacctcccctgcacaggctgggctcctccctccttccctggggttcccctgggcttcacatgccctcatcttcctttatttttcttgaggcattgttgaaaagcctctactcctttgtggggctgttttacctcctggtaaaaaggttccggtcctgagctcacggtttctctcatgtcccctgtgggagtaattagagctaaccttcctggtggtgctggaaacctctgtggaagctggttcatgtatgcctcaactttgcataacagggaacatgatcctagaatattctttagggtagcatttcccaaattttccagggaataagaatctcctgggctccttgcctaagcatcaagcactgatttagacttagcgacccagaacctccaggagaggggcctgggaatctgggttgtgaggctacacctgttggagggatcggaggggcccagtatatgatactcccctttcctgcccagcttctgaatgaattgagacaaaaacaatgactaggacaaatgagaggtcaaaatgtcctcatagaggcttggctggaggatgctgcgttaagtcagctagcccagtaggcctgctaattgaattcctggaatgaggctgatgtaccgcagaggcctccctgggagcagggccgctggagcagcaacagaaccttgcagcctgcagaagctcacaaccaaaacagagaacagggctgagctgcgctgagcagagctctgggattctcttaaatctatcagtcgaaattatttctcctgaggcacataggaagtagagagggctgagagaggccgggagtgtgtaggggcgtggaggctgcagggtggaggagagtccctcctcctggcaatcaggaatgggaaaaagcatctcttttacacaccccaggtgatttgcatgatcaggaaagtctgggaagtgggtcttaggaagcctgcaatgttgtctcttgtctgtgctttccaccagcgttccagttttgcacttttggtatttctgagcaagctcagcttctgtgttttggggtactggctcctaagagcagctgggtgtgtgattagacaaggaactgcttcactagtttattttcattgtgagcacacttcaatatcactctttacatgaacatgagcaaatgggtttaattttgaagtcagggcttgggattcttgcctttgtgtctatgtatatgtgtgttcaacagaataaccagtgtgaaacctaacctagccgaacataaccggaataaccagggtaaaacctaaccatctgtgtatatattcacaaatacatacataaatgtgtatatataaaatacatatatacatatacatatgtaaaatacatatatgtatatataaaatatatgtattttattttgaaataattacagtcataggttgcaaagaaaaatgtacagggaagtcccatgaatgcttccagtttatattttttgaaattgagaaatataatcttagaagatggtaaagctggttttttttttaagttggcaaagaatatgcagttaaattcaggcatggagagaaaattgctttgaaaggaagattttttgcattgacttttgtgtgtgacattagctgtctgttttggaaaatctaagagcaatatctgattatctatgctttccatccctaaaaccaccaacacatagaggctactgaatctcccgaagggcctcggtgatgggcctgggcaggaggaggcccctgcagcctgtgggtggtgcatgggcagcatctcctctctgcagtgtcctgcagcagcagtgcaatgtgattgatttcagaaatttaaaaaatatttgctgacactgcactccagcctgggcgacagagcgagactccgtctcaaaaaaaaaaataataataataatttcctgggataggtaggggaaacggaaatttacatgattgccaacctgactactgatattttccaaggaagattacctctgtgagggcctttttgctttaaatgtcaccttcatggtgttcagcaatgttcactgagcgtatgacctggctttgtgcaccgagaaaactgcccaaaataacaggtgccacagcttggtcacaagacagacacagggccagtaaggtgctgtcagttgtaccccctatgctaagctgtgaaattctaatcccccggccccactttctaaccgtggaaatgttgggttgtgccatatcctggtatgaattttctttgtggaatgataggcccatagagttaagttttctctactgctgacttttactcacttaatttttactcaagttcttaaacttgagtgtgcatctgaatcccctggaaagcttgttaaaacgcagattgctgggctctggccccagagtttctgattaggtgggtctgaggtggggcctgaaaatgggcattttttttttctttttttaaaagttttagggtacatgtgcacaatgtgcaggttagttacatatgtatacatgtgtcatgctggtgtgctgcacccattaactcgtcatttagcattaggtatatctcctaatgctatccctcccccctccccccatcccacaacagtccccgaagtgtgatgttccccttcctgtgtccatgtgttctcattgttcaattcccacctatgagtgagaacatgcggtgtatggttttttgtcctttcgatagtttgctgagaatgatggtttccagtttcatccacgtccctaagttcccaagggatgctgatgcctctggtttggagtctgcactttgagaactctcgctctaggcaaagctggcaaatttgtctcaggtaggggcacacctgctatcttccaggtaggcactgttcctctactcttctgcgtcatctcagcttcatttctccctcggggtaccaatgctctgaaacctcctgctgtggactgaaacattctctttggttaattcaaactgaaatattctatttggcatcaactaacatttgcatatttctgggggaccagccactttgctgcaaggtgcttgtatttgttatttaatctctaccacaaccctgtgaggtcaattgtgaagtccccctttaatgagactcaagaattcaatgacattttcaaggtcaagcacgatgccaggtctcaggcttggagcctctggtactgggccactggtcttccttctctctagcttcaacatccttctgaagagcaattgggtcctttgtgaggatgcttcgaggttggaccaagtaaatgaatatctgtttggtaacattgttgacactgctgtatcgagctgctctaagaaagggaaacatttttggttcagaggacattcacagcactgtgcttgttggagtatttgtaccattgcctcttccaacagttacattttgctcttctttccctcaagagtagaagagggtggagaagaggaaatgattataattcattcctttcccctccctgccaatttctcacaatacccttattgggaggccaaggcaggtggatcacttgaggtcaggagttcaagaccagcctggccaacatggcgaaaccctgtctctaccaaaaatacaaaaattagccgggcgcggtggcaggtgcctgttgtcccagctactcaggagactgtgggaggagaatcgcttgaacctgggaggcggaggttgcagtgagctgaggtcgtgccgctgcactctagcctgggtgacagaatgagactccgtctctttaaaaaaaaaaaaaaaaaaaaaaggcacatttgaagttctgagtgtgaagtgtgcttcaggatagtaaatggaaatggcaaaagaaaatatccagtggaaatctttgccatctttgggattctctttagtttttgctcatttttgcctatcctgcaagggtaacagaaagctctgagatttggaggtcagacaaacctgtctggctcctgccctgattctgctccttgagggttctagtgcagggaggacctctggcaagttggaggattgtacctctctgagctagagaactggcagaaggacaaaatgtaatttactccactgtaagcccttggaaagcaggtaccttgtctgtttggcaccccagtggcagcccatgcccagcagctgtcattggttgggggtgggtggtgggtgagtgcaccctagtgggtagttggaggattaaatgagatagtatgcaaatagaggagagtaggtaagttccccctccatcactggatgtttttgctacttcccctactcttttgtttgtttgtttgagatggagttttgcttttgttgtccaggctaggtgcaacggtgcaatctcaacacactgtgacctccgcttcccgggttcaagcgattctcctgcctcagcctcctgagtagctgggattacaagcgtccaccaccacgcctggctaattttttgtattttagtagagatggggtttcaccatgttggtcaggctggtctcgaactcctgacctcaggtgatccgcccgcctcggcctcccagagtgctgggattacaggcgtgagccaccgtgcccggccccctcctctctttttatctctctgctctttagttagctggcctcatgattcccatttttattttgtttaccttttctgttaaagaaatttttgcccaggctaccctttaggcagggaggagaacttccccctacctcttctttctaagctacaacatcaaaaaaaaaaaaaaaaaaattagctaatggctctccccttccaggcaaatttctaggattaaacgacttgatgcttttttgctctgatccaggcccacctttccagcccacatatagtaataattatggttttatgtttttagggctccacttttgtttgatttatctccccatgaggatgtaagcctcttaggaatggggatcatgattcttcctgacttttaaaataacaactgtttctggctcctatttggtttatgctccatcatgtaatttgctgtcattcttgtattcagctgatttatccttaatcctgtatctcggttgtttgcttttttatccctaagtgccctaccttgcagagccctggcgtcatataactatttattaaataagcttcacggaacctcaacggggactctgttcacatgtaccagcagtgtgctccttctcctttctgcatccaagacatgatcctcagtaggaattgagaacaaaacccagctctttagccaaaaatggtttctgaggttcggttttcataaattcagaaagggggcttttttcccctccatctggccataggatattgttggcctctcttttatttattttattttatttttatttttatttttattttttgagatggaatctcactctgtcgcccagactggggtgcagtggcatgatctcggctcactgtaacctctgcctcctgggttcaagcaattctcctgcctcagccccctgagtagctgggattacaggtgtgcgccaccatgcttggctaatttttttgtatttttagtagagatgagttttcaccatgttgaccaggctggtctcgaactcctgacctcagatgatccacctgcctcagcctccaaagtactgagattacaggcatgagccatcgtgtccagccggcctctcttttagaagactctgtcccattgtcctttaagggcatgtcacttccctggaggtcaaaatcatgtcatactagtttttgcaatccacagctccttgcacaattcctggcccagggagtgggtacatcatcaatgtgtgaggaacagactgccatgaaatagtgtaaaaaatccacatagtacacttgtgagaaaagagataagaaccagaattttccaagcaaagggatagagagctacaaggtggaattcagcaggctcacacctattgggtgttagagagatgaacttagatcacatttatttaaacatctctgagtgcagtatttttaaagatcacacaagaataaaactgtagcactgaacttttctttaagtgttgaagtgaaggaaatgaagaactcagcacggaccctgcttagactccggcagaacaggtggtcttgacatgacgtcgctccaacatgcacgcaacttgccttttattctctcagctctttgtgccactagtacatggtcacctgggcatttctttagaaagggtgcagagactttcatttcgtgaaaatatagatgtcccagggaaaaataataatccaactggtataagtttatatcaaaccatatggaagtgattttttctggttagtcattttcacggggattagagagtagagaaaagtcaaagaaccagggattcccaaggacacacttggcctggtcaatattactaggattggcccagatgccaccaaatccttttttcttcctacttattgaaaaccctgttaaatttgatatgtgtaatatcttttctctaaaattttagccttgcaaataaaattttgcataacatttttattgacaagacattgtgtcacattaaggcttttgaaggtgatgaaatggacatgacatcttcaccttagcaagtaacactgaattaaagaagtttgtatttcagagtggaagagtacagtataaaatatttgaattcagacactttagagcttggaccctgtcagaagcttggaaatacttcgattttaaagctgctactcttccatttacctcactccaggaaatccttttagaaatcatactcttgagggaagaagacctaggggatagagcatgactccactgagaaatttaatttaggaaaataatgggggaaggggctgtagcctagaggctaaaaacccatgctctggagctagactgcctggcttcacatcccagccctaccaccttttaactagtgtactgaccttgggcaagttactcaacctctctgatcctgctgcttaatctgtacaatgggatgtgtggtagtattggccttgtagggttatttggagcattacttgagtcaataccagtgaaggcacatctttagcagaatgtgatgactgaacatgcactcaactggggactcgtttgttgtaaagattatccaggaaattgggaggagcaaggtagtcatcaccaagtataggacttgagggaggtttccagacctttgaggtccaaattgcaaggaggaggggaaggaaggatggccaggcaatagttgggagggaagtgaagtgaagaccccaggctatctgtcggtacctttgctggctgctgggaggggcagtgtctggactctggagaccacgcctccagagaccacaccctccaagaggccacacccttctagaggccacgccttcgtggaaaccacacccccccccttgctctgggccagttggcagcccctgctcttggggctggaccactccttcccagagaccatccattgtacaagaagcacggtctttgataggcttggaggaaaatccctcttccctctccggatccataaggactgcagagagcagccctcacacagcaaggctaattcctggaaacccttaagaaccccagatcagcttgattccaacacaaaggagtaatcaaggcggttgcaaaggaaacaatggcaagtgttttgtgaagcatttttttaagagagtgtgatggaaaattttctttttgaggaagaacatgttctccttgttggaaatgaagttgattttagttataattactaccaaagacaaaggttcattttcacacagacaatgtgatgaagccccaaacagtggaagtcagctctgatttcaaaatagacgcgtgaaggtatccgtgcctctgggtgagaacaaacttgtaggccttagttcttttgtaggtgtgaaatgttctcctcaaaaactgcaacgttcacttaatgaagtttgaaactttgctgcaaagttttaaaaatcttttaaataatttactctatctaggaagattgcaaatgatagtgatgttaacaaattgccctatttggtcttagtggattgtttaattccttactctgaacaatacatttcttgtgttttcttatcaaatggctgaaatatgaaagaatgtgtggacccataaggaaaaaggagaaaactatgagaagaattaatagggttgaaagatgatttcaggtgattttcaaggctgaaattatgatattagaatctgaatatcttttatttaagaattgtaattctttctgagtggctttgcgagccttctttgtggatccttgtgaatccctgcagggaggggagagcaggtgccatcttgtccttgttttgcagaaggggaaggggaaccaggctgaacgacttgcccaaccacttacctaccttgcatggactgttgctatccaaggggagccgagacagctgggagatttgttcctgtcctttcttcatttaaggatttactctgtgccagaaactgtggtcaggcattggagagtcacagctggctaagacaccttgcctgccttccaggatgttctcgtctcatgcaggaggcagacataataggaggtactcttatattagtcagggttctccagagaatcagaagcaattgaaacagaagcaattatatctatttgcttacacacacacaaatatatatatttatacacatgtacacacatatatacatacacatacacatatataatttactatttactatatttatttattatgagaaatgggctcacatgattatggaggatctgccatctgcaagctggagacccaggaaggctggtgatatatataataattcagttggagtctgaagagaagctgagaaccaggggagctgatagtgtaaatcccagtccaggggctagagaagatgaagtgagatgtcgtagctcaagcagtgaggcagagaacacaagggggcagattccttcctctgcattttgttctattcaggccctgaatggattggctgatgcccacccacattaggtagggcagtctcctttactgagttcaccaattcacatgctaatctaatctggaaacacccatacagacacacccagaaatcgtgtttaatctgggcatcctgtggtccagtcaagttgacatgtaaagttaaccatcacactgacagtagaggtgtgagctaatggtctgagctcatggaccaggaagcaataaccttggtgtgtgtgggttgagaaaggcctgtgtcatggaaggctgtgtctttgagggcaagtagaagcttcttaaataaaaaagatgatggagaaggaagacaggatagcaaatgcaaaagtagagaaacttacttgaaaattttagacaacagtgagaagtacagtagaagatgaggtattgtttgggcaggatgggggacatggtgggagtgggggataaggcccaggtcacgaaagaccttctccattacgctaagggattctgacccatttctctaggtggggaggtcagtggaggtttataaacagaggaaaatgtcatgttgtataccatataaatatggtcgtaatttggaggatggacaagttaggtaaagggactcattttttttctctttgattgtctgcctcaattgggtatttctggattcctgaaatgaggcttcatgccctggactgagatactggccatcattaggaggagttagagtccatgattgattgacttttcttttctcttcttttttctcttctcttctttctcttctcttttctctcttctcttctttctcttctcttttctcctcttctcttctcttccttctcttctcttctcttctcttctcttctcttctcttctcttctcttctcttctcttctcttctcttctcttctcttctcttctctgttctgagacagagtctccctctgttgcccaggctggagtgcaatggcacaatctcggctcactgcaagctctccctcctgggttcaaatgattctcctgcctcagcctcccaagtagctgggttacaggcatgcaccaccacgcctcactaattttttgtatttttagtagagacagggtttcgccatgttggccaggctggcctcgaattcctgacctcaggtgatccattctcctcagcctcccaaagtgttgggattacaggcgtgagccactgagcccagctgattgtttcaatcaattttcaattttcaaactttgtggttttgcaacatgtacacaaatacctgcaaatatcctttctcccatttcaaaagaaattgaagggatatatacatacataggtacattttaaattgaaattgattgaaatttattacgtctttgagaatttttttttggagaattggagtttttcaggtacatctgaaacttgaggtacaccataaaaaatgatagttcttcccactcaccttacagaaagtccttttctgtatcccatgtgacaactgtagtcattatggcagccacagacgtttgctagataaagtaaagcaactgccgttttcatcatgcagtaacctgccacaactccatactagattctgtgcttggtactggggaaacacaagtacaatttttcatggttactaccttcaagggtaggctcagtagctattcagaaatagtctatagtcaagtgcacagagacaacggtagaatggtggtcaccaggagctgctgggagggaaaatagggagttattgtttgtttgtttttgtttgtttgtttgttcttttttgagatggagttttgctcttgtcacccaggctggagtgcagtggcatgatttggctcactgcaacctccgcctcccggattcaagcgattctcctgcctcagcctcccgagtagctgggactacaggcatggaccaccacgcctgtagtgataccatgtttagttacatcttttataaagattttcctattctccttattaacaatattttaacaatattattctaatagttatggttcaatatttaaagaaaccggaactacttagtcttttttttttaaaagacctaattcacgtgaaaaaggaaaaaccccttgtgcaaaaaaaatgaattttagaatgaaaccattctgactgggtgaagaagtctatttctaatgtggggggtatgggctgaatgatgttcttccaaaattcataagttgaagccctaaccccctagtaccttagaatgtgcctgtgattgcagatggggtctttaaagaggtaatgaagttaaagtgaggtcattaggttgggtcttaatccaatagactggtgtccttagaagatgaggaagagacaccgggagggtgtgtgcacagaggcaaggctgtatgaggacacggggagtagacagccatctgcctgccaaggaagggcttccagaagaaaccactcctgccaacacttcatctcagatgtccagcctccaggactgtgagacaagacgttcctattaagtcagtcagtctgtggtacttggttaagatggtcagagcaaactgctacagtaattgggaaaactgcatgtgtgtgtgtgcatgtgtgtgcgtgtgtgtgcgtatgctctcatcttggtgcacctgcgccagcatctgaatgcttgagttggtcatggcacactgggccccaggtgtccagagacagatatccaggtgcagtgtcagatgggccgttcaggttccttgggtccatctctcctacgatggccagtttgtttggaggatcacatcggatgaatggaaggaagtggtagctggtctcatggccatggcactcttcagcctatcaaatataaatgcagaagtcaggaccacaggaacagtctctactaaagtggaggacctgccttccattgcctttcggtgccagggagacctgggggaaagcctttcacctggatgggaaggtcttggtattgataccacatctctgccttgaccttcaatcactgcatctcatctctgatcacttttcttcagctttggtctttagttacaacattcatgcaattaagtgataaacgagttatccctaacttttttagattaaaggacacagcaatcacctttctgtccgagagcacaggcaaatgtttttgggtcatgtagacaggaggttgttttaaaaagccgaggtggtaccatgtgatgtttattttatgatctctggagtcagaccactgggttttaactcctgtctcctcagtttgctttatatcacttagcaaatttgtcagcttcctgaccctcagtttcattatctataaaatggtttaatagtcatttttttttatcaggggttttgagaagattaatgaggtaatgtattgtttatgtcacgtggcctgacacacggtaagtgcctgataaatgtgagcaactcttcctacattattaagcatcccatcaaattgtactttaggaattatagtggctaggaaatgcactttgaattccaacaattctggactatttagctccacttgaatttgtgtcagaaatatggtaaatttaatgaagctggctcatcgttaaaatgcaaagctgttctgagtctgaaaagagacaatgcctgggaagtatttaataggggcccagaattttctaagtgatcaataaatggtgacgataaaatgtgcagagtcaagatgggtatgatcttggtttccgtccagctcttccactaagtagctttgtggcctaaggaaagtctcttaagttcctcaagcctctctctcctcattggtaaagtatcaacaatagtcgaacctaccctcctaggtttgtggtgaggctgaaatgtgctttgtggggctttgtatcgctttgtattatggtggtggcggttttcccctgacatagctctctaggatatgtaatggtaaaggatgaataagggcttttcaaaatggagctctgagcggctgtgggagcaatctgtgtggtacatctgtggccccgctggctgccaggtgtctggagacctgtgctccatctctcccctcatgccatgtgcctccctcctgaggctgtgggttgcatccaagagaatgaccttcctcgacagaggagggcagctctccaggaaaagaaatgggaggaacttccttcttctgctggaacccccaactacaggtttaaaatgctgtgtgtgtgtgtgtgtgtgtgcacatgtgtgtgtgtgtacatctttagttagtgagaccactgtaggtggtttcaggtggtgtttagaaggtatggtgctgactggaaagggtggcaacagaaatgataactatccaaggaggtgaggcttatgcagtttgcaaaatgcagacaaatcggcatacaccatgtttttaaagttacatttaggtcaaggagaaaaatgaaaaagccttacttaggcttctgatgaaacggggaaaggaagaaagcaagtgtttttgactaccagcttagtgccaagcacggtggctggcactttccaaaaaattcttccattcagataaaaagagagagcactcaactccttttacctcctgttttcttgatcgaggagaaagctgtttacagtaaaaatgtatttgcaagagaattttaagataatttccaagaaaagttaggaaacggtaaactccaaatcagttggtttcctgatccagattaatcatttcctaggattttccccaaattattagaagacattgctggaccattgtcattagccattgaggagctgtagagaaagagggagatgtaatagaggcagagatccgaattctagtagctgtagattggtgtttctgatctcagtcccaggtgacaccctagactgatagtcaagtatatgttctgtgagaaacggaggccaccatgggttccttggggcaggcatggcgggtgacctcgtgggtttgtaaatagcatcactatgctagaagcattagtggaatgttgtagatatgggatataaaaatttagatgtggtgtatttgataaagtctctcttagtatccttatggaaattaagtgtgaaatgcaggaaaacagacaatggatgatggttcattgatgtggagacacaattagctcagtggctgattcctgaaaatactggttggtgatttgagagtagaggtcacccttgaggaacacctgccttacctgttttgggctcaacattttttatcagtgtcctgaataaggaccatagataataggcttataaaatttgtggaaaatgtagagttacttaaatgttagttagcagaacattggggttgcggttggaggccggggatgccgaggggaatgatccagttaagagggaagcaacccaccgggatgcgccacatcagtggtgaagtccctccacatcgaccgcttgctgatttgaagtgaaaagagggttcctcagtaaggacagacttaacagaagtacaatgtttcctttgcaaaagatgagtgttaaaagggaacatgcagaaaaatgatggcttacatgggatgaataaagacttagcaaactctggccagccatggtggctcatgcctgtaatcccagcaccttgggaggtcgaggcggggggatcacttgaggccaggagtttgagaccagcctggccaacatggtgaaaccccgtttctactaaaaatagaacaatcagccaggcgtggtggcctacgcctgtaatcccagctacttgggaggctgaggcacaagaatcgcttgaacctaggaggtggagattgcagtgagctgagatcgcgccactgcactccagcctgggcaacagagcaagaccgtctcaaaaacaaacaaacaaacaaacaaacaaacaaacaaaacttaaactctatgatcctaagtaaaagataagagaagcagttaactaacttccttttagttaggtactccagggtactactttttgtgatggcagacacacttaagctatttgtaaatgtgtcaccaccttttcaaataatttccttgaaggttaacatgttttctctgagaaaaatttatttaattaaaaaccttatgtatataagggctacaataaaattttcatggactctgagatgaaaagacatgtatatcttcttgaagttatatagttagcaaatgtaaaggctataggggtggattgtgtattatgcaactgctaaacactgtcttgcaatttgtgtgcgtgtgttttgtattaaaccatgtgctcctgtccttgctagtacagtggcttttataatttttgagatgatgcccatagtgagaaccacatttttcatagtgttccagggtatgcacatatcatatactccacacagaactgcaacaaaaaactcaggaaacaatacttaccctaagatgctttctcatttattctgctttatttgcttctatcctatttttatttaaaaatactgatgagagctgagtgctgtggctcatacctgtaatcccagcactttgggaggccaaggctggaggattacttgagcctaggagtttgagaccagctcaggcaacatagcaagacctagtctctacaaaaaaataggaaaattagctagatgtggtggtgcgtgtctgtagtcccagctactaggaggctggggtgcgaggatcacttgagcctaggagttcaaggttacagtgagctacgactgtgccactgcgctcaaatctgggtgacagagtggggccctctctcttaacaacaaaaataacaacaaaaaagtgatgaagactttctcctttgatcctatcagtcactattttttttttttttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggtgcccgccaccgcgcccggctaattttttgtatttttagtagagacggggtttcaccttgttagccaggatggtctcgatctcctgacctcatgatccacccgcctcggcctcccaacagtcactatttttaaagcaatgctctggcagagactgaatacacgtttaatgctatagctgtctcttttcttccaaggagaaactgttttatgttatcatctcatattacatcattttaaatgatgtcaagtgaaatactttgagatagagtttctattttatagctggagaacagggttacggtgagtgtcataattatgaaaaaagctggcatcttgccattggcttatggatcattttgcaatgatttgcccaaagcctgtcagccatcacatgtccaggaattagggaaaagaattgttgcttatagactcttagtgtaggaaggacatgtagaggtcatctattctaacatctcaccgagtgcgggggtcccttctgtagtagtttcacagttgaccattcggtatctgcttgattaccttcagaaacagagagcccactgtgttagttttttattgttgctataatacattaacacatatttcatggctgaaagcaacacaaatacattatcttacagttttgtagttgagaggtctgtaaagggtctcagtgggctaaaatcaaggtgttggcagaactacatttctttctgaaggttctaggagagaatccgttttcatgcctttttcagttcctagaggttgttagcattccggggccagctatggaggtcatgccattccatcttcaagaccagcaatggctagtagagtctttctcacatcctatcacgctgacccacaagtcttctgcttcttctatctgcaaccttaaccctcccttgacagggaaggtaacattcacagggtctagaaattatgatgtgggcccttttttttggtggggggcgcggggggcattgctgtgcctgaccacccccatcccatctccccaccttttccccctggcaagccaattctactttctgatggttctaattttgggaatcacacatatgttgacttatgacaatgactgctattcatgcagcaggtgagtttttaaaagagaaataaaggaatctgcaacctggagattttcaactttgagaccaccagccgttttgaaggctgagactgagcgaaaactggtagaaactaattcataggcagtaatgtctccctctactggctgcagagttaacacgtgcattttgcagatagaaatgcttggtggttgccagaaagagggtaacaatgagttttgaataaagagccgagaagtatctgtaagatacgaaactggtggatatcttagttgcactgtgcttacttggtcactgtggagaaggtatttttaaggtcgccacgcccaggcctcggaggttcggtgggttgggagggtttatagggagtcctttggcagttctgattttgttagggattcagatctgctgagccgtgtgagtttggtgtgctgcctgtgactctcatccacagaggggaaagaactaagcaaagggatgacttaacaaaagctgttttgctaaaaaaaaaaaaaaagcagacttatagatccttactgcttcattcttttaacactgaaattgcagtagttgagtaaacgctttaacatactttactattataaggatgccttcattttggagagatgaaaatttaattgaagaccaaaaccagaaagtttaaggaattacataaaaatattaacgtcattgtttttgtgctaagttcctcaaatgcgttctaaatattaaactgaatgaaaaaatcagtgtagacagtttttcaaattaaagttctttgtaaaaaacaaacatgtatcataaaataagtattactttttcctttcgtgcctattttggttttatttaagcatgggcaggaagagaccttgttacttataaatgaaaatatccattttcaaaatgtcactttctgtaatgtacaaaactgagtaagtgttggcaaagacatgtggcaagaagagacctttgttacttaataaatgaaaatatccgtttttaaagtgccactatctctaatgtacaaaactgaggccgggcacagtggctcacgcctataatcccaacactttgggaggccgaggcgggcggatcacctgaggtcaggagtttgagaccaccctggccaacatggcaaaaccctgtctctactaaaaatacaagaattagccaggcatggtggcgggcgcctgtaatcccagctactcgggaggctgacgcaggagaatcgcttgaaccagggaggcagaggttgcagtgagccgagatcatgccactgtactccagccttggccacagagtaagactctgtctcaaaaaaaaaaaaaaaattgaatagttggcagaaaaccctgtggtggccatggaggtgtgccactcagctgtccttccagggaacttgctatgagagtaattggtgacagtcttcagctatggaggtcatgccaaacctaccgtctactggggctgcccccagctgatgactgggcatggtgaggggagctggagctgagccctccatgcccctcttgggactcttctgatgggcaaccttttatctccctccctcctaccccatcagcctggccaaggctttctcagagctccactgcagtctgaggctccttctccataatcctccttccttccctctttcttccacaggtgtcagacctccatctgggtctgaaggttgtctatgcctactcctcctttttcccttcatccttcctaggtatttctcccagaaaaccactggcagttctaattctgtcttggagtcagctccttgaaggatctgaacatgtacctgtgtaaagacttatggaaagaatttttattttattttttttatttatttatttttttaaatttattttttattgataattcttgggtgtttctcacagagggggatttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgactcttaacgagcatgctgccttcaagcatctgcttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacagggcaaccatccgatttctcaatcttttccccacctttcccgcctttctattccacaaagccgccattgtcatcctggcccgttctcaatgagctgttgggtacacctcccagacagggtggtggccgggcagaggggctcctcacttcccagtaggggcggctgggcagaggcgcccctcacctcccggacggggcggctggccgggcggggggctgacccccccacctccctcccagaagggggcggctggccgggcagggggctgacccccccacctccttcccggacggggcggctggccgggcggggggctgatgcccccacctccctcccggacggggcggctggcctggcggggggctgaccccccccacctccctcccggacggggtggctgccgggcggagacgctcctcacttcccagacggggcggctgccgggcggagggtctcctcacttctcagacggggcggccgggcagagatgctcctcacctcccagacggggtcgcggccgggcagaggtgctcctcacatcccagacggggcggcggggcagaggcgctcctcacatcccagacaatgggcggccgggcagagacgctcctcacttcctagataggatggcggctgggcagaggtgctcctcacttcctaggtgggatggcggccgggcggagacgctcctcactttccagactgggcagccaggcagaggggctcctcacatcccagacgatgggcggccaggcagagatgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcacttgcggttaggggctggagaccggcctggccaacacagcgaaaccctgtctccaccaaaaccagtcaggcgtggcggcacgagcctgcgatcgcaggcactcggcaggctgagtcaggagaatcaggcagggaggttgcagtgagccgagatggcagcagtacagtccagcttcggctcagcatgagagggagactgtggaaagagagggagaggcagaccgtggggagagggagagggagagggagagggactggaaagaatttttaaatcccttcagaaagttgttcaatttccctctgccagtgatagcaaagaaggtggtatagctagagtagggtgaataagggagtgagtggtaagagatcagagagaggtggcagtgcagattgtgtaggacctctttgagcagtttattaatttggaccatgactttgagtaagtcaagccatcagaagttttgagcagaagagtgacatgatctcagttacattttagtaaggccaccgtggctgccagaatagactgaatggcagggattgggaggtcgggatgggaaggaccaaaatacaatcacagagaactgctgcagctgcagagagctgttgcagtgatccaggggaggaatggtagtagctggcatcaggatgctagcaggagaggtggagaaaagaggttggattccggatatattttgaatatagagataacaggaacagaggttggatatgagtagaaaaggtgttaaagaagactttaaggttcttagcctaagcgatttgaaggatagagctgccattttctggtgtggagaagattgaaggaagagtagctttgagtgggaagaggaaaagtttatattttgacttgttaagtttgaaatacattttagacattcaagggcaaatggagaacaggtagttggacatctgactactttctgccacccccactacaaccttcccagcccaaggcactgccttctctcatctggattactgcagtgcagtagcatcccagctggtattcctgcttctgccattgtcccttttctatttccacgcaacagctagagttagttccttgaaaatataagtcagacttctgcttcatgtattgatggactaggcattttggacacatattcctgttgaaggcaaccaagaagcccagataaagtctttgaaaaaatctacttgaagacagatgttagtgatggctaataatatgatgaagaattactgtccaggattcgggagaacatggaaatcaagagaggagaaactgacattcggatgcatttttctggagatgtacacttagtctagagaatgttgctgagagttctagaagcaattttgacagattgaagagtctgcaggaatgcagatctctcttcagcatgacacttgccaagatatggaatccacctaagtgtctataatgggtaaagtatgagatatatatatgtgtgtagcataatgatatatataatatatatagtatgatatatagtatgatatagtataacatatatagtataatgatacatatatatagtataatagtataatgaaatactattcagccataaaaaagaatgaaattctgtcattcttggcaacatgaatgaactatgaggacattatgctaagagaaataagccaagcatctgaagaaaagtgccacacatcatctcacttatatgtggaatctaaaaaagtttaattcatagaaatgactagtacaatggtggtttccaggagcttggctggggttagggaggacatgaaatggggagattgtggtcaaagagtatgaagtttcagttagatagtatgaataagttgtgaataagttctggagatctattgtacagcatggtgactatagttaatgtatgcttgagaattgctaagagagtagatcttaaacattcttactacaaaaaataggtatgtgaggtgatagatatgttaattagtttgagttaatcatttcacattatatacatatgtcaaaacatcacgttgtacacagcaaatatacataatttttatttgtgaattatacctttataaaactgggggaagagtaaaaaagagagtatggaggaaaatgtgaaattcaaagctagctaaggggttatcctctgtgtttgggattggttccctagagaactacataactaggaaaagagtgaactgaaaatagaccaatagcctggctattacagggccttatgtccccttaaaaatcatctcactaggttgggcacggtgattcacacctgtaatcccagtactttgggaggctgaggtaggtggatcatgaggtcaggagttcgagaccagcctgaccatcatggcataaccccatctttactaaaaatacaaaaattagccaggcgtggtggtgtgcacctgtaatcccagttactcaggaggctgaggcaggagaattgcttgaacccagtgagctgagatggtgccattgcactccagcctgggtgacagagcgagactctgtctcaaaataaaaaaaaaaaagtcatctcactaactgacagtagactaaggtgatcctggattatgatcaggcatctagcagaagtaaatgttaattttctctagagaaagataacatcgccatatgcctcaaattatttatatgatcaatttttttagatacagggtcttatagaaatctaaaatagcccagctgttccctggcagatgggaaaggaattctgagaaagtctcatctctgagacagtcacacagggctgtctaagactgaggctagggtaagagaagtgagaaactctcctgtctccactctgagctttacaccaagtaaaaagcaacactattgtactgctgaggaggggcaaaagccagagaaagatagcccctggcacagatgagcagggtctgctgaaagggaaggtgaagcaggaatactgagaaaagataccccaggcctcacactaagcccaagataatgacagttccccctgggaggaatttgaagtctgtggaacactgaaggcaacttcctgtagttacaaaactcaaacccagtttaactgtatactagatcaactcaacttctcacactaatggcctgatagaagaaaaggcatgtacatttctggttgtaaatattattatctttgattctcttaaatggaatgtttagtattcaataaaacatcatgagataaacaaaagagtcaagtgatggggtggggagggggaacaaggcccattgtcaagaaataaaatagtcaacagaaacagaccaagagatggcccagatatttgaactattggacagggccgttaaaaatagctatgattaataagttgaaggagttcatggaaaaggttaatactaggcttgaagtgatggggaatttcaggagaggtatgaaaactgtaaaagtgaatcaactagaaatgctagaattggaaaacataatatcaaagatgaagaattgttttgacaggatggtagctagcctctaagatggcctgtaatgatccctgctttcaaatctgcatttttttttttaggtagagtcttgctctgtcacccaggctgtagtgcagtggcacgatcatggctcattgcagcttcgacctccagggttcaagtgatcctcccacctcagcctccagagtagctggcactactggcatgcactaccatgtttggctgatttttaaaaaaatgtgtatgtaggtggggacgccctacgttgcccaggctggtctcaaactcctgggcccaagcaatcctcccacctcagcctcccaaaatgctaggattataagcatgagccaccgtgtctggcccaagtattcataatcttgcatactttcttcacacactgaatagggttggtctgtgtaaccaaaagaatattgcaaaaatgactgtgtaatttctgaagcaacattgtaaaatatattgtggcctttgccttgctctctgtttggtgacacgttctgaaggaaactattcactatgtaatgaggacactcaagtaatctatagcggggcctgtgtggagatgaattgagccttctgccaacaactaggactacatgagtgagtcatcttggaggaagatcctccagctctagcaagtcctttaggtggttgcagtcctggatgactccatattggtagtaatgtcatggcagatcatgagctagagccagcagcttaggtgctcttgaattcctgatccacagaaactgtgagatagtaaatgttgatggctttaagccacaaacatttcattgtgggctaatttgctataatagatgactaatgctgatggacatttcagcagactggacacttcagaggcagaattggtgaacttgaagagaggtcaataaaaggcatccaaaccaaacacaaagaatggcaaaaaatgacaaaactgaacatcacatctgagatatgtgaggaaaatatgaaacccatgcagtgggactcacagaaggaaaagaaaggggtagaataagtattttttatcaggaaaaatttttctaaaattaatgaaaggcaacaaatcacatatccaagaagcttagagaacctcaggcagggtaagtacattgagagtaaggattgggaaaatgtcgaagtgttaaggagagaagaaacctgaaattgcatgggatgatgtgagagtgaacagggaaatgtcacatgattctcactggtcccacttaatgcagtgttcaggtagagttgggttttttaccaaggatggttttttgtcaagcaagtaaagggaaggaagagagggtaggcactgaggaagcatgcaagggagatctgtgatgatggctgattgacatgctctgggtaatgaaagaagtgaggacttcagaggagacagcgtgggttgggagacagtgggctggtggcaagattaggaattgtagggttcaggggccagacaagtctgcacacaggacttccgagaatgtaagtgagatgcttggaattggggctgtgggggctgtacttagtaaggtccagggaatgaccttaggtatgagagatggagatcaggtggagagcgaggtcactgggaaagaacaaatcaagaaagtgacagactactttcttgaatgtgataatctgtgtgatttagaccattggtttagaatgcatttcctaggccccctttcttacttgatatgaataagagggagtaaatgatatgtttagtctctggtgaagacctagatattttgctcagctccaggtttaataggagggagggttgagttatttgttggaagttgagaggtctagtagtcccactcatttggaatgtctttattgtaatttatgcacaagaagaaaacatatagatactgtatggtcaagattggattgtcattccaattagacattcccccagttgtttgtcaggagtaggagaagagagcaacttgtataagaagtgggagtcggccaggcatggtggctcacacccgctgacgcgggtggatcatgaggtcagaagttcaagaccagcctgaccaacatggtgaaaccccgtctctactaaaaatacaaaattagctgggcatggtggcacattcctgtaatcccagctactcaggaggctgaggcaggagaatcgcttgaacccgggagatggaggttgcagtgagccgagatcacgtcattgcactccagcctgggtgacagagcaagactccgtctcaaaaaaaaaaaaaaaaccaagtgggagtcatcccttagttaggaaaggtatgaaaacttgcacccttttggttgtccacgtttccgttggtggttattggaggtgttcccttgggtctgaagtaccaagctcactaggatgacttctgaatgattcaccgctgatctgactgatccagcacttgtgatacttggaggacattgggcagcttctgagacactgtggttcaggaaaccttgaagttcctggcacagaatccacactggtaagcctcactggtcccctggcttggcacacattactgagagagtccctcccttagaaagaacaaccactgatttctgggtgttcagttattttttttaatcagtgtatttgtccatgttcatgctgttaatcaagacatacctgagactgggtaatttacaaaggaaagaggtttaactgactcacagttccacgtggctggggaggccccacagtcatggcggaagagcaagggatgtcttatatggcagcaggcaagagagagcttgtgcagggaaactcccccttataaaatcatcagatctcatgaaacttattcactatcacaagaacagcatgggaaagacctgcccccatgattcagttacctcccactgggtccctcccacatgtgagaattgtgggagctacaattcaagatgagatttgggtggggacacagccaaacgatatcaatcagtttgtctgatgttctctttaatgataatctatgtaaagatgatcagggtgaaatagaatttaatacttcctttcaaagcaagtggtcaaaggtcaaaatatttgattctatcataatcaagtgccagggattgttgtaagcaatctattaacttccttaattcccaaaacactctgtgatgatttttatcatccctgttttacagatggggaaattgagtcatagatcaagtaagtggcagggctgtgatttaaacctagataatgtggccacaaactgttagcctcaatcactgtatgatcctgtgcctcatggtgggaggaaaaatggacatggaatagaaccatgctgataactcgaaaatgcagccagaatctagaaaacataaaacttgggtcagtttcatttaacaagtaagctgtttgcaacatatttagtatgcaagtccctggtggtagatgacgcatgctttcaatgccttatgtaaggttactcagatacatttcatttattttcaggtatcttcaggaaatcttagtaacagcaaccaaggaaggtgcagcatcactttccagttatcttgtaatagaatatcatgaggcaagtaaaaaaagtccctgtaatagactatcttggggaacagaagtttctcattgttctcctgggctacagattctaaaatcacactgtccagcatccccttgttggttttttttttatttttctttttttttttgatacagagtctcgctctgttacccaggttggagtgcagtggcacgatctcggctcactgcaagctccgcctcccaggttcacgccattctcctgcctcagcctcctgagtagctgggactgcaggcacccgccaccacacctaattttttttttttttttttcatttttagtagagatgggttttcacctccttaaccagaatggtctcgatctcctgaacttgtgatccgctcgcctcagcctcccaaagtgctgggattagaggcatgagccaccgcgcccggcccccctcgttggttttaactgtgtgtattttacaatgagttttcacttgtagcttattgaaggtctgtcattgtgatagatttgtcttttgtacagcttttgctttcacacatggcatctatgtggatacctctagagaatctttcctatgctgaatgcagccttttgagtggacgatgtgaagccaagagagagggcagagaagaggtggtgtgtgcaggggcattagtctgtggctactcctctgcttggccatggggcccctggggagtgctggagtggccctggcctgagcagggccacagaggccccactcatttcccactgctgttgtgcaggaaagccactttgcttcccttcttcttcagatcctcttcactggctgttgagaaggagagatgcatataattaccaacataacttgagtgtccatgacaaatgacccttccagcactctcctaaaccaccagcttagcccgttgagttttactaatgctgtttgatgcagtgataaagcggaaacattgctctgctacctgcccaggatagcattgccatgtaaagggcaagtgatgtggactgagaccaccataatgcaggtcttcttggaaaagtatctaatgcaaggcagagttgcataaggggctgaataaccctgggttattcttactgtgaaaaattcccctacttttttcccgtagttacctgggctatataagaggtatgcatgctatgcaggggcctctgagagctataaatgacatagggtcaaattgaaccattttcccaccgactggggtgtcagaatcccaaccagcatgtgaagaacacaccctgcctcctccagcaggactcagacaggcctcctgtctcgcacagtggtggtttagaatgcatgttgaatgcttggatctttctagaccaggctgtgtatgggaaggggaatattggcaagagggagaaggttttcctgttcaagcatactacaatgggaaagcaaagttatgtttcttagtacatcaacagttataggttggtggttaaaaaagatgctgagcaggctgggtgtggtggcttacgcctgtaatcccagcactttgggaggccgaagcaggcagatctcctgaggctaggagttcaagaccagcctggccaacatggtgaaaccccatctctactaaaaatacaaaaaattagctgggcatggcggcgagtacctgtaatcccagctactcaggaggctgaggcaggagaattgcttgaaccaaggaggcagaggttgcagtgagccgagatcatgccactgcactccagcctgggtgatggagcaagactccatctcaaaaaaaaaaaaaaaaaaaaaaagatgctgaacaaaatattctagattcccgtagccagtggctctaccatactgttcatgggctatactatggactttgcaaaagtttactttacttcatgaatcatccagtaacatgatttgtgtgtatgtgtgtggtcctcattgtgaccatgaatttcagtccccttaaggaacaattatttctttgctggtggaaggagcctgggtcagtgacagtggggcatggtacttacccctcccatggtctctgtcaccttgtcatcatgcctttgtgctggtggggctgacctctagttctctagctggaaaataatttataagagagcaagcatgggggcataacagtgcagatgttaaggcttctaatatctactgtgagatatcctttcctcaactcataatttcttggtgaggaggaagaacaggcgtgaacctgagggttgtgcttcgtttagacttgacaagaatgtcaaagagtttatgatcttgcaataaatgtaattttccgtaaattggtagcaaatgatgtttctcgaaggggagtcccctagaagaatgggttatctttgaaagcagtgcttctgtttatctgtacagataagatgtgcgacgtggcatccatttgaataagtaggaaggatcaaaggaagataattctactctttatttgtcatctttagattgattttaagtaatttttttgtaaggcaaagatctctcatttaatactgataagttgcgtgggaaaatatttgtttttaacctttcttattatgaaatgtaaaatccacacaacatctagaaacagttaaataacaagtgaacactttttaaatcatgacctgaaatagaactttatgagtatcacagactctcaacatgcttaccccttccctaatagatagccactatcccaacttttgtgataatcatttatttgtgttactttttaattttaccacttttgcactggatatattttattttattttattttattttattttttgggactgagtcttgctctgtcacccaggatggagtgcagtggcacaatctcggcttactgtagcttctgcctcctgggttcaagcgattctcctgcctcaggctcctgagtagctggaattgcaggcgtgtgccaccgtgcccggctaatttttgtattttttggtagaaacgaggttttgccatgttgcccaggctggtcttgaactcctgagctcaggtgatccacccaccttggcctcccaaagtgctggaattacaggcgtgagccaccatgcccatcctggatatattttaaaatgcaccctgaaggtgttttattactgattttgttgttgttcttgttcatttagttctgctagaaagaaccatggcctaggagacaagagactgtgattatttttattctccagctcaatctagttttgtcatttaaagtctcggggcttattttcttatatgtggaaaaataagtgggaaattttttattagattggtggtttcataattattttcttttaaaagtcagatgaagtttatgaaaccacaatataaaaacaaactatttattttctaagttcagatgtatacagtttactcattataaagtcaacaaatgagaacacattgacatgctggcagtattcagcatgtaaacatttggaatctggagtcccctagcttaaaagtaattctactttaaaagtatgtaatagttgaatgtgccaaagccaataagcacatgagaagatgttcaactttgttagttattagggaaatgcaaactcaatctgcaatgagataccacttcacatccaccagaatgactgtaataaaggcagacaagtgttgtcaaggctacagagaaattgaaactctcatacactgctggggacctggtatagctgccacggaaaacagactagatttccttcaaaggtgaaatatagagttaccatatgaaccagcaattccactcctatatataccctagagaaatgaaaatatatatccacacaaaaacttgctcatgaatgttcctagcagcattattcagccaaaaagtgaaaacaactcaaatgtccatcagttaatgagtggatgagcatgatatgctgtatccatacaatggaatgttatttggtcataaaagggaaaggaatactaccatatatactaccacatggatgagtcttgaaaacattatcctgagtgaaagaaaccagtcacaaaggacaacatctgtgggattccactgatatgaaatatccagaataggcaaatctataaaggcagaaagtagatgagtggctgtcaggggctaaaggcagtgggaggattgggtggctaagggatgcagagttccttttttggggggataaaaatgtccttaaattgattgtggcaatcaactgtgtactttaaatgggtgaattgtatggtttatgaattatatctcaagccattatttaaagagttgaatgtgcaaaagtgagatcatagtcttacatgatattaagtagggagtgagtggtagagaggaaagatcctgttcctgagaagaagataccatgacaatatctctgtgagaggtacttggtgtctatctcatgggttccttttcttctacactgtttatgactagagtcacctcttctggcatgcctactgcctaatgactgtcttcattaccactaacattcatatctccaaaatatttctatttagattcatttttacacagcgcaaaacactaacagattcaaataatttgacagactctatggtactgaaactatggtggctttgacgaaatggaatcattgtctggcaggcagtgctgtgtgacgtgctagctcacaacgtgtgtgcagagatgcaggcgagttaacactcagtgatgtgtaggcgatgtgtgcctgaaagtgaggtttgttcaagagctaaacatagaaaagtggatgactgtctgactctaacacatttgaatgtgtatgtttctgtaagaagagttttgataagttcgaaatctaaaaaaagaaatcagaatgaagtgttcatggaaccctgaagcaccgttgcagaacagtttgtaaaccacaaagtttaattacacctaacgtcttttttggctttcatattttattgttttatttcatttatagctacatttgaatatctgtttatcagctttcatccaaaagacttgatggattgatttctgatatgtgccatcttggtagggtaattattgtgcttgattatttagacagtagagcttaaaattaactttagtggtattgcataatggaaactttttataaggccatgcaaatttattattaagtgaatcatcacaaattaagttgtgactagttcaccgctctgtgaacttgaattctctcttgcagaacacacaacactgatgccccaattgggggtgtctgaaataccccagcacaaaatccatttactcacagaacttatttatgttctccttataaaattggagacaataaaggcttaattagggataacatgttcaactttctcatttccagatgtgtaaatagagtgaaatcaggcactcctagttggtggagtttgttgataaaatctttgagataattttaggaatttggaattagaccatatttgttcctggggaagtggattaattattataagcttactctgaaccattacaggtgtctttgacttaccttggaccataggatttctctggagtatctgcataaagtccatctataatacaatgacctggcctcaccttacccagcctcttagtatccttcagatatgcagagctaggccgagctcagtgtcttctttattagcagctgcagattagggagtgcatctgctgtgttatagtcacttttggaagcataatgcaatggatttatgtattgtcctgtttaaggacatttatattgtttcattttaaaatttttctcatagaaaatcattctgcaatgcacaatcttgtacatgtcttcttgtgcaaagtgtgagaacagcttctggatgtatttaggaatggaattgctcagaaatagagcatgcacatattttgtttctttttcttgtctggctgtagctgctagaatttctagtaccatggtttatagaaacaatgttggtaggtgtccatgtctccttcctgacttcaagagggatttctaatgtttcatcattaattaatgtgtttgctgtaggattttggtagaatctctttgttgggtaaaggaaatcttcttattccttgtttggtgagaatttttatcgtaaatgatggttgaattttttcaaattccttttcagacaacttgttttgatccagtcctctgagatcttcctaatgaggcgtcccccaaattgcctatcatctcatgtttatggggtagtctgggacctttagtgacttaaatttagccttcatgtcttgggtgcagttgttaagagaaaaactggggagtataatgcctcccctggttccccaactgggaagatgtccagagaccaaggaatgactcaaacaagtccagcttggcaagcggatgagtttattaagacttacatatggggaccttctgggcggcagcgggacagctttagagatcggccctgcctgccatttttaagctgcttttaagctaattttctggctctttgcctacagtgtgtgtgcaatggaactctttttgctatgttcccggatcctctccaggatgtttgggttctcagaaacaccttcttcttggctgggcactatggccttggttcaccacttggacctcagggttcaagcagtggacatatgcccttaagtaacctgatgggggacctgtcacactacagaagtcatgtaactttcagttaacaactgtgccaggattttcacttccccaggacacttgtgggatttgcaaacaacagatcccttcttacagccagccaatcagatatattcttacctaagtggctcctcactggagatgccttatgaccaggtggggcccccattgccctgactgcctccttgggtctttctgaagccctgggtggctgtcctcagcttcttgggcatgtagggtggctccagcagcctgagggaaggcatacacacttgagcacacctgagaggggcctgagccccgctctgtcctatttctcatgttcttatgctgaagagtttgccaggagcttgtatgaaactgaagtgctagagtctgttattcatggacaaaaaggggaatgctgtatttttggtaatatcccaatgccctatctaaaggaaagtcaaacaaggctggaagctggggctttgaattaagaaaatggcctcatgctccatttatctaaggtaaatttgaagaacacttctggggcttgggtccctgggaaggaagcaatatggtaggataaaggagaatacccagtaatctggggtgtaccacagggcatggaggaaaggggaaccctacaacctgactgctgcagtgctgccagggttcctgccaccctgtgatgaggagctcttcattggtggggcagttgggaagagcatgctgctctctttgggcaaagagatttcccatgtcatagactttgatctcgtccgcactgtgagctccaggtcagacacacagagggaccgctaagccctagagtgcaacacttcactgcccattaacagtttattttatttttgcctgcccttgtttcactggaagctaggtatggagagagaatgccagaggtatcattacctctcacttttctctaatacagatggaaaccagcattgcaggtaatttcgggggcctctcggtagcaccggctccccactgggaaagacatgcattagatgcctgcctgaaaaactggccggctctcaataggtttagactatcgttcgaacaccttcttccttgaaaaaagaaggttcagtagttcctcggtgttcttaaacttaacattcacagtttgtcttcagtgagtaacccttaaggtccctaaccagaaattcataaatttgccagggcacaaaagtacctgcatttccctattgttttgctgttctgatttgatgatgcagaaatgtaaatcaatgtgaatcactatgtaaaacataaattgagtcattccttgaaaactctctgagaattcccattgcatttaggctgaaacccaaactttctgacatgagctgatggtagccacagtgtcagggtcccgcctgtatctctgatctcattccatcctgctttggctcacagggactttctgcaactcttaccctctcctcaactttggagagctttgtctttccaatgtagaccctgtaactcaactttggaggagattcctccaaatgctgtagctgctttgcctacagcagccagtggctggaattaatgtccctggctgtccccagcctcccataactgtccagtatggaagcatgaaagcccagttcacgctttcacggggcagaacttaccgtgtagagttccactggagtctcccgtggcccccttgcttggttttcaccccatgcctgtcttgctttgtccacaccctcactagcctcctaggagcacttccttcctaatcctcttgcactggactcttccttttagggcccgtgccttgggaatccaacctaaaatacatcacccaactcaaataccccctgtctgaccagtgttggggaaaaagaacaaaaaccaaaatctcccaacccagtaaactactctgtaaaggtagtagaaaaagaaaacagtttacttattgaataaatatcctagcactttgggaggctgacatgggtggatcaagaggtcaggagtttgagaccagcctggccaacatagtgaaaccccatttctactaaaaatacaaaaattagctgcgcatggtgacatgcgcctgtagtcccagctactcaggaggctgaggcaggagaattgcttgaacccgggaagtggaagttgcaatgagctgagactgcgccactgcactccagcctgggtgacaaagtgagactctgtctcaaaaaagaaaaaaaaaaaattagaccagaatgtgacgcatgttataggccatctactaaaagagtgccaagacagaaatctgacccttttatatagccaagtagacagaacccattatatacatgttctcaagacagactactccttaagaaagaggactcgacagcactatttgttacacatagtttatgctaaattcacctggtaattagggtgaccattggtgttaactcattcctatctttatgtcagaaggtagttttgcaacttggagcctggtacctgccgaagttagactgccgtcttccagtagagactgcgagatagggacactatcttctttggatgtttacattccaaagagatgtttctcaggtcctggagaaagacatttctgggtcacagagctgacagaaacatcatttagcttttaaaataatttacatatatttcaaagagataagaaagaacttacaacttttctatagtaaatattctaagaaaaaggatgggcaacatctcttattttttatctgtgagaattaaacctcttatttttaatttttatttgtcttcatactataggtctagctgccctggagactctatcatattccttgtgctattttcctcagagctttctgaatgtttgatacatacacaataatagatgtaacatatacttaagttataaagtctagtaataaagtaaatacgagtgaaacatgcatccaactcgagaactggatcttgggtatcccctattccaccctcagacgtcccctaacctgaattttgtgtttataatttccttgcttgtaccactatacatgattccctggccaatagttctaaatgaaccctgtagtttagctctggagttgaacaatgagaacgcatggacacagggaggggaacatcatacactggggcctgtcggggggttgggggagctaggggagggatagcattagaagaaatacctaatgtagatgacgggttgatgggtgcaggaaaccaccatggcacgtatatacctatgtaacaaacctgcacgttttgcacatgtaccccagaacttaaagtataataataaaaaaaaaaagaaaaaaagaaaaaggtgcactgtgggtagactcttgggactagccgtttgcaattagcattgtttctaagacacctatgtggttgcatttagctgtgcacgctcatttttgttactatctaaatattcctttatgtgaatatataagcatatatccattctcctgtctgtggacaactgggttgttcctggtttgtgatatgaggaacatgcttctttgaacattcctattgtatctcctggcgccatatgcaagagtttttctgatgggtactcctagagatggaattactgggctgttttgttttcctatgtatgcctctgaaaacatcttgttcattggcttgtttcctgctcactgtctgtccacttgcctctgtaccagtgtcagcaggcctttgtctcagtcttggtacatgttggatatagacctactatacccataaacatgaatgacccagttctagatgaccagttttttgaaacagaccctccagaaatcaataactatctattcttgtaatggcagtgaagaaaaaaagcaaggaatactgggaaactgggatgattgttagcctgaaaatagaagttttaagggaggaattagatgcctcagctatatttttaaacgagggggtttctgactgtcaaggtctattattagttaaagttaaaagggttttctcttccagctgccgctgtatttgggtaaacaaaaatcctgtgtaagacttcagaatctcagtaagcagggtaatgtcggtattaataaaaatgttagagtaaaatttgccaagagttagtgtgttgataatagatattgactgcagagggactatagcatatatttgggtaacaaatttgatatgtggtgttgtgtttggtatcatgaaaacataagtaattgttgaatttctcttaaaaagccagctctttagaaggggtggggaggttttatcagatggtagggtttggaaatttagggagatgtttaagtgtaacttaaaaccttacttcgttgattccagttgttttaaccccacatttttaatttagtgtttggcttctattggctctaagtcaactatctaatgaacacggcactgctgggaaggggcactgccgaatttagcgtatggtttgtgtcttggagaaagttgttcagttgacttggagaggaatgcgtgggaatgcagttccaagaatcactgacacagctctcctgggaacccacttcaaatatgtagataacataacagtcggcatgcttggagtaaacaattcccactgctttgcaggatgcgctccttcttatagcactttgttgtactgccagctgtttttcttgactagttcaattgtgacaatgtaaaccttttaaaaatgcattttttcaccagtttctgtccactagcaaaaatttgctcctagctccactgagagttgggcttttttgaattgtcatgttgccagttttctttcacttggaggatgtgttcatctatttccagaatgcattttaagtattaccctcatctattctagtagttttgttcctgaattttaaactacagattaatcatcccatttaatctttttaaaaaagagattatagtttggagacacagcttcttttggaatttctttctggttaaaagttagaataattgcctgcttataattagtttagtgttgaacatactacttgttaaaatctaaaattgcccttaattttataccagctttaaagtttgggagctgcaaatgccctttgttctggggatggggatgattaatgcctggaaaaaactatgagcaaacttcagggtcaatcagacaatagatatctcattatctattgaaaatatagatgtgaaatctcaggaaactctttttacttaaaaatattaagtgccagaaaagattaaggctactatgctgaattgcatatttacatgagagattgagaaatctttctttttaattgacaaattaaatgatttttagagcatttttagtttgggttaataattaagcagataagtgagaactttgttagtcttgctaattttgataaaattccctatttctattactgtaagaggaaaagggtgtgcacctgttctggtaataccaacagtatccaatgaaaaaatattatgagggtatgggggtaggggtggaaatacacacaaattatctgttgctttgtgtattcttttttcaatcttttcctctaaacttgagcccctcacaattcacgttccttctgttcaatgaccattttgtatcttcagtttgaatttatctgagagcagtcatgcaattaagatttcattggtgatcacattttaagtttcattatgagtaacttttcactaagagatgtctgccaacctcatggtgaatacatcatgtaaaatcagctcctggattagaagagccatttcttaacatttgtacattctcctcatggtatacctggcacattatccttgtgccttgaatgtttgttgaactgaatcctttgcgatcccgcaacactgtggctatcagagagtcacaaagtttaaactggatctagcaaagtccaagcgagtatagtttctgcaaaagcttcttatgttgggataacagttagtgatgggatgttggccaatttcaatggtgttttattaaacagacctccactagttaccttgatttggccttggccttttcatggcaccctatctggttttattcaggccagagttaatgatagttaggaagtcatgtggtcgaatcatctggaaattttgcataatatgacagttttctcctgaagcaagttccaccgcatgtcgtgtcacacatatattatggtggagatgacatgggcctgcagatggacttcggctgaagtgttcagggtctcatcaagtcagatggtaggataaacaagatagttaataaaacagcttttaacctctctttttaaaaggagattggttttcactgaaatacgtgcacgtgcaggaacagaaaaccaaacaccgcatgttctcactcataagtgggagttgaacaatgagaacacatggacacagtgaggggaacatcacacactggggcctgtcgggagggctgggggatgtgggggagagcattaggacaaatacctaatgcatgtggggcttcaaacctagatgacgggttgataggtacagcaaaccaccatggcacatgtatacctacgtaacaaacctgtgcattctgcacatgtatcccagaacttcaagtaaaaaaaaaaaaatatatatatatatatatatatatatacacacacacatatatatatatatacacacacatatatatatatgtgcatgtggtatggttattgtaaacacaagtttattgaaaaaggcagcatgggagaatagaaagattttgggttttgaagccagctagacttgcatttcaatcctgtttctggctgtgtgggttttggacaagccaatctgagcttccatttttctctcataaaaataatgataattataccgacttcgtaggattgttaccaagtgtctagtacacagtaggcattaaatactaagacctttgtgattttattgtcgttggaattgccctgccctttcagatctggataagattgcctttgacctctatttttcagattttgggaaatccagccccctaccccaaattttgtgaattcttcaggttcatacatttttgttttcacttctgttcccaagctctagcttcctctgaatgaattttcctcttcgagtgagcaaatcaagtaggataaattgttcaaagcatttctggagtgttcagagagtcaaatgtattgggagataattatactttgaaaacttaggcaataattgataccaaccatgatagaggaaatatttttagagctgcataatttgtttgaaaggtgtcgcttattttctatgcctatctatatccttgaaattttgggaagttaaaagacagttttagtttgaggctagcctgagcaacatgctgagaccccgtctctacaaaaaacaaacaaaaacaaaaacaaaaacaaaaaaccaaaaacaaacaaaaaacccccgaaaacaaagcaagaaaattttaaaggaggtagaatacaagctttgagaagtacatggtatggctggtcagtttacaagggtgtgttgatgagatttagcagttaggcctcaaaacatacttgaagccaagtgccataaacacaataaaataatggctcatttaataggattaaccataggtagcattccaactctgaggggaagaatacaagacagtagcagaaaaattgtcaaattccattaagagtggaatgaaggcttttttcttctgtgaagtgtgatgaagtttccctcccacacacctgttatacattaccacaatgtatttgattagtttaacttttattttgacttctccgttaatttcattggaacattaagatattttatagcttatcattggctatcctatttccttgttttcatgtgaaatgaagtccgagctacttcaatgctatcttgaaatgctgcctttctgggaatttttaggtgaagaagatagatgtgagtattttcaaatacatgagccgttgccatgattagttacatatgctggcccattttccacccgagatagctcattaggggggttttgtgttataagatgagtttgaaggctcaacttaatacagtaactgctactgctgttgtattagtattataaaagcaagcaacatttactgagaacttatatatgccaggcacagtgccaagtattctctgtgcattgtcacttgcaataaccttatgaagttctctcattattttcctttgttcctttcctttcctagggtttggaaatcttaaataactttcgcaaggacatgcaagtgtatgtagcagagttgggcctcaagcaagacctgtctgacttcagaggtcacagtcttgatcactgctctagggctctgcttctgtaacagctgcttcttgagatgtaggaattaagaggcatgtaaggaaagctagcatctggtttcatgttggatttggcttggccctcaatctatcaatatcattgatgggatgaattcagaggatggaagattcttggaaaacaagtttctagatagggctgggatggaatcttttctgtttttgtatccccggtgcttaacctaatacctggcatgtggaaagcccctgaagacagatatggcaggcacttttcttggattggcagttgaaaagaactgaaaacaatgacaacaacaacaacaaaaacacaaagaacacatagcatagtctgtacaaacatctcctgtattctatgaaagaaaaaactagaggtagaacataggctaatgggaatattgaaactatggtgccttttccaggtttttaatcatagatttggagaatttgacaatgccgagatgaagctcttgaatgttttagctggaggattctggaaatccttctggagttcatgtctggaggaattaatagagaattcctccagattttggtttcaaaagctttaattttgcttttgattttcaggggtctacttaattccaagtgctctggaagaagagtatgctgatttgttaacatgagggccaagtgtttaagttggtggttttagttttacttggagaacctttcttcttttagatctcagggtttcgattttgaaagtgagtttaaacaaatacacaggagtcactggaaaaagtaggttgggctgattaattttcatctagattttaaatttatgattcattttagatctaggaatcatggtgctgttaggaaaatagttttagaggttatttaattttgcattaggagtatactgtgcctgagctttcattttaagcttgatattaagaaattcatattcagatgcagttctacatttgctagaactgtccagagacaaaattatgcttctcccgaagggcattattacttacttgaaacagaaaccgagtatgtgcctgttccagtaatggatatgtcagggtggaataatcaccctaacagaggcagccacccaaagtttttgtgttttgactagagaaaatgactcttagcgatgcataagacacccctcaacatgttctttgaatggttgctgatgttatttagcaataattcaaattaagtgatgtttcttgctgtaaagaaaaactgagctgtaagcaggatagtgatatgattatagaactcagtcagaaagatctaagttaggagtttgctacttggaatctatctgtatttccttaagacttcagttttctcatctgctgggtgaggatataagtacttgaaaaggtatacggtatttagccagtgctaacttagccattgtttttgttgttgtgtgtaatgatgcagacgtcatgatgactgctgaaggagcagaggaggacctttacaatcaacaccctttaggaaatggtggtgggccaaggacagagtcaaaggtttttaagcagtggggtgtggcatggacattgatcttgcagctattttcttttctttttaaattttactttgctttaagttccaggatacatgtgcagaatgtgcaggtttgttacgtagataaacatgtgccatgggtggtttgctgcacccatcaactcgtcacctaggtattaagacccacatgcattagctatttgccctgatgctctctctcctctagcccccaccgacaggccccagtgtgtgttgttcccctccctgcgtccatgtgttctcattgttcagctcccacttatgagcgagaacatgcggtgtttggttttctgttcctgtgttcgtttgctgaggatgatggtttccagcttcatccatgtctctgcaaaagacatgatttcattcctttttatggctgcatagtattccatggtgtatatgtgccacattttctttatccagtctatcattgatgggcatttgggttggttccatgtcttcgctattgtgaatagtggtgcaataaacatatgtgtgcatgtatctttatagtagaatgatttatattcctttggtatatacccagtaatgggatggctgggtcaaatgggatttctggttctagatccttgaggaattggcacactatcttccacaatggttgaactagtttacattcccaccaacagtgtaaaagtgctcttatttcttcacagccttgccagcatctgttgtttcttgactttttaataatcgccattctgattggcatgagatagtatctcattgtggttttgatttgcatttctctaatcatcagtgatgttgagctttttttcacgtttgttggctgcatgaaacaaaaattaactcaagatggattaaagacttaaatgtaaaacccaaaaccataaaaaccccagaagaaaatctaggcaatgccattcaggacataggcgtggacaaagattttatgatgaaatcaccaaaagcaattgcaacaaaagctgaaattgacaaatgggatctcattaaactaaagagcctgtggacagcaaaagaaactatcatcagagcaaacaggcaacccgcagaatgggaaaaaatttttgcagttacccatctgacaaaggtgtaaatatccagaatttacaagggacttgaataaatttataagaaaagaaaaccccatcaaaaagtgggcaaaggatatgaacagacaccagcagccattttctaagggctttggtaacagtcactgtgctggttgctgaatcagatttgtgttttaaaaagatgagtcagagtgtgtgtatttagacagggaaaccaattaggatgctcttgcatgggtgagagatagtgaaggtctggacaaagagtagatgtatgtgatggacaatttggagcaagaatgaacaagagacaaagcggtgaagattttgagatttggggggaggggaaggaatgaattaggaagaattaaaggtttctagtgttggcagttgagtaacttgtggctttattaatggatgtaggacagataaaaggaacaagttggtaggggatcaaacagaagacagggtcttccctagaaagtctttaactgaaacctaaactgttctgtgtgtgtgtgttttaaataacgatggacctttattacccatcattattctggcagttcaacttggcgataatatttctataaaataactgtggtgcactgatgcaatacatttggaataatgaatttaatgttgagttgagctggcatggaacagttatagatagtctgggggatgtgtatgtgtagcattttttttttgcagggatagttgttgaaggttataaactataatcaataaatcttttttttttaattttcccaataattttgcagacaatctgcaaaaccgttattttaggccacaggtagaaaatgagcaacataaatttagatgatgcttctctgaattgttacatatttttcatttaagttaccccaaggctgtgtttgtattggaaataaagaagtggttttctgctgtaaaaatactgttttgctactaggcaaacagggtttttgttttgttttttattctgaaaaggtagattttatctacttttaaaattttctgggttggtactcatgactttcaaaaattttcattctaaaggacagtagatttaaagggtggatgaccttgggaagcagctttgtcataaattgataagtgcaatttaagagggagatgagtaggaataaaaactgcaacttgcaagaggggctctgggctgcattgcagtcacaagataacattgctaacttccagtgaaatccctggtgggaagcagctcaggagttatggatgcggattatgagttatgtagtttttatgcaaataagattctgggcttctcttcaatttagatttacgtttccaaacactcctagtggggctggtttggtactccattgttattttatgatgacacaaataagaggctttatccaatgataagcgtgtgattcattgctgttctgaagagctgtgagccgagtgctttggtgcaggcagcctgagatatgttgaaacctgcagtgattcagtgatgaagatatcccttgcaaggcttgaaggactattggctgaggaaagtcggttgcagcttattttcagtttttggttggtcagtgaaacactccaaacctgcttacctagctttctaaaaacaatgtagattttcaggcaggtgcagtggtgtgcctgtaatcccagctactcatgaggctgaggagggaggattgcttgagcataggggtttgagaccagtctgggcaacatagcaagaccctatctcaaaaaaaaatgtagtttttaaactaaagaattcaataatggcctgtacagatttggacctccgtcctatccctagagggacattttatagacttcattatatataatatatgttgtttaaagtgtattatatgtatgtatgtttttcctattttcttcttgttagctttaaggatgaagtaggatttttaaaacagttgttaaagttcctcaaaacagttgtttaagttcctctgtagcaggccaccattcttgtcagcaataaaggtgaagaatgccccattacagaaaagaaaataaacactttctcattgttcatactttctactcttgtactaagcttcagatgccactgggcgccagttgctttccaagcctcaaggatccttagggatgttggggctttctttggtgactgttgtctccttgtttgctcaaattaagctccccagcaaaagagggaagtgaaataaattaatacatgaaaccaagaactgttactgaataatggtatatatatatttttttcttttcttttttttttttttttgacagagtctcgctctgttgtccaggctggagtgcagtggtgcggtctcagcgcactgcaatctccacctcccgagttcacgccactctcctacctcagcctcccaagtagctgggactacaggcgcccaccaccacgctcggctaattttttgtattttttagtagagatggggtttcacaatgttagccaggatggtcttgatctcctgaccttgtgatccacccacctccacctcccaaagtgctgggattacaggcatgagccgaatagtggcgtatttaagaaagaaaggggaaattagattccattttggaattttattgagcggaaaggatagatgatttgattggaaactaaagggagatacttccagttttgtattggaagacaagttattaaactttcacgaaataatgttgatgttcatttaaatgttcttacagtttgtttctaaatgatttagtagtttatgtaggaccagctatttaatgatcctttgatcattaaatatgcagttatatatctcattgggatgaatgggaatggctaggattgttactgattcttgcccctaaaaagagaagttgaattcagaatctcttagaaggcataaaaatttaccatcaccatggcattgaggaaggcaacacaggcataaagtgatctcattgttcaacctcgtcaccatttaaccagctgtttccttacatatggtggcaccctttctgagagcctgtaagtattttttatagccctaatcatgtgctgtccctcttaatcctgggcatttaccctgctgttccctctgctgaacctcacacatgtgttccctctctaactctggttagacatttaggcttctttctgttggagagacctgccctggtccttcaatcgtggcttgggctctgtgttctctgacctcttcctctgctgtattcctggccatcatgtcaagtgtttctcaaaatgtgttccgtgggaccccacccaggtgctattctccacaaaatctattctcagaaagttctagaatggatagtaagatagctgcactacattgtgaaggtactaaatgccaccaaattgtacattttaaaggttaattttttttgttatgtacattttaccacaacacaaaaacatcttttgaaagatgtttctcaaaagaaagtctcagactcaaacatgttacacttacctcctggaggttttacaatgcatattagtaaagaatctgagatgtcttaaaggaacccgcttaattttgcttgattcaatgttcccaaagctattaatagactttaagaaaatgcacaactacctgttaatgtccagctagttaatattcttagggatacaaattgtaattgcctgcttaatcatgctctcctatactaagtggtagggatgggaccatatttgtagttctagaccagagatcaggataagccttcagtaaatatgtattgaatgaaatgcttaagtgaatatagtaatatgtagaatgtggtggggcattgtgaaaggaacacagagtcacagagatcaagggttcaatcctcccatgatcacatttagctgtgtaaccttcagtgagccacttgaactctgacctttgatttcatcctgtattaaatggaaatacaccccagttaaaatggcgcttatcaaaaagacaaaataatagatgctggcaaggaggcagagaaaggggaatgcttgcgcactgttggtggcagtgtaaagtagtacagccactgtggagaacagcatggagatgcctcaaaaaaccaaaaatagaaccaccatacgggccgggcacagtggctcacgcctgtaatcccagcactttgggaggccgaggcgggtggatcacctgaggtcaggagtttgagaccagcctggccagcatggtgaaaccccatctctactgaaaatacaaaaattagttgggtgtggtggtgtgtacctgtagtcccagctacttgggaggctgaggcaggagaatcacttgaacccaggaggcggaggttgcagtgagccaagatcacaccactgcactccagcctgggtgacagagtgagactccatctcaaaaaaaaaaaaaaaaaaaaaaaaaagaaagaaagaaagaaagaaaagaaaaagagaaagaactgctatatgatccagcaatcccgctaagtaaatatccaaaacaacagcaatcagtatatctaagatatctgcactctcacattcattgcagcattatccaccatagccaagatatggaatcagtctaagtgtccatcaatggataaatggataaagaaaatgtgatatatacacacaatgaaatattcgtcagctgtaaaaaagaatgaaatgctttcatttgcagaaacatgggtgaaactggaggtcattatgttaagtgaaagaagccaggcagagaaagacaaataacacatattctcatgcatgtgtgggaacttagaaattgatctcacggagatagtgaatagaatggtggttgctagagaatggaagcgtagtgggaagggacggtgggaggagctggttaatgggtacaaaaatacagtttcatagaaggaataaattctggtattcaatagcacaatagggtgactataactaacaataatttattatatatttcataatagccagaagagaagatttggaatgtgcccaatgcaaagacatgataaatgtttgagataatgtacatcccaactaccctgatttcatcattatacattgtatgctattatcaagatagcacatgtgcctccacaagtatgtacaactattatgtatccataaaataataaaattgtaaaaaccctcagaattaaagtttacaaattgcttaaaaaatggaaataaaagtaccttcctggagtttttgcaaggattacaagagttaatgtgttttaagtacatggcatagaaagtaccaaataagtgctagtttctttctcttcccatagaaagttaattaccataaaatagttatagatggagtgagttgggtgtttagagtgagaagactttcagctgtggggatcagggaaggtttgtggtcttatgagctaaaggattggaagaattaagacttacagaaataaagggaaaggacattgaagagagagaacaagataagcgtctggaagaaagagattagagttcagatgctcttaaaaaatatcgtgttcactttcatattttatccttttcatatatgccttctcccgggctttgaaggaggaaattggtgatgttttcctcattagacatttatctataaggatcacaaatcagacaattttcccttattttcctttttctctcctgttttcttctgctattcttaaaaatgattggatcccacccttcccatcttcagctgtagcattttgagacattgtgcctttttgtctaaaatattctatttgatgaacggttaaactaatagtctgtgagctcctttagggcaagaatcacgtccaggtttcgtctcctcagtgctgagggttgtgctcaaaacagagtaggtagggaaggaatgattgccgaatgaatgaatgaatggagaaagagtggatctagttccatgggcctaagactgaggcccatagtctctaatgtgtttatgcaaaatgctgcatggtagctgctaatagaaagcaagttctttcctccagttctgatgtgatgtgatctggcagagggcagcatgcccataaatcaacacacggtagtgtaagtcatccactggtgttagaaagttatgagtaaggccaggcgcagtggctcacgcctattacataatcccagcactttgggaggccgaggcgggcggatcacctgaggtcaggagttggagactagcctgaccaacatgaagaaacctgtctctactaaaaatacaaaattagctgcgcgtggtggtgcatgcctgtaatcccagctactcgggaggctgaggcaggagaatctcttgaacccaggaggcagaggttccagtgagccgagatcatgccgttgcactccagcctgggcaacaagagtgaaactccatctcaaaaaataataataataataatgagtaaaagcaaatatagaaattggaactaattaatagttattttggtacaggatgaagtatagtctatggggcgtttatctaaggaagaagaggtgatcaaatagacaggagagatgtgttacatgtgtgtagaaaaaggctccgtatcattacatagatgagaaatacacatctgttttatggtatttttcattcaattcctcacatacttacttaaatgtgaactcaggccgggcacagattacgggctcatgcctgtaatcccagcattttgggaggccgaggcaggaggattgcttgagctcaggaattcaagaccaacctggacaacaaagtgtgaccctgcctgtaccacaactactactagtagtactactactaataatagaaaataaatatgtacttagcagtgggttgtgaatcagagggctacaaagagattatgatggagcaatgctttgggaaagtttcaacttatagggaaataaaacatacaaatctgaaccatcttttaaggcctatattaatcaccatctccacaaaatcagcttcatttagtggaaacactcccttgaaattattaacgtgcacttgaaaacttaattttgtgccaccttatagtatgtattaattgcttgctctttgagtattaatcttgtttttccctccaatttgaatatctgagattagggaccatgctttactaatgaaatgatcaataggaaataggaaatgctcctagaataatcctatgtgattcctgaagtctctaacaattaatacttgacagacacagactgttatcaacagcagaatctttggattaactttcttaatattgaagaagggtatcttatactggtataaagcagttcaatttacaaaacaagtttatatgtattatttgtatttcgttaggatctgcaggatacacatgaatgatctcatttggaaacaatggattgtcagtgtttagaggaaatgtttttcagtggtgccaatatgattcaacaattttattatggtcttcaattacattttcttccttatttctttagtattgcttctaaattcttaaagcctactgatcaatagtatcaagtgatgctcttttctattatctagattttgccatcctgaaagacaatgacatttcatttttatttttttgtcaggtttttaagtccttgttttagatttagaactaatgtctgggttttttttggtggtggtggttgttttgttttttaatggaagggatgatgggcagtgtatccctgggtgtctgagtgtatattcatcctgctaattgagttgtccattttactaatgtcttctgacagcctttcattgatctttatagttcttttctgggaaggtgagattttacagactcaaggtgattggtttaaacttggaatttctttccttctaatagatagtttttaaaaaaaacccaaaagaactaagaaactaagagttgattctgaaaattgataaaagaaagaattgttctttgtaacttcactctaaatcattataatttatattttattactaatgatttatacatgcagaaagataaacagtttccacaaaggcttattcacattcctggattttaaacctatgatgagactgtgtttaattagaggtacggcccacggcagttgttttctttacaggaatttaagaaatcatatattttaaacttgcttaagataaatctaaataattctttggatggcatgttaattaggagatgctgatatttatagattaggaattatttgtagactctgcatgcaaatattatgggtaaaaagaaccatttaagtattttgaaaataacattagaccagatgatgttgtaattataatgtgtatttgattatgaccttttacttcttacaacaaacaggatggatttgaagcactcttttctaatgataattccaaagatttaaataactttctagatttttgtaccttccacactgtataaaacacccctgtcttccctgtcaagaaaattttgggggaaaaaaaaagaaaacattgtgcacagagagttgataatgaatttaaatattactaatggaaatactttatagttatatcaactaggagggtttttttagtttgttaactcaggagttttaataaaaaattgtctctaagaatgctgtttccactgcatttacataagggatatataatttattagacatctttttcatgtaaatattcacatgagtatttcaaattgtgaaattacaagtgggtctctttccatgcatactagaagacagcagttattttggcagacagtgcttttcatacattcacccctttactcatttatggatacatgcaaatattcttattaattaaactcttttcctaatgtaaataaagatactatgtgctgatgatacagtgatgaaaaaagacctgacaactaacctaaagaaggtcacatctgggtagaaatgaacaaaacaataaagcaaaatattgaagccagtaaaacagctaaccaggtttcaaataaaagtctattggttccaaaacccacctgttttctatagcaaatacgtcaaatctttgttcatttgtgtagtgaacatttgttgagcacctgttatgtgttagaaattttttttttggtttggtttgcattgcctagtgtggcagcctctagctctgtgtggatatttacacttaaatgaattaaaacaaaataatattcttctgcttcctgtggcaaatgtgacaaccagggcatcatcagagtgagtagtggagtttgggatattctgttaatcctctgcatcataaaaggtgctgtgctggaattagtgttctgaagccataggtagcttcctctggggaggagaagtttgcaacagattggccaccttactgtttatgtggattatgtatgatcaggcatttgtacctttatacagtatgtgaatgtggaatgaacacgccatcacataattacataagtcatcaacaaatctttattggccatctgcttgtcagaaagcctcttcctcatgaataaccttagtctctaatctcaaggagctgaaaaatggttaaatagggctgggtgtggccctatttaacattttccacaacttttaatttcatttcctatcaatattactcaacaacaacaaaaaattggttttgcaatccaaatattgtattaacaacataaagttggaaactttcagctaatgttcattctatttaaacatgctttgggttgttggtgcccaggatacagcaccccaaaatatgattataggagatcagaatatacctcaaaatacatgtttttggcatattgatgattttgagctggttattttgagaaactgcaggcacaggcagggaaggaggggtattgtaaagtggaagtgtacttagcctgttaagtagagaaacaatttccataggatagggttttgtgggctggaaagataaactgcaaggctcatcgtctaaatgcctgctgttcatagagttagaacgttctgcaggagtctaatggggctgttacaaaagggtggctactaagcaatctgagactctccaagggaaagaggcttcatctctacaactgctacttcagtagaaacaggagtccatcagaaactccatctgcttatccagtgctatttgatattatagttattatgtactctttatggactagagacggagaggttgaacaatagcacacactggccttagatatgttcctattttatcttttaatttttgacttgaaatatacaaccactccggtcaaacctctctactggttgctgattttgggaatccaccgtgatctctaagatacctgcaaccccattcctacatgcagtgttaaccagcagttctcccttttactgtccacctaaggaacatgccataccacattcccatcaatagcatttcctcaccagttacagaaaagaggttgtagctagcaaaaagtaccgcccacccccaaccccctaccccccccacccccacccctccacaactgctggtctttccagtatgcaggaggtatgcttgagtaccctccaggcctctgggtttgcccttggcattactgatgtaaacactgattggtttatctgcagatctcctggttttatttttgtttatttggatgcacacatctgggcgtacatctcattaggttaaggtgagtaattccttgaggactattcctttgacctcttcttataaagtgttatttacttgagcatacccagttctcttaagttcatgtagttaatgggtggtgggaaaattggtcttctgaaaaacagagacggaagagggagtggaaatacaccccatgtttgtgttagctcctcagcttctggagtgtgttagttttaccagaaagatttgatcaacaattgagaggtctagacttcagatgtcaaaccttttgagcctgctcatgtgcacacagatacacatgaaggaggtgagctaagggaccgccaaggcggtctccgggtgcctgactgctcacccaggctgctgacggaggctctgccagacttcaggatcagaaacctaatgtcattagtggctgggagttaatgagactacggcttcaaattcagaaagctcatatgtaactgaaggctgggatgcagtggcttacacctgtaatcccagcactttgggaggctgaggcaggtggatcacctgaggtcaggagttcaagaccagcctggccaatgtggtgaaacctcgtctctactaaaaatacaaaaaattagatgggcgtggtggcctgtgcctgtagtcccagtcagtcaggtggctgaggcgagagaatcgcttgaaaccaggaggcagaggttgcagtgagccgagattgcgcctgggccacagagtgagactctgtttcaaaaaagcaaaaacaaattcagaaagctcatatgaacctgagggataacatcagaatgctgatttgttaactgatgctcagaaatgctactgtcggccaggctgggctttcacaggtgcccagctgtagacgtggtgagccatgtcattgttgggtgcacagtaggtttgggctcttggggtacagtgtaaacaagacaaatattcaaggttgggctgagagggtggtggggtttaagcagagacaggcgacaaataaataaaagaagaggtaaagctcccagttaatgatgagggccaggcagtaggggctggcagtaggccaccgtggcagggactggctgatggctgggttaggtgggctggccagtgaggcttctcacacactttagccagagggcacttggtgagcttcaaatgaaaggtcacggcaacctcttacctttttgatagacatagggtttctttagttatgtttataaatacaatccagttcaggccagacctcaaagttgattttgcatatctttattttcagttttgtttttctccacgtttactggggctttgtctagctcctgtccatactccgtatacctattctgatatatttaaaatcatgaaataatcctaccctgtgtaggaatatatttcagagaattatttgctatgtaaatgatttcagattttgtgctgtttattctttttttttttttttaagagacacggtctcactctgttacccaggcaggagtgcagtggtatgcttataactcagggcagccttgaactcctcctgcttcagcctcctaagtagctgggactataggcgcatgcaccatacctggctaattaatttttttttttgtagagatggggtctcactatgttgcccaggcttgcatttattcattttatttatattcctggaataagattacagatagggcaggaacaagagtgaggtaaagtggtggatgtcctggagatgactgaaaatcagtaacgctgtagaaatgaaacttattttcaggggaaaagtcttaagtgttaattaacaagttcatgggcagactcctgctgaactaatagaggcaaacgttcttaaaatggatcaaaatcacttatcttttggcttgcttcattgaaagcactgtaaagacagatttgtgaattacaaatttttgagactgtcaaaaattgggccctagctttccttagggggtggaaattatgatctgcttatcctcaaattatataatattgtttaatatagtttaaataatgtccttttatttgtaattaagtgaggctgggcatggtggctcacacctgttatcccagcactttgggaggccaaagtagaaggacgggttgagaccaagggttccagaccagcttgggtatcatagtgataacttcatctctacaaagaaactaaaaacattagccaggcatggtgagaagtgcctgtagtcccagctacttgagaggctgaggcgggaggatcacttgagcccaggagtttgagaccagcttggcaatatagtgagacctcatctctcagaaagtaaaaaaaaattagccaggcctggtggctcatgcctgtagcctgttgtcaggcaagggtgtgaggactgcttgaggccaggagttcaaagctgcagtgagctatgatgctgctgctgcactccagcctgagtgacagagcaaaatcctgtctccaaaaattttttaaaaatccaataaacaaaaaaacccacaaaaactttaaagtgaaaaactgtttgaagatgatcttaatgacccactatcagcatggtgagattcctctgtcaggccaccactgggtgtttatctacgtgtgtgtttctgggggctggttccattaggctgaaatgagctgggaatttagcttctcaagggccaatgccagtcatctgacttagaacacctgggtaccttgccaacttccatctgcttctctgatattatttgtcagcaatctttcaaaaataatattagacagcaccagcaataaaacagatactttctgcatgagtgtgttgggagcagaaaatgagccaattaagcattctgttttctgatgcatgtgaaacatttgtacacatggatggatcttttgaaatttgagatttgctattctttacaataaaatttaagctgaagtctctcagggctggagcctagatttttaaattatttgcatttttttttagagtgaaactctatagtaagtgaaattggccatatattttaaaatgcatgaacataacaaagttagtcattgaaaagcaggcaaaatctagcatgtatgtttttctttggatttgttacgtcattgagtcatgtaatgagtatttaagaaaacaaaacagttctctggaatgcctgaattccatgttggcaattgggtacaataaagcatttgcaattctagtgacaaattgtactgcagtgcagaaggtctcatcgagcttagatcattcgttgccttacatattggttcagagatgagaaaataaaaacatcagagtgaattcactaggttctagggtttcaggttcaatctctgtacagaaagacttaacaagaaaatcagtagtcaccagagattatacttggcattagattacacgagatgaagttaaatgcttttgtttgggtttgaatgaaaatatgctgacaaataatgaagcaacaaataaacaaacaaaagcaacctcttcactgcagatgggctattaacacttagcattctaagctcacccataaaagctgtaaccaaagcttttttatttgattttgaaagccgtgctttgttgaatatttgatgaaaccgactgcagagatctgcagtgatgttcttggtgaatccctgttggcagctttaggagtctgtccttttggagatttccaggggttgattctcattctggggaagaggggaaaaaaagcacagtgattacaatcaaaggagtaggcaccagaatgatatgaaacactcagaattttctgccttttgataaaaatttcacatactggctagatagagcgatagttatcacatcaaatagagtaacggtcccactcttcttagagggccaagaactattcaacagctcacctcagtaagggctgttttgctgagtagtatctctgggaatgatggtgaggctatcctttcgtttgcaataacttttagactcggtgaatataatagcatgatcattcttgcctatagaacagagaggtaagcaaagcagctgtcaaatagtagttttctctaaattagggaataaatatagttctttaaaaaatttttttggaagttgatatttcaaaatatgtagtatgtgaaattgagtaatgtgatattatatgaaactgaactgatgtctgattgatccacctcctttttttttttttttttttttttttaaatttagagatgaggtcttgctgtgtcacccaggctggactgcagtggctgtttacagatatgcttatagcagccttgaactcccaggctcaagtgatcctcttgtcccggctttcagagtagctgggacaataggcacatgccactatgccagtccataagtagagttatgtgaagtcagtttagacaagaaagttctttaaaaatttgcatgttaggagcctagtcaggaaataagctgaatttctgtttcttaaagcaaaccccaaacaacaacaattccttcttttcctggatacttaccaagccaaagagaaacggattcattgagatactgatctcaggagaacagtaatcctggagcttgggctatcacagtgtgtcttggaaaaggcctgtagtggcacacaattcatctgtaattgggattagtagccctggccagctgtagagtggaggacaaatgttggcttcattccatgtcagtgtccttcttagattcctgggcattaatcgttaaatgttgttaggaatgaagcttaaagaaaagcaagtttgaacttcttcatgcagggggtgctgggttgggggagagatggagagagacactggtttagaaacttcatattagaatttttgatgccatacttttgctttgggtcatttatttgatggctataaactttgattgatggtttctatcttctcataactctgctcattgaaggtggagtcttctatttcttaagaggactgattaccaggttgatagatttccaagccttctgttgttctatactctctcttttcctgcctttcgccgagaggaatatccgtgtttcctgaggatgggggtgaaaaaatgtctatccaataatgcttgaattataattttggtgacaaaagttttcttttggggagggggaaggaatttagaatgtttagatttcacttttctctgttcttgctaaatgtgtgtgccggcataaagaacagagctgatggctgtcagttatacgccgctttcagatgtcgaatgctctacattgtctgtagacttaatttgatggtcaaatgtagttttgccttttgatattttaggcattgacttaaatatactaggaatatttaagtctatccgagtctttcctccccatgggatccaggccatttgaaacaatatggttattggtgctctgtttttgttttattcttcgtagtcaaccaaaaagaacagagttgattacatgtttcatttgggatatttattaatgacaattgctttcatctttagatcttccataatcagaataggaaatttaaataccttgggtatgtcatggttatttcactttttaaaaatagggatacaatgagatgtttgtaattatataaaatactaaattgttattaaattttagttagtgtcaacatgtattcatcattttctaaatgtcatctaatcagactctaatttactttcccccaaatatcaagagatcattctgaatttgtcttgctcatgatatggatgggttactctgtgtgattgccttttttttttcttcttcttctttttttttgagatggagtcttgctttgtcgccaggctggagtgcagtggcacaatctcggctcactgcaacctccacctcccaggttcaagcaattctcctgcctcagcctcccgagtagctgggattacaggtacacgccaccatgcctggctaattttttgtatttttagtagacacagggtttcaccatattggccaggctggtctcgaactcctgacctcgtgatccatcacctcgacctcccaaagtgctgggatgtgagccaccgtgccctgccatgattgcctttttgctgggtaaaatacacttttaatttcttgctgggcttttaaaataaatacggctgaaattttacattcacatttctaaatacataacatacatgaaatactttaaacaaaaaatgataaagtaagcagacttgcttggcgctctagaaataattatactatttgtatctaaataggtttctgttgtatggataattcatgtattataggcatgataacctgtttacagaaaattctaagcatgtggatctcctatcttttatgattttttcgtgtaaaagtttcctttaaaatcagctgttttatattgatttaactcagtttgggcatctctttttcatcctttattcattcattgagtgctttttgtggaaagttgttattataggtgctggggattcaatggtgaacaaagtagataaatgtctttctcccttgaagtttattttggaagatggagggattctggcaatagaataagcaaacaaggtatttgcaggcagcattttgttgtaaagaaaaaaaagaaaaacacatggtaataggaagagagcaacatggaatttgggagtaaaaaggaggaaaaggtgggttaatccagttctccttttctatggatgtgccatttggtttgagtcataatgatgaaaaggagcctgccctggaaacttctagggggagagcattcaaagcagagaagcagcaagtgccaggctcttaggcagcaggaagctccacatgtttgaaggcatcgggagggagtctgcatatccactgtagaaggtggaagggagaggaggcgggttcggaatgaggacttgaacgatgataacactgagagctgtgaccctcctccgtctctgccaggtggtctgggtaacggcaggtgctaacagaagactggctaattataaaatacgactaagcggaaacagctttgtagcttaaaaaaagtatgtatttcatttcactctcatcacaagtctttgttttgttttaaatctttgcaataaatatttgttaaagtgcctcatgaggatacaagaaagaaatttggaaacagaagaggttattatcctgcagatatagaagatctttcatgaagacattgaggaggaagatatgacctatactcagctattgtgttgtggggctggaggaagacatggctggtgcaaaacacagaacgtgtctgagcttagaggtggttctggaaaacagaatatgtgtaggtgtaggtttctgtttaggtgtcggtggagaagtaagtgtaggcatctgcgtgacaccagtgattttcagtctgggttctgagtagttctagttcctggaggttccaggagggatattgtttatggtaaaggggaggatgaggccagctgggtgacttctcttgaaaatagattctccccatgaggtcgggagatcgagaccatcctggctaacacagtgaaaccccgtctctactaaaagtacaaaaaattagttgggtgtggtggtgggcacctgtagtgccagctactcgggaggctgaggcaggagaattgcttgaacccaggaggcggagcttgcagtgagccgagattgcaccactacactccagcctgggcgacagagcaagactccatctcaaaaaaaaaaaaaatagattctcccattaaaaaaaaatatttaaagtactctgctttaaaatgtcagtaacagtataccttttgacatgtagtagttgctaaatgattgatacagatactgatgtttttggaggtagaggactttctcattctaaaccctgtttgccatacatctagaactcactaagcctgtcctgttgatgatcacctctagaggaaatacaggtgccaatatgaataacggaatcagaatgcctttgatttatttaatctcacttctgtatactcatttccttactatgtgttagaaaccctctcagcccagtgtcttaggtaaccgttctgttgaaattttggctgatcgccacttgtactatcaaaatattaatcacatcttatctagaaacaaacaaaaatctctgagactcctctggaagccattattcaaaacctaatttcctcaggcttctctaattatgcagtgcagtgggttagaaaaaggcttccatagcttcatctgcgtctgcctcattgcttcctatttttgccacacacccagtgagtaatggtatggctttgcttcccaaacaggttaaagattatgaagctctgtgctatcataaggaggttttcaatgggaatatctgcttttacccaccggtctttctgttttgcccccaagaggttaaaagcagttttcattctcatccattttgtgtttcctggatgttggcccaatttgccttaacatccgtgtctgctaagcagcaagtcagcttagcttggctgtgcccttacaaatatgcatatgtttgagaagagaggaggaaattaatcagagcccctggcttaaatgatctccattcttactagcactatcgggatgtaattaaatcatggtttaattctttctgttagggaaatcttattcctttttaaccaagttcttaatgtatggtcatacaaggtgaatttaatcagtaagcagtttcattagactttgaatgttgtttgctgttgggtaggtgaagctcattatgcttcctaggcttggatccagacagacaaggttttatcattaacctagttttcatcaagggaacagtgtgcaaactgggtaccacctgtgagaagcatcatttaagaggccagaggtgagatcctagaaaattatgtcaccttgcttgtttacaggccattgtacagaaaaaacaaaaaagctgataatttaaaaacggctatttttgatcttaaatacctgtttgatttttttttttaatgaggaaaggcagtgctccaatgagaacattctcacaggcaggtaacagaatagcacacttttattaggaggggtaaaaagagatgcagaaagcaaggaaatctttttagaaatgtattaaatactaaattttcttttgctgtaggttgtttctggcaaaaccggagttttattgatggacttcctttatgtactcactctgcgttagcatgttggagacataggatttgctggcatcatctggttatgaatgtgactgtggggccccagggaggttcccaaggttctggttggtggttcgagtcaggactcaggttttcctgtctctggaacagtcgtttgtgttataccaggccataggcacagaatggtgagtggatttctatcctaggagaggtcctttgctgtgttcaagtacttgggatatcgaatgacagaacttgtttttagagagatgacagcaataagcctgctagtatgagctgttggcaatcatatagcccatttaacccttatgataactgttaaggttgttattattattactaatactacaaaagcatgttgacttaaatttgcagatgaggaaaaagaggttcagaaagatgaatctgcaacccaggtgccttgatatagatgctgtagatacgacaaactactctttttttttttttatcagcttattgcatccagacagggtttgaaatggctctgaaaacaaaaaaggaagcaagaacccagtagttgtgtgttttcctgcttctactggggtttgaaattgaagacaattggtttgagtcctagcactgttcctcattagctgtatgccttgggcaaattacttaatctctccaaacctttatttcctcctttgtaaactgaggacagtaatagaatagaatccatctcactgggttgtggagagaattacaggactcctacacttgaaaagtggtcggaagggcacctgcacaaggtcagctgtttgtgattgttagtaatattgagattgctttgagaatacacactctgacaataaactgaggatgcttgttggaaagagtagctgggtcaggtgagtctttcaccttggagtgactgatctctttctctgcatgttaagttttctacacaccgcaaatacctgtctatacacgcacacagtttatatgtgtgattcttaattgcttggtaggcattataaaaggggacaagagcattaaaagagagtttgactttcatgataaaagattaagagtgttggccgggcgcggtggctcacgcctgtaatcccagcactttgggaggccgaggcgggcagatcacgaggtcaggagatcgagaccatcctggctaacatggtgaagccccgtctctactaaaaatacgaaaaaattagcctggcgtggtggcgggcgcctgtagtcccagctactctggaggctgaggcaggagaatggcatgaacctgggaggcagggcttgcagtgagccgagatcttgccactgcactccagcctgggcgacagggcaagactccatctcaaaaaacaaaaaaaaaagagtattggtgtcatttaatttaaaagagattgtttcaaggatgcttagttatgttggagtattcaacattatgagaattttttaaaagtttcatttttcttcattcaatctagtttaatatttaaacagaaggtgtatagtgaggttagaggatggtgcgtttataataaatcggtgtggcagagttttccttaagtatcttgagtttgaatctgtctttagattagtggcaacattaaagaaatagtaaataaccagtctgttcttactaatgtcaccctggcttatatcctcttacatgacctggtttcctgctgtgctagagcatcatccttagtcctttcctcctaaagtaggcactgtttgaaatgaactttgatttcaaatgcacctgctctctattgatgttggccatttgcatttatgaatcttcctccctcactgttcacccactaccccaacccctgacctctcttttcatctggcccttccctacctatgataacactcaatggagtgagtggccattgcctacttggtttttgtttccccttagacctaatctgagatttgccaatctcatgttctaatatcccgactgctttttcaaataggagttagcagagtatggtgactccattttaatttgtgctgaatatttaggagtaaactcataataggcctattctggactctgctgttagaaatactccaacaatgacacaggatcaggaatcaatagtatttgtcaagtatttccatttctagcaagggaaaaatgatctattaaatatactccacattaacaaaaaagtccctgatttatgtatgttgatcaatgaaggttaaaaaacactgttaactaaggttttctatttgcagtgttttctgacaaatatttttcctccagattttaagcgtgttattatgagtcaacctttatgtttgtaaagccttagtcttgttaataatgtataacttccaaatgaatcatatacttatgcatagcacttgaatatgcagattttataatacaatctgaaggctcatatttttctgtttatttttaaaatgttaagtctcattagcattatattttacagatatattatgtaccatataacctctacaaatcacagtcaatctggatagtgtccccttagggcaccttaattatatgctgtagttctagaattcttttatgtggttttttagagataatttctcctctttattttccttatgaggcatcttaaaatagcaaaaaatggttgctttggaacctactgttatagatgccagtcttctggaagtgtttccagatttttttttcttttttggcctttagaacattaagtattctgtagagttatgcccattatccataaatgatttttttcagtgtatgtctgtctctatgtacctacctatatgctcatacttgaatgtgtatatgtgcaccaataacatacctgaaaaatggatgagttgtaattgttttagtagagataactgaaccattgatgtgaactctttgggatctacagcatcatccttaatgcctgtgtcataccttgtatatcattttgaatggcttttggagcttaaagtatctctgatttcaagcagagtgccctgctaaccaagacagtcccagccaggacaatatctactgggttccaggttcactctggtcttgttcctatattcctcatttccaggcagaaggaactatcacagtcctctttcctgtctcaacagttgcaatttgtaaagcctatagcaggtttacttttgtgctccatagcatcagctctgagaatgttaaacacattgtagacgtgatgtgttggaaatttaaagttatgttttctgggccaggcgcggtggctcatgcctgtcatcccagcacattgggaggcagaggtgggaggattgcttgagcccaggagttcaaggccagcctgggcaacatagtgagaccttatctctgcaaaaaaatcattagccaggcacggtggtgtgtacctgtagtcccagttgtttgggaggccaaggcaggaggatcacttgagtccaggagttagaggctacggggagctcggggagctatgatcacttcactgcacttcagcctgggcgatagagcaagactctgtctcttaatgaaaaaaatatatatatatatataaaaaatgaaatatataaaaataatatataaatatatatttttttattaactctggcacatagcaaatattatttcacttacattcatgttgtagaattttctcagataattttgtctaattacaactgacagcacttcctaatttactttaaaatatgctatcatttataaacatgtatggttcttatgaaaatcacaaaaatggccaaaagatgattttactgggttctggcactttgttgcactgaatagcctttgaaataaataaacccttggttttgacttgaaagttttatttatttatttatttatttttttaaaaaacacctttaatatcacagatttccttatagcaatatatgaactttctgatttctattgacttttctgattttgttatcaaactgtcaatacattctgtgccttggcaactacatgttctttaaagaagtaaaatgtttaacatttcaggtgttaaatttttgcttgggatcacagtgaaaatactgatattttgatacagttggtaaccttccatttgtgttttattgctgtgtgtctggtaaagacgttctctaagtttgtgtgaaagtgtagtagaaggttcaggaacatacagtacttcaagaaaactgtgtatctacaacaagttaatattgggaagagattagtgttttgagatgtttatagaggaggaaattatatcttgatatttactgagattaccagtgcttttgcaaatagaataactagatctttttgtaaacaaaaacgttgactttagtctatgttgtattactgttggaaatattacctccttatgaacctcataagacatggagcctggctatggtcactgttaggagtattttgctgctctcttgctggcaaaaatctttgcatgggtcctccttctggactggctactacacgatcaagtcaactgtctgctttggaatggcaatatgtcatgacatatcaaattttatcttaaaactttttttaattgttaaactttacatatttaaaataacattacagatatgtaaattatgaaagctagtcataaaatgaaaatgtaagagcacacttcccaatttaagaagcattactaactttcagtggttctctgtaagcattttcctgatcacaattcctacttcccaactgataattcctatcctgaattctaagcttattctcttgctttcctattttttaaaaactgcatacgagcatgttacttgcttgtttctgaactttaaaatgatttcacataccatgtatgtattctattgcaacctgctattttcacttagcattacatttctaaaattgatccacattgatgtttatagctatagatcatttatattcacaagtatacagcactctattttgtaaatatgcagcagtttatgtgaactactgttgatggtcattagattgtttcttttaaaaaccatgctgctatgaacaatcttgtatgtatccttctaatgtacatgtacaagaatttctttagggtttatacctagaagagaaattactgagctgtagagtatgggcatgctcattttcacaagataataccaaattattttccagagttttcaaagaaacatatataaatttcttatgtatggaaaatatgtattttccaggctagcaaatacagattataagacaatgccaaatgtcttccagagttttccaatgcatgctctcagtgataacatgtaagaattctggttgttccacatctttgccatccttgatattgtcaggcattaatatttttgcttatgtaatggatgtaaaataaaatcttggggttttaatgagcatttctctgattcctaatgagctcaaatatcttttcatgtggttactgggtgtttatctttcttctggaaatgcttctcatttgtctatttggttgtcatttttgttattttatttattctagatgctgtcagtgacatgtgccaaggacatcttacttcctctaatttttggcttgtcttttccattctctttccggagttctttgaaaaggcattcttatagtaggagaatttgtctgtcatttttctttgttgttaaggcttttttgtttttgtagttaaggctcttttgtagttaaggctctgtgtgtgtgtgtgtgtgtgtgtgtgtgtgtgtgtgtgtgtgtgtgtgtgtgtttaaaagagatccctctgtcttctaaggtcatagagttacagctttaaaaattttctcttagatgtcaaagttggctagttgcggtggctcacacctctaatcccagtgctttgatcacttaaggccaggagttcaagaccaggctgggcaacatagtgataccctgtctctacaaaaaaatataaaaaattatctaggcatggtggcttgcacctgttgtcccagctccttggacagaggtgggaggattgcttgagcccagagttcaaagctgcagtgagctatgattacaacattgtactctagcctgggtgacacagcgagaccctgtttcaaaaaaagaataaagtgtcaaagttttgctttcaacctttaggttcttaattcaccaagaatttctaaatttccatttatgtactatgtggtgtgagatagatatataatattattttttcaaaaaatatataaactactatcctagcagtgttgattaggctgtctttgaccattgccacctttgttgtatgtgtgtttctgagatccctattttgttaaatttgcttatttctgtgccaatgtcatcttgctgaattataatagctcttataataaatgtgatagcttttagggcaatcctagctctcttcttctttaggaatgccttgagtagcaaattttatctctgctgtatggctggtaccagagaaacagaaatagaattggagcttctatgttgtttcagtcatcttcagaaatatttcagatatgaagagacatactcttagagcttgttggacaaagattcattaaaaccatgatctgctgataaggccaattatattgtgttgaactcagtctttctcattatatttcttacaggcaaacttgaagatttaccaagaaattcagaagttagtatcagattttacttgggatcaccccaggaaatgctttatgtttaggagactaggaataccttcagaagtccttgagattgtcttctagaaatggggagggagaaggaagcagaggagaagaactggtatttattgatgtctatgaataccaactgttccactgaactctttatctgcgttatttcatgtaatgccccagcatctctgagatggaattcttcttgttttatagctgatatgtgatctgggctacataccgtctctctgtatccagaatgtacattcttaccacccatataccagctgcccaccagctgcgttgctgatggtgctctggggctagccaagaggaatgtctggaagagctgagggtagccttttagagaggagataactttcagcagatgatgcatctggagaagcgtgggggaatctgccgggctgagtctgaagaaccttggccatagccggcaacatctattgtctttgcagagctctgtgctgggactaaattctgcctgattgaccaagaaaaagcaaaagagggtcagcatgtcctttgtaagccggaagcgcagagcaaggtttcagattggcagtggctttctgatcaaatttcgggtcttgacacagcaagtgataaagctttgacccctgggtatattgttgatgggagacccgacttactgagccatgtccgtgtcgtcctgttggtaagggctgttcaggatcctcagtgatgagaattggttgtgagttagagcctgggacaatggcctgatgggaaatgctgcatttggtccccaggtcaggaaggcgaggctcctggggctggctagaggacagacaggggtgagcacagctcaggtgaggaatgacaagggaagattccacgctgcctatccctagccctcagagcttgcctgttctccctctcctttcagctgtggacactgggctgctggatgtgacttgcatttcacattttcccagtgatttgggcctgatttatctcttgattgctctctggtaaccgactctccagcctcttcatttccagtacacaacttggctttatagcccttggacactttcccaacttttgatctttcagtgcaacccttctttttctgcttagtctttctggttggctcagattgaaaaaaacccaaatatatatatgtgtgtgtgtgtatatatgtatatataagtatatatatgtatatatgtatatatgtatatgtgtatatatgtatatgtatatgtgtatatatgtatacatgtgtatatatgtgtatatatgtatatataagtatatatacacatatatacatatacatagatatatgctattatataataaatattaatatgttaatagtaatatgctaacatgaattataccaattatataataattactaatttcaatcatgtaaatatatatcaatattaataaagtatatatttatactaattaaatatatttgattatataattataacaataaatatataactaataatatactaattaataaaaattgctaaccctctctgagcagatttatccaatatgctaagcacttttattatttatttgtttatttttttaagacagagcctcactctgtcacccaggctggagtgcaatggcatgaccttggctcattgcaacctccacctcccgggttcaagcaattctcctgcctcagcctgccaagtagctgggattacaggcacctgccaccatgccctgctaatttttgtatttttagtacagatggagttttaccattttgcccaggctggtcttgaactcctgacctcaagtgatccgccctcctcggcttcccaaagtgctgggattacaggcatgagccaccacacctggcagctaagcacttttatacattaccgtatctaatcctcacagtagcccacaagacaggttccgacgattattcctatttgaagacacaggaaaagtaagttctttactcaaggtcaacctgttggtgagtggcggagtcaggatttgaacccaggctgggagctcaagagaggctctttaacatccatgcatgagctgtactgtcactcaagagacagaccagcagatgtagaaactgctagggtgtgtcagatgagagatgtttttgatgctgtgacagagatgtttttgatgctggggacagctgagactctcatacatacaattggctctggtatgcctcaactagaaataaagcagtacataggacacgaaacccatcagcctccacatcctgtgaaaatcactgctgcacaatggctgctgagtgtcttaataggtctaatgactgtgctgcatgaatgtaaagtaggttctgtatgcaaagggttaagaaactggatgatatagttagttttgatataaaaagaaggattaatgatgaccgaatttttttcaaatctgcaattcctgtaacagctgattagttccgtgatggttaatccagacagactagcgtcacaatctggccatcaaaaagcagtgactcaccattgccagaacgagtacgtgttaaattgaattgcagtctggttggaggcagctgtggtgtggctcagcaaatgtggtcttacatttccttttaaactataagacatttgctacatacaaaagaatgtatgttatgcatatgtagattatgtgagatgaaactccctggggtttatttatttatttatttatttatttatttattttgagatggagtcgcactctattgcccaggctggagtacagtggcgcgatcttggctcactgcagactccgcctcccgggttcaatcaattctccttcctcagcctcctgagtagctgggattacaggtgtgcaccaccacgcccagcttatttttgtatttttagtagagacgggattttaccatgttggccaggatggtctcaatctcctgacctcgtgatccacctgcctcggcctcccaaagtgctgggattacaggcgtgagccaccgcacccagctccctggggcttctttttaatcatataccctgcctcaccttcccttcctggaaattgtcaccatcttactcttatttcttactctcctgctttcctttatttttgccacaggaatcatgaatatattgttaaacaatctatttttagatttgcttgcttttgaactttataaaaatggtatcacatactatatattgtctttggtgacttggtgcttctaaaatacatccatggaaatccttggctgtagattgttagttacaacggtatactagtccattgtgtggacatacacaatttaaaaaatctattataatagtttttctggttttggaggttggatccagctggatatatttgtgaaacccccagagaaggccaggaagatgggaaaagtagccagaggccagacatttaggcattacaggccagcataaggagtgtggattttgattctaaatccattgagactctatcaaggggttctaaatagggacctgatatgattgaatttatgatgatttacttcattttatctttcagagtatcccatttatctggtgaaacagccatgaaaacaggtaactctggtttagtatgataagcgcattagttggtttggtgatgagtctctgctctttgccaacccgatcctgactcaggcccttctatattcaccaccacaaaacaagtcggctgttaggggcttgcagattggaataaagctataagtcaccaccaatccttctctttttcaaaatatatcatcctaacttcttaaccgtttacatgcagaacctactttgcattgatttgctagatatattagtagaatcctagggcaagctattcatgaagcatttggtagaggaggaagaatctgtaaaaagtgactaggaaagattagttggagcaaaaggactagaaccaagaaagaggaatttagaaggaggctggctttcagtgtataaagaaggcagtggctggcacgattaaataaaggctatgggtttgcaaattacagatagtcctttggatttaccagttaggaggtcatcagtgaccttttgatagtagcttaggaaagacacgggcatggaaccactgagcacctaatgaaggaaagagtattgaaatggtaatatgacgtattcaggttaggagaaagagaattctcaggtagtaaagataaagcatacacatagaaatgagttttgggggactctttggagataacctcagaacgaaagtaaaatgttgcagtggagagttagcctaatcaagaaacacagagatgactaagtgaccttcccacacatgaacacaatattttgtctcatcctttgttcaatttagagactgacctttgctaaaatgccggtgacaaggagacagaggccagtgagaagggaggacatttatctgtcaatgaaggcagctgatactagttagatttttcataatctgttagagttgagctgacaagcaaagaaattgcttcatattgcatattaatttcccgagaagtcaatagtgagaactctgaaactccagctgcataagagaaagagattccaaacaccataagatcttgcagttaaactgatcagaattaatgacataatcctttccgcatatgttgttgctataggaagccttctgggagtacctgtcctagcattgatgtgtaacccttgggcggggtaaacccagagtcaggttagctgcaatgacctggcctgccacagcagcggggagttggggaaaagcctacattccaagcaagactgagtgtggctgcaaagaaggatgttggttcccaggagcagaggactggggcagaaatgaggaggtggctgaagagtgcttcatctccctgctgtcttaggaggaacgtggctcctgccctttctcccaattatgagatgagaagatgctgactcaggtttctctgctctacatggtgcaagtttttaagtttcctcaaattacggaatacaattgacaagagaagaactacttttcgggagccataaataacctttattaaagcttaatgttatcaagagtgtatttttcagagacttacgtaactcattttctgttaaataataggcacagttgcatgacttgcaaggttttggcagagtaaatagtctttgacaaaaataatacatagtctacttttatttaaaattagataacgatggactttagctatactgaagtaccatttgaggtacaatggtggacttatgaacggtctaggaggtccacagctttgtgttcatacattaatatttatcagatgataatgcttatatttttctagcataaatttattaggttttaaatttttttaattaaaagtatacagaacttactatggtcttgctgaaagtgatgtcagttttgtctttagttgagttgaaggttatcttagttctttgtgaagagggttttttttttttggacagggtcttgctctgttgccaaggctgagtgcagtggcatgatcacagctcacagcagcctcaaactctcaggctcaagcaatcctcctgcctcagccttccgaacagctgggactgcaggcatgcaccaccacacctggctaatcttattttttgtagaggtaggatctactgtgtttcccagactggtcttgaactcctggactcaagcagttctcccacctcggccccccaaatagttggtactacaggcgtacgtcaccacgcctggctaattttttattttttgtagagatacagtctcactatgttgcccaggctggtcttgaactcctggactcaagcaatcctcctaccttggcctcccaaattgctgttacgggcatgagccaccacacccggctacatagaggccctttataccaaaacttcctgagcagcactattttacaggcagtgttaacataattgtaacatatttagatcttggcatatttttcaatattggctttagttaaattttgtgctccatatatctaaaacagaactcattatctttcctgcacgtgctactttgcctctcacattctctatttctagcaccttcactcctggtcattagattggcagcccttggattcaaaagaagcatctctgactctctctcggtgctcctgtgtcagtcaaataacaaacctttgggtacttatgtgcagtggggatacacacacacagaggataagattcccttcctcataacctcctggtctggttgggacaagaagtgatggtgtgtggttgtgcattctcagggtaaagcaaatggcattgatcagtgctgtggaaattctcaaggctattatctctctggggccgttagacttttagaggtatagacaacaagtgagtccaaagtgagtgaaggccaagcaagcataaaccttttggctcttcctttgctgtttttgtacaccaaggttaaacagcaacatagctcctggacacttctgccacacagtcttcactgagtatagcacctgtttccttaggtgcctggctggaggattttattgtcaggattgcactgacacaaatctatccctaggtcttaggcccctgctttcttcagtttcaggagtctgagggttgtccctgcaggctctcatgggtctacaacctgggagctgatttttcccttgaaacctaaagccctcttgtaggtaaatgccacatcctgatccgtgaagatgggatattgccttgcagggctttacagctgtgaattagaaaaatgtttttctctctctctttctctttttctgtgttcctttcccagacataattactccctgtggcaaagctccctgttagtacagacagtgcatttagcactattttaacacaggcgtgatggttatgtttgcctcttttataacatgccattctgtatgtaaaaacaagtatcgtactaaggtcctgcaagagccttagtacaataatgagaaatccgcattccactgtcagtctaatgcagggacatcttagtgtctgtttaactggactcaattgaacacctggagctgtgtattgaaatggcttgaatttttaacttttatggtatcaatgatccctaattttaggccagatgctttggtttacatttgtgttttttcaactttgattcccaagattgaaagatttattctggctgaggattctgggcgttccttctaatggatcagcagaagcagaacaagacccacttgcataagagtccccatcactgtgccgaaaagcacaggctgacatttccctcatgtccccagaaatcccatcatcttgattgactgttgaaaacagagagaaaagccttcaaaacataattattcgcatctccttgtggctgtggcatagctgaagcctgcagtaaattttcagcatctggatatatttgtgtcaaatagctgcagagctgataggctgcggaggctgcagcccgcattgagcagcctccagagagccttgctctgccggccttgagctccttccactgcggctttttgaggaggagacacatgcctgagagcggctctgggacttgccctgacaagtgaagggaacttgtggaagggaggtcagctttttgcgaactctgaaagtcaaagatagaggtggctgtgttgagtttagaaagtgaatcaatgggacagttggcacccctaccttccaaattcagattagccttgtagtaaaagtatagtggcaagaatgtcacatagactttttttttttttttgaggtggggtctcactctgtcgctcaggctggagtgcagtggcgtgatctcagctcactgcgacctctgcttcctgggttcaagtgattctcctgtgtcagcctcctgagtagctgagattacaggtctctagtagagatggggttttaccatgttggccaggatggttgtctcgatctcctgaccttgtgatctgcctgcctcggcctcccaaagtgctggaattacaggcgtgagccaacacgcccggccgactttttttttttttttttttgagacaagtctcactctgtcactcaggctgaagtgcagtggcatggtcacagctcactacagcctcagcctcccaggctcaagcaatcctcccacctcagcctcctgaatagctgggactgcaggcatgcaccatcacacccagctaattttttaattctttgtagatacggtgtctcactatgttacccaggctggtattgacctcctgggctcaagtaatcctcccacctcagcctccccaaagtgttggtattacaggcatgagccactgagcctggcccacatagagttgtaaatcatgaaactgttctggacagaaagcagatggcagaatcacaatcttctgtgtccagagattatttgagattattttaagaacctaagtacaccttttagagcagggatttcttggatttgaatttttaggttacaatttgctttttagttgtattgcctgcaaaaaatcttaaatctctttgctgtttgtgacattgtgcatacttctcaatgatcttccctcttcatactttaacttactcctctccttgcccagatcactaaagcggcatgactcagccagcagaattgtcatcatccccaggccttgagcagctagtttgaaaaactgaaatagatctggcctcattgaatgctgttttaggtgaaggaaggtaattttgctctggcaggttggcgaattagtatgttacagctgtaaatgtatttctcctaaggtggttttctagcatcgtgtgcctcaattcagttgtttctttaaagttcagcattgcttttttttttcacctattcattcttggttaattaggaaaagacagcatctgttgtgggttttgttgtctggtgtagatgactgtttaatcagagaaggcattatgtcttgcagttagcagtttgaccctttgcagcacaggcttggggcgtgacctcaggatgtgactgcaccaaaccttactattttatagaaaatggggataataattctgatctaacaatttggatgattaaatgagataatacatgtaaacctctgagctcagtgcctggcagttatcattaggttatttaacatggattctttttttttctttttctttttgagatggagtttcactctttgttgcccaggctggagtgcagtggcacgatctcggctcactgcaacctctacctcccaggttcaagcgattctcctgtctcagcctcccgagtagctgggattacaggtgcccaccaccacactaggctaatttttgtatttttagtagaaatggggtttcaccaacatggattcttagatgacttgatctagggagtctagggttgcagcattattttgtagactcgatgcggactgccttaatattttacagcatttttattttgtcttcttgttttttattgtgataaaaacataaaacattaaatttcccatcttagccatcctcaggcatataatttaaaagtgttaaccgtatccacattgctatgcaatcaatctccaggactttttcatcttgcaaaactgaaattctgtacccatttaatactaattttcccttcctcccccgtcctcctcccagcccttgacaaccacctttctactttgtttctgtgattttgattacttcagatacttgatgtgagtggaataatacagcatttgccctcttgtgactggcttgtttcccttagcatgatattcctgagcttcatctatggtgtggcatgccatagaatttccttcttttaaggcttcataatgtcacgttgtgtatatatttatctgtatacatgacagtttctttatctgttcgtctgttaatggacatgtgggctgcttccaccttttagctattgtgaatcatgctgcagtgaacacaggtgtgcaaattatctctttgagattctgcatcttgtatatgtcttttggatatagatacccatgtcgtggatggaatatgtccccacaaaattcacatggcgaattccaagccctgatgtaatggtatttggaagcagggcatttgggaggagactaggtcatgagggtgaggtgctcatgaatgggatatagtgttcttataagaaaaggccagagagctagcatgctgtctttctgccatgtgaagacacaacgtaaaggtggcagtctgccacctggaagagggcctccaacagaaattgaccattctggcaccctgatctttgtccattctggcacagtgaggtctctaattgtgaaaaataaatgtgtgttgtgtgtaagccgcccagtctataacacctttttatagcagcacaaactaagacaacgtaaaaatgggattgctagattgtatggtagttctattttaatttttgagaaaattccatactgttttatttttatttttatttttttttttgagacagagtttcactttgtcacccaggctggagtgcagtggcgtgatcttagctcactgcaacctctgcctcctgggttcaagtgattttcctgcctcagcctcccaagtagctgagattataggcacctaccaccacgcccagctaatttatttattttttatttttattttttttagtatagacagggtttcaccttgttggccaggctagtcttgaactcctgacctctgatgatctgcctgctttggcctcccaaagtgctgggataacaggcttgagccaccgtgcccagccatactgttttctataatggctgcaccattttacatttccaccaacagtgcgtagtgttctgatttctctgcagccttgccaacacttgctattttcctttctgttgatagtggccatcctaatgggtgtcaggtgatattgtgattttgatttgcatttctcttattgaggtattgagcgtctttttgtatgcttcttggccatttgtatatattctttggagtattgtctatcaagtcctttgcccatttcaaaatcagggttttttggttgttgctgagttgcagaagtttcttattctgggtattaattccttatcagatacagttgtctctctgtgtgttccttatctttggattcaattaactgcagattgaaactatttgggaaaaaaaccaatacaaataacgacacaacaataaaaaatacaaataaaaaatactgcctaacaactatttatataacagtcacatggtattaggtattataagtaatctagaaatgatttaaagtatacaggagaatgtgcataggctgcatgtgaatatgacaccatttgatatcagggacttgggcatccactgattctagtatccattggttctggaaccagtcctctgaagatgccgagggatgactatataagatttgcaaatattttcccccattctgtaagctgcgtttttactctgttgactgtttcctttgatttgcagagggtttttaagtttgatgtagtcccagtttatttttgtttttgtggcctacgcttttggtgtcgtatccaagaaatcattgccaaacccattgtctggaagctttccccctgttttcttctaggagttttatagtttcatgtgttagtttaggtctttaatccattttgaattaatttttgtatatggtataaggtgtgggtccaatttcattattttgtttgtggatatccagttttcccagcaccattttgttgaagagactgtcctttccccattttgtagtcttggtacccttgtcaaaagtcattggccatatatgcaagggtttatttccaggctctctattctgttccatcggcctatataagtttctgtgccactaccacactgtctgattactgtcattttgtagtatgttttgaaatcagggagtatgaggcctcagctttgctctttttcaatattttttggctatttggggttccttgagattgcatttgaattttatgggttttttttttttcctttttctacaaagaatatcattgaaattttgataggaattgcattgagtcttgactgtcttagattttatcgggaagaagctgtttaccaggctgagcaagaaatgtgagctgttggatagaaaacacttcttttgctgcggaggggcttgcgttgccaagtgcgtgttccgattgaggctggataaaagaacggcacaatcaaaccgtgcagtgcagtctgtgaacaaattgtctccagctcgaaatgatgaaaagaatattttaacaacttttgacttcatttaatgatctaaacagtgattatttcttattcttgctgagaaataccggttttatgtgaaaaaccctcaattaacaatttaagatagcaaatgactaatggaaatttttgccagaggaagaagtcagataggagctctctgtttttgttgctgttgttacttgccaaataatatttgctacatttttgggtcagtaatgaggcttaagtgagaataagtgggttttgtatatctaagtccctaattaacaacagtgatacctttttgaattccttccatggtcttatcacctgctgtgaagtaggtgaagtaggcagaacaggagtttttggaaaatattcagtatgaagatactgagcttagagaagtcaggtgatttgtttgaggcctgatagcccacagggacagagccaagacttcaacccatgcatcacaatactgcggcctctgctttctccagaaaaaaaaaaaaaacattttcttattttttcaaaattttatttattgttttgagacagagtctcgctctgtcacccaggctggagtgcaatggtgtgatcttggttcactgcaacctccgcctcctgggttcaagcgattctcctgcctcagcctcctgagtagctgggattacaggcactcgcccaccacgcccggctaattttttttttgtatttttagtatagacggggtttcaccatgttggccaggctggtctcaaactcctgacttcaggtgatccaccggcctcggcctcccgaagtgccgggattacaggcatgagccacagcgcctagccaacaaaaccattttagatagcatataataaatttattagtaattccaaattctgtgatctcacttaatagaaaccacacattctactagtaggccaattaattagccttaaggcattgcctttacacaggagtcaaaagattatgggagacattaatcatcttaaaattccagaaaggaaggtagagggcatttattttccgctaaggggtttagaacagagatacgtaacttaagtatagcttactaagagccagttgttttgatttttattttacttcatttaaatgtgcttcttcaattaatagcagtaaatactcatcaatatgtatgatctgtgatagtattctagataatatatatagttaaattatttgatgttatttagaatccaaacctaatgacacagataaagcagatgtgtttttcagtatccttccgaatcccaaatccgtgggcaaggtaacacctgtttggagtttctctaaaaattacctttctctgcctttaaaaaatatcttgaatgcggccaggcgtggtggctcatgcctgtaatcccagcattttgggaggccgaggtgggcggatcacgaggtcaggagatcaagaccatcctggctaacatggtgaaacctccgtctctgctaaaagtacaaaaaaaaaaaaagaaggccgggtgcggtggctcaagtctgtaatcacagcactttgggaggccgaggtgggtggatcacgaggtcaggagatcgagactatcgtggctaacatggtgaaaccccgtctctactaaaaatacaaaaaatattagccaggcatggtggcgggagcctgtagtcccagctactcgggaggctgaggcaggcgtgaacccgggaggtggagcttgcagtgagcagagatcgcgccactgcactccagcctgggcaacagagtgggactccatctaaaaaacaaacaaaaatatcttgaatgcttttgagtgactccttctaacttgtcacaatggtgatgttcagtgattaaaatgtggaatcctgagggagttcattgcatgtcacaaatcagtacttctactcccctcagcactaagcattgaatactgcttttttttgaaggggtgagggggaagaagctgttttaaattgcagatgtatttggatttcttttttatgtaactcacatttcttattttccaaaaactctggaaacgagttgcatatttccactgatgtcaaaactgatgatcctcacaaagaagcacaaatatgatataaaactataaaacaaaaatattgatagcaagactttgaccagattccagaagaatgtatttgttacatctctgtcactttttttcctcactgcatttctaatagtttaataaaaaatctcttatgaagaaaagattgcctttctcttgcgtcaaacattctcataacttttcattctatcttgaagttttccttttttcttctaaactttgaagaaacagaatccttttgatgtctttgagtatttgccattgattagagcacttggaaaggaattttgcttggaaataaatgtcttttccctgcattctaaatatttcctttgcataaatgcatttcatttcttcttttcttgaccttgacatagttgctggcagagtacagcaaggaactctatgaattttgagttccttggcttctactgatttccttttcttatcctggacattcagggctggcttggagagacccggattagaaatctagagaagaaaagagattttttggctgtcgcagttctatcaggcacaaagtcaagaatattaatgaattcattatttataacccctttgttggacccaccgtactatacatgagtgagaaacagcggcaaggagctcatagtgcagcctctgagattcccgtgtgggagaggtaggcctgggaatattgagcagtggtggcaagtccaggagaacaaggggcagaatccagggcaggtggccgagacaggaagggatcgggagggcccagagcactagaaaggcaggtgctggggtgacagagttaaggaaatcaatactgaccaccaatatagacactgcccaccaatgtagactctgaccctgacccagaggcgggtccatactcctgtactgaagtaggggagagcgagtgagcagggctgtcagaagtgttcttgtgggagagaaagatgacaaagcatctttgcttctccttgaggctgccaagaaaagccaggagtttgaagaggttttagctgtaagtttccaaacatcatgctgtcttcaattgaatctttccttggcatctagaaaggtggctgaagaatagtgggaggaaacctgggctagaattttgctttctgtaggaattacctgaaccgcagtttcttcataggtaaagtgaggaatcttaagaataggatgatgtgtgtacaagtggctcacacagtgcctggcacctattagggcatcactaaatgtttattcactgacctgtgaataggtatgttaggatttttccaaactcttttaggtcttttattactgaattcatgatcataaacatattttcttataattttcctaatgtttacttttactagaaaagttgaacgtgctcattgtatacattttataaaatgtaaaatacagaaaatacagaaaatgcagaaaaataaacttcaattctgaaagtatttaatttaaagtgaaaattaaatgacccaatatctcggcacttagcaataaccagtcgctcgtgttgcccaaactggagtgcaatgatgtgatctcggttcaccacaacatccgcctcccacgttcaagtgattctcctgcctcagcctcctgagtagctgggattacaggtgtgtatcaccatgcctggctaattttgtatgtttagtagagacggggtttctccatgtttgtcaggctggtctcaaactcctgacctcaggtgatccacccaccttggcctcccaaagtgctgggattacaggtgtgagccaccacgcctgagccaccacaccaggcctccttcaatcttttctatacattcattaggaagtgttctctatttgcctttagcacatatgtatgcatatattgaaggagtgtggattagtggttaacaagtatcatatttggcatcaaattggcataggctctagtctggtcattgtatacccttgggttagctatttgtccccttttgacctgtttcctcatcagtaaaaggaggtaatactgcccacttcattgtgcagaaatgaggaataaatgagaatatatgtatagggcttaagaaattacccgggaagtaatgagcactcaaccgacgttaacattgcttattattgttgaattgtgaatattaatgacaaaaacaattatatgagaaaggtgctttataatttcagtgttaaaatagccaatgatcttagcatgtcttgtccggcatgttgtaaaacatttgggtattgaagagttcctgaaagaaattcatgcgaccttttaaggacatcgtagcagtgctttgctttttataagaaatcattaattacaaatgtcaagttaatggcagcttaagaaacaactgagtatattgtggtctaggaagtgtccttttggtaggcttttcatgttctagtaacaaattatcttcagaagcatttttaactacaataaatatattgagacaaaatttaaaaaaattttggagtcggataacttgggtagaacatggaaacatacttgtctggctctataataataaaattgccttctatgttttatggtataccttgtgcttttcaaagtgttttcatttgcattatcttattcacttctccacaaaattctaatagctagctagatattaaaatgacaatctctaatttaaaatttttcttctatgtctttgaaaattttctaggttttacttttcataattgcttattgactccacttagaatttatttggggagttagcttcattttttccatattgatagtgatttattgttgttcatttttaacctgattattttatatgtcagctctgacatatatcaaattgtcctacacttatggatctcatttgatctttgcaagtctgggccagtatcacattattttaataactatggctttacaataagtcttgatgagaagtactctaccttgctttcatttttaagatgttcctaactattccgggcactttgcattttgacacaaacttaagaatcagcttgtcaaagtctgtaagatacacagtcagtattttaattggaatggcattgaatttatgtatcaatttgggagcagttcataactttataatatcgagcctttctatccataaacatggtatagctctacatttattttgttcctgtttaaagtaactgataaagttttataattatattaaaaaattcttatgcatcttttgctatttatattcttaagtgtgtcatttttttcttgctgttgtgaatggaatctttaaaaacatatatgttctgtttgttcctgaaatatattaagtaaagtgatttttaaaaatatactggtcttatatttagctaccttgctgaattgtcattcagataatttaccgaaagattccatagccaatcatattgtctgtgaataatgtcttttgtaatcctcataccttttttattgtcgtttcattgcactagctcataccttcagcacagggttcaacagaagtggtaaaaagcaggcattaactatgatatttgctataggatttcaatacactgtatcaagttaaattcccattcatctcaatttactgagttttcataaattggtgtaaattttattaagtacttttctactttcaccgaacttaattttctgtgtcttaatatcttaattgtatatttcttaattatgtaatcatgtaatattcagatattgaggcaaagacttttccagatgaaaaagacctaacagtttttatcacaatgaggaaaaggaaccaatatgattaattaagcaaattactgaaagatgcacttacgtgggtgtgataataggagcatatcatagttgatgagatccgaagtgatgtcatcctgtaggaatgagggtggaagggattgcatagggtgcttgaagaagtggtgaatgtctgaactgcagtggagggaataggaagcaaaatgaatagaggtagtgaacagctacagtgtacttaaaattacatttttaatagcagctgttggtagagtcttagcagtcctgctccatagctggagtttgtgggcagaacataggaattcaggtagttggattgatctaaggatgtgagtttgcaagctggttgtagcacaggggagggaactactgagggaactggtttgaaaaagcagctgatttggtcaatcataggttggcaggatgtgctgcttaaggaaggaaatggaacaggaacaggtctgatacacatggacatatttttgctaatgaggcagtgggaaagacggaagaagattaggatcagatggggggaaattcaagtagaacatttcagagagaatggcccagtccgggttatggccatgcactttggagtttttgatagaatggtttccagaaagcactgtagatgagtcagttctggtcagactgcctgaaaatgaaatgaaccacttgttctcagctgtgataaatacagttttattactgcaggactatttagtttatgtgttgagtctactaaagtgttgagcagttatacaaatgtattgctatctgaactatgcgtcattttcatgaattgtggtgtgcggtgttataaaatccttgcattttatagcgattagatttttagtaatctttttaagtatgtttgaatatagtgtttccttgatttttttttttttttttttggtatggaagtattttcctttgaattccttatcgtatgctagtttgtacctctttagcatttaggagaaatgctaaaggagaaaatctttgtttcctcaaatagtttttcactctgagaaatgttgaaaaatgtgaagaaatagattttcagcctggggaattatttattcctggcaatttggcatgaacttgactgctcttagagagactatagtaagtggtaaataaataatcttcccattggattcagcaaaggtcagaatctaatgaggatctagactttattttgaaatccacaatttttagggccttggaaaacttgcaaaggattcagaaaatcactgtggaagaaaaaggttttagacatatatattttcttatcttttttttttttattttctggagaagtaatagtccatgcgtgaattaagaaagattttcaacaacttgaaaaattataggctaaccactttggttaggttttcttcatttgcaccaagaatttaacaaacttaattaaattcaggtcaatgccatgaaaattattgtctggttaatccggttatgatcaatttgataaatgcaaacttcaaaggtggttccttgccggggtcctgcagagtgtgtgaaacaaaagtgagatatggtttttgccttcaaggaaattttgctatcaggatagaggtgcgacattctgtattagtcagagttctctgtagggacagaactaacaggatagatgtatatatgaaggggaatttagtaacgagtgctgactcatacgatcacaaggtgaggtcccacaataggccatctgcaagctgaggaacaaggaagcccgtccaagtcccaaagcctcaaaagtagtgaagccagcagtgcagccttcagtctgtggccgaaggcccaagagcccctggcaaagcactggtgtaaatccaagagtcccaaagctgaagaacttggagtctgatgtttgagggcaggaagcatccagcacgggagaaagatgggggccaggagactcagcaagtcttgtctttcagcctttttctgcctgcttttattctggctgtgctggcagcttattagctggtgcccacccggattgaggatgggtcggcctctcccagtccactgactcagtgttaatcttctttgccagcaccctcataggcacacccaggagcaacaatactttgcatccttcagtcctatcaagttgacactcaatactaaccatcacacattcattggtgaaaaatcagcaatataaaacagcatatggttgcataaattctcaggattctttcaactgtggatctatgaaaactaattttatatctgaaaacatcatctcatatgcatggaaaagcctgaatattaatgttttctactaaaaattaaatgatatgttatctacactgatattaaataaattccaaattgtgccaatttgaatttacatcagaaatgttcgttaattagccgagttttgtttattataatatttctgtagtacttgctgtatacctgtactaagttctttacaagtgatagctcatgtcacctgtcttaggaactgtatgagataggtctgttactatcatcactcttttaaacataaggaaaccagacaggttaagtaatttacccaaaatcacatacccaatatgtggaggagctaggatttgaattctgccagtctaccttcaccaggctatgctgcctctttatttttaatagcctcagttttattgtttaccatctgtttgcaattttatcctttaactgccccaaccattccattctttttttttttaggtagagtctcactctgttgcccgggttggagtgcagtgagcatgatcttcattcactgcagcctccgcctcccaggttcaagtgattctcctgcctcagcctcccgagtagctgggattacaggcgcccaccaccatgcctggctaacttttgtatttttagtagagacggtgttgcaccatatttgccaggctggtcttgaactcctggtctcaagtgatctgcccaccttggccctccaacgtgctgggattataggcgtgagccactgcacctggccccattccattctttaatgaatgaagtaaaagtagatacgaatcagaaaataagtaggaaaactgcagattctggggggattacttttgccattctcgggcatatttttaataatggtgagcaaattgatactttgggttgatacccctctttcttctctggccaaataagagacagaaaccacagaaaacagcatagtacgttttctataactgtagtataattttgagtgcatatttctttgaatttggtttaaaggaacctcaaattttccatcgattgctaaagttatgtgttctgtgactatctactttagttgtgattctctcagttgtttgcttaggagtctcatccagtatagtgatggagctgggatatcaatcattcaggaaactgactccatcagtgtgtcagtcacataagagtaatcaatgtagggttcccaaatctcattacttctattccttctgctgtgcctatggcacaggatgacagttttggaaagacagtaagggtaatgataagaaacatcaaagtatccttttcttgagttctgattttaaaataagcctcatttagccaagaattgacaatgactagaccaagacatgtttgacctgtgtctgtcattagcttcctcagtaactgaatgaagaaatcaacgtcacctgatacctgttaacttctaaagtctattagtgtcacattgaggtcctggcactgccctcactattattcaaggtcttgttttactggaagaacttgatctcgacggctatctgcttttgtttttccctaatagttctggacagatatgttgatttgtaacatcagatgagatgcacacgtgtgagtccagactgaaatagctttgtgagtcttgctgtgaaatctcatttgtgtttttctggccattccagggaaattgcaggcagacatgggtaggatgcttttcttctaaaaacttgatgtattagatatgaaattaattattggcccctagtttcagtgcttagagtaatttagggaagcccattacacaaactggcattagcatcctccccacctccttttatcatcgtcattatcatcattactgaggttgaaaaaaagacaccactttctgggtggaattttcactggatgaggggctcccagggctgctgaggcctcactcctcctgtggctctctgatgactctggcattggactcttgtcgggaaggctgatgacagtcccattgtgggctcccattatctgttggagatggactggaaggtgacgtatattcaggatttgtttgataggcaccatttggttctatctgagttattttatcatatctactgatacactgaattacttgccagatgaatcaacaaaggcctatctcaatttggatggatttcctcagagaagagaaaggcagctctagataaatatgagtgcaagataaaatgttcgtagagaaatgggagaaatagggctggggtagacagaaaccttaatgtaggattcaaaagatgctatttgttactatgaattttattgtacacaaaaaagtagttttatcctaacaccattaaaatatgatatttacttatacaatttgcattaacatttccctcaaggtaggcatgtgtgcctgatatgcctatgaatatatttttgtgtctgatgatagtctcccatttctttgtcattcatttcttattgcagtctctttttctacctctttttgagtctgagcacttgaacattgggaatagatttgatggtcacttagcaaaatctcaatttccctcagtgcatgtcttttacaaattatacctgtactttcctttaaacaacattttttttttcagtcagggtctcgctctgttgcctaggctggagtgcagtggcactatctcagctcactgcaacctccacctcctggcttcaattgagtctcctgcctcagcctcttgagtagctgggattacaggcatgcatcactgcacccagctaatttttataattttagtagagacgtggttttgctatgttggctaggctggtcttgaactcctggcctcaagtgatcaacccacatcggccttccaaagtgctgggattacaggtgtgagccaccgggtccgtcctttaacaacacctttttaatggaaatcttgttctgaacagttttcgttccagcattctgaagatggcatctgcatcttctgagcatgcttcttcctcagccgtttcctctgggctctgatctctttgctgtgtggtggaagggatggaaaggagggaaaggacaattggaaccagcaacgcaacattgtgaatgctcagcccttccaaacaacatagtcaccatagaaacaactttctaaagtaacataataacattttcttgaaaagataacctgtttgccattcttggaggcaggggaggcagaggcccagacatgctgtggcccagacagcagcttctaagcggatggagcctgaacccacccagtttggacaaagaagcctccatactccctgtgaaaaagatttccagaagctgttgtgaaaaaaccaccatcaccaccaccacacacaccccacccacccaccaacactaaagatcattcttgagtctgatttgaaaactagggtcacatgttatcaggttgttttgtgtattaaatgggtgttaatacaggtaggttacttagaatagttcctagggtatagtaattgtgtgagttttagaaattgttgttattattgctgtttagtgtatattattcttaaatgtttataaaatgacaatatctgatgttggctaagtagaggaaatgagtattttcatacattgtaggtaagagtatatattggatcattattttgggaagaaagttttacaatatgtctcaaaagtcaaactaaatgaaatctttaataaataaaattctactttgggaatttaaccaataatctatacaattatttgccccaatggatattcatagcagtgttacttacaatggtaaaaagttagcaaaaacttgacctccaggtaaataggtggtttgaatttattcattgaatttcatttactttctaagcttcattaaaactgtagtaaaaattttttttttattgagggaaaatttacacaaaggaaaatatacatatattaaatggacaatttgatgatttttgagaaatgtatacacacatgttaccaagctcctaatcaagaatatctccatcctcctagaacgtttcctcttgccctattccgtgcagtctccacctccatggactacactgttcagattcctctcaccatagattagttttccttgttcttcgacttcacataaatgaaataatacagtgtgggctcgtttgtgtctggcttctttcattgaagttactatttctgagaacccattcatgtcattgttttgttttgtttttgagatggagtcttgctctgttgcccaggctggagtacagtggcgcaatcatgacgcactgcaaccttctcctcctgggttcaagtgattctcctgcctcagcctcccgagtagctgggactacagatgtgtgccaccacgcctggctaattttgtattttttgtagagacagggtttaccatgttggtcaggctgatctcgaacacctaacctcaggtgatccacccgccttggcttcccaaagtgctgggattacaggcgtgagccaccacgcctggcccatgtctttgttatatcagtagttatccctctacttttgattcccatatcctctgtccctttattgttgagtagtgttctatttttgaatatactagaatttattttcctattgctgatactgttgttgttgttttttgactgtcatgaataaagctgttatgaatgttcttgttaccaaaacaaaaacaaaaacaaaaaaaaaaaaaaagaaagaaaactagggtcgaatcctgcaaatgcattcaggtgacggggtcccaccctaacagccatgtcagtagctctcatccatcacgcctgggaaaatgctccattccgcattccttagctctggttctggtttcagacttcactttatattggcggggttttaaagctagaggagtctttacctacttactcttatgtacagatctgaatatggaggtcaggaggggcaaatgacatgtcctaagtcagaggagattcaacaagaaaaccagacagtcaacgactgagcccctggcatatgctgggcattggtgagctgtagggatgtggtgatggagaaaacagagtcccttcttcaaggagctcaatccagcaagggaggcagattctttgcaggcaggaccaggcttccctacagcagaaggaaactaaatcagggtaatgagcctcagcagggacgggcctccccactgccctgagaggacacagggctgtggcatggtcctgctttgaccggctagctgtgcagtagggccaggtggggcctggagtggcctgagctaggggctgacatgagctcccccaaggcactgcataagtaacgttagcctctatttgcacagcaaaatcaaggacatggttttctagaacacaggctgcaccctctcccccaagcctagcaaatgggctacgctggttggtgggcccttgtttgtgacagggttggaatacaccacagggttccgagtgctgagttgtggcccacaggtgactggcaaggggaggcagagctgtagagcccttgggagccatggagggcttgctgcctgccacgaaatgctctctcagcagctgctggtccagctgtgggcagccgtacaagctgtttacagcatcctgggacaggtgcttgcaaacatatggatgccatgggggatccgagcctgcagtgccatggtggcgtttgtggccaagagactatgtgcaatcagaaggagggaagagctggcccagcagaatttggtccagggtgagggccacagaaaggtcagaggcaggatggggctggcacccaggctggtggtggcctcacatcacctatgcctgaggccagtcctggattgccccagaagaaacaatttctttactccaaagaaatccaaaggagttaaaaagtgagagcccaaatccaatctgtgctcagggagcaggcctctctgcagggggcaagggcacggctggagacggaggtcctgcagctgcagctgaggcccccactcttcctgcactgggcagagagccgtgatggggcctcagcaggagtgcatggaggaggacgcctactgtctggacctggaccggaggcttggcaagatgcaggacaactggaagccgtgagtcagacccgcgactggctcaagaagattgcacaagacctggtctagaaattggagaagttccagcgggagatcctcttccacgaggaaatggctcaggaagtgtggatggccaccgggtccaccaagcgggtgctccaggagctccgggaagaatatgacttcaagaggcagaagccggctcactgggaggccaagttccagcctttctggacagtgctttggctcctagggctccagccacagtctgcagggcctggaagtaccagggggaccgtgagccactaggacccccaggagggaggtgagtcatcacctgagggcttgggtccagagcatctacctgtttgattccattttccctgcagccaggtcctgaataccctgaaactcggccgaacatgagcctgagctgctccctcgaaaacacttttatctcttgttactttaggtaccatttattaattgaaactgaaattgttcttagtgaagttggatagatagcgttaggagtgtaagatactgttttaccaataaagattgttggatgtaaaaaagaaagtttttcacacttgtttctccataataattcaagtacttctatttgcatttgtgtcaaattacatccctatacatataatactaaaagacttatttatatgtttacagatacacttggcattgtgtcatactattatatttatctcataatttaaatgttaaataatattgtgtcatgtagatatgctttaatttatgaacttaattccctattgtgaactatttagtttgtgtccattctgtggctattgaatactgcaaattagtttgtttattcagaaaatcctcattcgggcattcaccaatctactattggacactatcccggccattgcatttttatggaagaagcctaacattgaaaagactactgataatgagttccatgggaccagctgttacaggaaaagtagtttttgtggaatattttaggttagtttacctaaattcctatgagaactgtcctttcaaaatattcataacgggctatagaacaaaatctatttattcacttgctgtggtttgaatgtgtttcctctaaaattcaggtgatgcttggctgggtgcagtgtttcatgcccgtaatcccagcacattgggaggccagatctcttgagcccaggagtttgagaccagcctggacaacagtgaaaacctgtctctaccaaaaaaaaaaaaaaattaaaaaataattcaggggttgccaatgcgatagtattaagaggtagggcctttaagaggtaattaggtgatgagagctcctgccttatgaatgggatgaaggcctttaaaaaaaagtcttcatggccaggcacggcggctcacgcctataatcccagcactttgagaggtggaggtggatggatcacttgagggcaggagtttgagaccagcctggccaatgtggtgaaaccctgtctctattaaaaatacaaaaattagctgggcatggtggtgggcacctgtaatcccagttacttaggaggctgaggcaggagaattgcttgaaccgaggaggcggaggttgcagtgagctgagatcatgccatcacactccagcctgggcgacagagcaggaggcttcatgcagccttcatcttcttttgcccttctgccttgagaccatgcagtaagaagccctcaccggatgccggctccttgatcttggaattcccagcctccagagctgtgaaaaaataaatttctgttctatataaattaccctgtctcaggtattttattttagcaaaatggactgagacaccactagtagaatagctatcctctaaaacaattttcatccttttcagcctggcacataactgcaaaacaatagtattaggttggtgcaaacgtaactgtggtttttgcaattacttttaattgtaaaaactgcaattacgtttgtatcaacctgagagcatattaatcttttcttgtttttcaccttaggtggggtctttgaaactagctggagagtattaggtgctgaaaagagtataaggattcagatttgttccaggtgaggcccacacagctttcacccactgtacctcccaggatgaactgatgttggttgaccagcgggagttgtggtaatagttcatacacaagggcacgtttgctctgttgcagccagcaccggcacaccatatgcatgcattttgtaattgttttcgtctgaatgaattaagatatatgttgcatagctgatcattttgaagttatcgctggtaaccattgagccagagacaaaaacaggtgctatcctcatggagtttgctgattctaggatttcttgacaatagggatgattttgagtgttcaagacatcaggctaatgtgggctgctgagtgattgccttctgtgtgggtttatgtgtgtgttttcctctgctgaagcattctatagtctacattacataaaataagatgttccatgtgatttcctttgaagaatgcttgagtaatatagctgttgaactagaagtgctgagcagtatatgcttcttgggatgtcttatgtaacatttggttggatggacctgattttcaaaatgtcatcatcttaaaagttttatttctgctttatggtggcataattgtcaaaaattatatatattcaacgtatacaatgtgatgttttgatatacacgtacattgtgaaatgacgaccaaaaccaagctaatgaacgtatttatgacctcacagagttaccttttttctgtgtgtgtgatggaaacacgtcagttctactctcttagcaaatttcaagtgtccaatacagtgttattaactacagggacccaccctactgtacattaggtctccagaacttatttgttttataactttaagtttataccctttgaccaacatctttgtatttcccctcgctatgacccctggtaactaccctactactctctctcatctgtacaaccaaatgtgtgtgtgtatatatatatatatatatatatatatatatatatatatatatatatatgtatactgtaattgaactatgattcagccatgtgaaaattttttaaaaagtttaatattaatataacatatgtatgtaacacttatatataaaaatataggtatacatgtgttacagcacacataatgattatatatgtgtaacaggatacatatttatatatataaatgtactgtaattgaactatgattcagccatatgaaaaatattttagaaagagtttatgcatatagaagtgctaatgatatataaagtttaaaaaagacatgcattatatgaacaagatgattccaaattcagttttgaaaataaaagcataaaatatacatatatttagatatatctgtatctagctacatcacatttgctctatccatttatccattaacagataaatgatataacaggtctttacaaattgcatatgacatatagatatatatgtcttatttacatatattaaagccttattctgatactatagttatggtacagtgtaaaatctgcatatatgtgtgtgtgtgtgtgtattttttttttttctttgggaagtgtgagtccaagtgatttgaaaatgccagagagggctgggcacagtggcttctgcctgtaatcccagcacattgggaggctgaggcaggcggatcacttgagttcaggagttggagaccaggctgggcaatatagccagaccctgtctctacaaaaaattttttaaaaattagccaggtgtggtgatgcatgcctatagtttcagctacttgggaggctgagttgggaggatcacttgagcctgggtatttgaggctgtagtgacctatgattgtgccactgcactccagcctaggtgacagagcaagatcttgtctcaaaaaaagaaaaagccagagagccaagtgtgacagccctaatacatgttcaggattttagagaggttgtgcatctctttctatgttttaaatctttgtgatatttttaatgagaaatataacatgtagaaaatttggagaacacaacaatacagacagaagaaaataaaagctacttgcaattatgccacccagagataaattgctgttgatatttcacatattttattccattcatttttctgtgtatctgcatatattgttcttttatttttaaaaataaatttggaatcatcctgctcatgtaataaatgtatttttaaactttttatatcattagcatttttatatcaataaactcttttttaaaaaaatttttaacatggctgaattctaattcagttatagtacatttctcttccgataattttgggactatttcatattagagaatcttgtctccttgtcttagatgctattttaccccatgtatccatttttgaataaaaagagcctgtctttaacaaaggtctgttttttttcttgagtactcctgaaatctctccttggatctggaggtcaaattaatatagcaatccctggccaattttggatgtctcatttcttgtatctctcatgcatggctctggggtggatgttggactgagtcagggttttctcttgcttctcttgtgaggggatgctcctgttttttctgtctctgccattccattatatgctggtcctataacccaaggcccatagactccctggtctttgttttttctcatagtttgcatcactgggtgccgtgtgttggtcttgtgacaatctctgcaaagaagctctgatgctggctgggtgctgtgtgttgtgggggtgggaacttatcccactatcttggaaagcaggcaccggggaccacaggtaggcttagattcctagggaaggcagcactaggaccatccaggccaaagttcagggtgattcctcagggattgatacctacttaattggtattttacatcttcagctggtttacctttgaagcttttatgtgttgtcatggatatttctgttggaaaatgtgggatggcaaatggagcttagcgagttagctgtcactgccgcagagacgtctcacacagatttgtcagggacgatgtttgggctgctgggatagtggcctaattcagtaccatgttcaatctcagcctgtgccctggataccgcttaggttattggatggcattactatatggtgacacggacgcggatgcattttatctttggtgagatagggcacagaaactttaaaccttacatgtttgacagcatcacagagtacaaagctcaccgtggctcttttcaagtacagccccattccatggcactgactcaggaagcttgtcatagactgtgccagtatttagatttgactatatgtgtacaagttatcaatgtgctctgcagtgatggtacagaggctaagatgtgtaggcatttgttatgctctttacaagatatctttgttagcatgataattttgcatttgtactctgaacaatcttctgatttttttcagagttaatattctttcaggtgaggaaatgaaggtttagatagacaggcttgctggagttttcccagctagtacgtggtacagctgggatgagaacagagcttttcctctatttagtctaggacatttcctaccattgcaccaatttttaaaacaaaccactgaatcatctactttccagaaggaaatttcattgcaatggatttatgctttgctttatcatttatccatttgacagttctctgaaccatgattgccccagtttaaagaaatatcaagaatgccacacttgatttccctgaatgccaaagtgctttcaatgtgtattgaataattgtggtgtgtaaggatcgttcctagtgagccactccccttaatgtcactccagacagcatgatttatttactcctgaggatggttgataagtaggatacctactcgagggaggtgtcacctttatggtgggacatacaataaaaataattattgaaacaaatgaagttaattagatgagagaagttaaaatatttgaagtcagatgtgcacagaacagcaaagatacttggaaattttatgatagtgttataatctccttggcagatggctaagcattaaattgcagacatctctcttgtttttgactttttttttttgctgcatattttgttttgttgtttacaaagaaagttctttggaaaaagttcagaacatactagaaataatacagaaaatattaggttcacccttaatcctatcatctagacataattacccccatgcttattttctcaatcctatatttattaatcttttctcatttaaaactacgttgtggacatgtgttctggatattagcaaatccagttgcccaccaacatttttaacggcttcatggtgttctgtaatattcatccctctattaatgaacatttaagttgttcccagtatttcactattgtaaataataatacatagaatatccttatacatgtgtctttgagaacttgttgaattctttttttaacaaaaattcctactgggcttggtggctccagctactttggaggctgctgcgggaggatcaattgagcccaggtgttggaggctgcaggatggtatgattgcaccagtgtactccagcctgacgacagagcaagaccccttttgttacaaaatgaaaaggaaacgtagaaacaatattgttaaattaaaaggcatgcacattttaaagtatttggaaacattttgccaaaaaagtaataatactaatgtactaatatgcattccaacacatggaaaataatgctcattttcctgcgtgttaaccatgattggttattattattattattatttgagacgaagtcttgctctgtcacccaggctggagtgcagtagcgtgatctcgactcactgcaacctccgcctcccaggttcaagcaattctgcctcagcctctggagtagctgggattacaggcacccaccaccacgcctggctaatttttgtatttttagtagagacagggtttcaccatgttgtccaggctggtctcaaattcctgacctcaggtgatccacccaccttggtctctcaaagtgctgggattacaggcgtgagccaccacgaccggctgattggttattattattaaccatttttacttgccattccagtagtttttttaaaaaaagcaaaaaaccccaaaacctatttttgcagtttggcttattttttaggtttttaaatatttttttttgacacagagtctcgctctgtcatccaggctggagtgcagtggtgcaatcacaactcactgtagcatcaacctcctgggctcaagtgatcctcctgcctcagcctcccaagtagctgggattaccagcatgcaccaccacacccagctaatttttgaattttttgtataaatgcgatctccctctgttgcttagatttgtctcaaactcctgagctcaagtgatcgtcctactttggcctcacaaagtgctgggattacaggtgtgagccattgcgtctggcctttttttgttttgtattttagtagtgaggctgaactttctccatggttgagtgtatttcttcttttgtgagtttcctacttaatacattatttgcctgcttttctaatgggagcgcctcttctcaatatataacagctgtttataagataagattatttacccttagtgaattaagtacaattgcttttcttagtttgtaatttactttccacgaggtttatagtgtggtgcttttacatttttatgtagtcatatatgtttatctcatctgatctatattttattaaattatttcatatttttcccactgttaggacttaaatctttaacctatctgaaatttattctggcaaaggatagggagagctttaatttttttttccccaagttgttagctaattgtcccaacccatttattatctttttttttctttttcttttttttttttttttttttttttagacagagtcttgagctgtcacccaggctggagtgcagtggtgtgatctcagctcacaacaacctctgcctcccaggtttaagcgatcctcgtgcctcagtctcccaggtagctgggactacatgcatgcaccatcactcctagataatttttgtatttttagtagagatggggtttcaccatgttggccaggctggtcttgaactcctgacctcaaatgatccacccacctaggccttccaaagtgctgggattacaggcatgagccattgtgtctggccctaatcaacttattatcttattgaatgtagctgcatttttcattagtatattgtcttagtccatttgtgtttctataaaggactaactgaggttgggtaatttctaatgaaaagagatatatttggctcatggttctgtaggctgtacaaggggcatgacaccagcatttgtctctggtcagggactcaggaagattctactcattgcagaagggcatagaggaccagagcaggcatcacatggagagaggaaggaaatgaggaggaggtcccaggctctttaacagtcagctctcacaggaatgaatccagtgagaactcactcattactgcaaggtattcatgagagctctgcccctatgttccaaacacttcctaccgggttccacctctgacattggggatcacatttcaacatgagctttggaggtaacaaatatcctaactatatcatatatatttcatatgcatttaattaccataactttagatttcattttaatgtgtagcaagggtagtttcactcaatccatttctctttataatatttcctttgccttttcatgaatgtattcttccttatgaactttaagaataaaatacaacattcattgaatatatttgcaaaattgatgtgagaaatgtacttggaattagattgtattctcatagcaaaggcatcctggagcacgtatatatctaggagtttgaaatggactagtaattttgcaagggattatggtattgagcaggagaaaggaaatgacccatggaatgtgtttctcatatcacatgaagtcaactcggagaaggtgaggatctttatggtttaaattcattctgttctgtggataagaactggcaacttaattctgtcatgtagtatatcttcctttggcctaagaattgagccaggaatcccagggtaaagcaaccttgaaatttgtttttttcccagaatcatttgaaaaacattccaggaggaaaatatgtagcattggcaggatctgagtgagatacagtagtcccgtcctttattctcaaggaatacataaaacatgaaaggagagattaactctgggattatgtggcaacgctccaggcatataggaaaaaaacactatatacagggttcagtactatccacagtttcaggaatccagtggattaagatgttgtaaatgaggattcttactttttatttacctgtgctggaactcctggaatcatatgaagtattttaaaaagcatatttgacttcatatttccttttattatttcatatttttttctctatatttttgcttctaagcaggtattttggtgctatagtaagcattttaaacttatcaaaatacttgtgttgttttcatatacaaataaagagagaaagcagactgggttttgaagaccagcagaaaaaggtttcctagtcttgtaaacttaggaattatataggatgatatatgtaaaattttgctccgtttttgggatatggtaggtactttccatgataatgaaaaagcttctctataaattcatgataaatagtttgggggatcaatactgtttacaaaattcccctccaaagtttcacattttaatggattcatattttagtaagcctagggactgaactttacaggttgtggaaagtcctccaaatattttttactacattctagtaattacgttactaaggttttgttaggttacacattttaaccaattaatatggagctctcacaatgtcatttcacgccagtagtatttacacttcagtttgttctagttattaagtcaatatttgcaactttaggtaaacataaattaacgatatttaactaaggaaataatgcattatagcatcctctatataactcctgtaacaacatatggaatgaaaaatattaatctagtaaaatcatatattaggaccttcaacttaactttaattctaatttttgaagaattttcaggttcatagatgaaagtttaggttcaatattacatctgcatctctatgaattcagtcttttcaacctatgtctgtgtttcaatagttatattgaattcagtattcacccttgaatattgagtttgaaaacaaaattatctatgattttttaaaaaatcactaggctatcatgaattttattaaatcttagaaaagtgaggattccaagccttaagttgaatgttcaattgattttatcttttaaaaagtataatatgggctaggagcggtggctcatgcctgtaatcccagcactttgagaggctgaggcaggcggagcacctgatgtcaggagtttgagaggagcctggccaacatggtgaaaccctgtctctactaaaaatacaaaaaaattagccgggcatggtgggcacctgtaatcccagctacttagaaggctgaggcaggagaatggcttgaacccaggaggtggaggttgcagtgagcgagatcgtactattgcactccagcttgggcgacacggtaagactccttttcttaaaacaccccccaccaaaaaaaaaaaaacaaaaaacaaaacaaaacaaaaaaaagcaagaaaaacccctataatgtgttcaatatactatataggtattgcaatttgaagcatttaagttagggtctgagtagcacatgctgaatgaatagtggcccagtgctttgtgcatagtggctattcaataaatatttaccaaagtgaaggactcttccccagatcactccagctcctccagggtacctgaaatttctgtggctggacattacagtatttagtcccgaataagaagcagggttcttacaaattggaagggctcctacaaaattggttaattgggattagactatttgtatccttgcccaaggaagggtggcttttctggggaggcttttctgatggggacctcgactggtaggacactgagtatcatgggtagagaagtagcctctgacatggagtatttattatattgtaacatcattgcattattataatgtaacctttccctgctcgatgactcaggctataggtagtctacgtgcctgacttgttgatctatgcaccttcttgaggttaggaattaaaacactttttttttttttggtaatttttaaacactgtgcatgtacctaaagtgaccataggaatatttgggaaattttacttttggatatcagctagttgttaccaaagtgctttaggtggtggctaaaaatgtcagtttgcctgactttgaatcttgactgcacatcgcataacagctgtgtgaccccagacttcttttctgtgccttcgtttccttctctgtcaaatgggaataataatagcaccaagttcataggacggcagagtatccaagcagtgtctggtacatggtaagaactcagtacatgtcagcggtggtggtgataatacgtgtatgagttccaaggtactgagtaggcacagtgtgaagtagttgtgtttgtgtcctgtgattagatagtagtgatgactgctgactcgctttactctgtgcccaccagaagagacctcaggttctgtgggatgcaccctgagtatgccccaagaaagagcagagacttgtacttaggatttgtgatttgcagacgcaagctttgctgtatttgttttgctcgaagggcttactgctgtggtattcagaatgtgaaataatagttaatggagacaaggggattaatagcagcatttaaaatcatttagtgactaataactttgtggcttataaaatctgtaccttgatatgcaggggtggctgttctattaacatttctaagctatttaaaagtcagttggatgcttttcggttgcacattcatttttcatctttgcccttccattcaggaaacatcaataaagtttaataattttctgtcatttctggaaaaataaacaagattatagattattaagggttatttttcattttgatggtggataaattaggaggaatccttactgaatgaaaattgtgaattattgattatgatcacaggattaatatgaaaccactcatatatctcgatgtgcatagcttcttttctagtgccattgtagatggattgaggaatactgtgaactgggattattgtgtattaatcattgaacacctactgtgcaccacactgattataggacgtgtatgcattatatctggcctgactttagcttctcaaaataggtattttatggttgaggaaatgcaggctaggagaggttggacaactgacccaagatgctataggttttcagcttgctttctttctggcatactttgccatcaaggcttttaatataattttttgctcctcaaaaaaatttctttcaactttagtgaaatctagcctcgtataggagaaggttcaccatggggaatttggcatttgagtcttgaagtcaaatgctggggtatgggggactacattatttgtactcaggatccagaggggagttatcacaaagccagtgctttcttttcacctctggtttagggttgggctcccctcatacagtcaaggtccagttgaatatggtaatcaaaagaacaagctggggagtcagagagaccttagcctggatattgggtggtacatcagttgggatgcttttggctgtaagtaagagatgcttatttccatttccaaatgcctcatcccaaaagcaatttatcatcataagtccagacgtggagccagtcaagaggtagcggctgacccacgtgatccatctttctgctttccttatacttgatttttttttttttttttttttagctggcgtctcactctgtcacccaggctggagtgcagtggtgcaatctcggctcaccacacctctgcttcctgggttcaagtgattctcctgcctcagcctctcgaatagctgggattacaggcctgtgccaccccgcccagctaatttttttctttgtatttttagtagagatggggtttcaccatgttggccaggctggtctcgaactcctgacctcaagtgatccacctgccttggcctcccaaagtgctgtgattacaggcatgagccactgcacccggcctatactttatgttaatccgtccattcactcatcataggacggctgcaggactttcacatatcccattccgacgtgtcaatgtctggaggacattatggctccatttcttcttgtggctctttcttagaggagaggagcatttttccagaaccctcttgcccccggagacgtctacttaagtcttattaaccagagtttggtcaaatgcctgttcctgaaataattactaacaaagtaaaaataacctctacaaatcagggtgtgatagcttcccttggggcacgtggctgtgttggggaggaatgagtactgcacaaacctgagatcctgctagaaaggaagaaggagggaaaggatataatctcgaagacttaatttcctcctggataagtggagatgataacactttcctaacatagttgtctaatgagatagctactgaaatccagcatcagaacaagagattaccataaatttgaagaagtgtgaaaccaggtaccacagcctggcccctgcttaggcttagttacttaaagctgtgcaatttaaagcagttttggaatctccccttttcatttacttgacaactgtcttttgagaacctatcatgtggcaggcgctgtgccaggaatgacgttcagcacatacctgtcatgtgcatgcaagtacttttagctgtgattacttggtgtatagtatgtttgattggttatgtgttgattactgaacagctactctgatggccagttttaggtgtcagcttgactggattgacagatgcctggatggctggtgaagcattgtttctgggtgtgtctgtgagggtgtttccagaagagattgacgtgagagtcagaggactctcaatgtgcatggtgggcaccatctgcctggctggaagcccagctgggacaaataggcagatgaaagggaattcactctctctgctttctgtctcccttctgagcaggtcactttttctcctccggcctttggacatcccagtccggtttctttggcttttggactccgggacttttaccagtggcctcctgggggctctcaggcctgaccggtggtgtgctgttggctgccttgcttctgaggctgccagatttacactgagctatgctactggctttgagccatgttagcagcttctctgattctctagcttgcagtcagcctgtcgtaggacttctctgcttctgtggtcctgtgagccaattcctcccagtcatccccctccatatataccgtatagtttctgtttctcgggagacacctgactgatacacctacgtttcactctgtattatccatcttgcatgcatcatctctgatcctcacaaaaccttttcagagtagattattttacagttgaggaaatgcctgtaacaatgtcaaatacatattattttcaggaagtactggttgggagaaaacccctcagaattagaaaatattcttgctgtttcgaaggagtccagtatgtcaaagtctacctgcctctttcattaataaatactgggaagctgaggtgggcagatcacttgaggtcaggaatttgaaaccagcctggccaacatggtgaaaccccatctgtactaaaaatagtaataaaaaaatgtagctgggcgtggtggtgggtgcccgtaatcccagctactcgggaggctgaggcaggagaatggcttgaaccctggaggtggagtttgcagtgagccgagatcgcgccactgcactccagcctgggtgacagagtgagattctgtctcaaaaaaaccccccaaaacaaaacaacaacaacaacaacaacaaattggggataggtctgcttgtcttataagtttgtagccaaagtatctcatatgtttatatttttgaaaatccatttcgttcctggaatatgttaatttattgatattctagtcagtaaaagacttgcatggaaaacattgattagatgaaacactgaaacagctaaacctcacttccacttgtttaagacatcaagctgtttaaaggtcagctggatgctttaacttatgaaatgtgtaagcagaggagtgattttctgaagaaagtcgtttatattagaaataatgatttatttaactgtgttttggtcacaagcatgacatttcgaacacagtaaactttatagatatgaagattattgggaaagatttattttaaaaagagagggatatgaaaacacggggaaatttcaggacatctcaaacattgtgctaataacacctgtatttgagttagtcacatgtactgcaaatttttcaagaagaaaaattgtttcaccatttcctttattagctaaattcggaagtcaagttagtagctaggttcatacctagttctttgtttagagtgcttgtattctatttagtaagaagggacatggttttacctctttatcaagggctcactgaggtagtatattctgggtggtggtcaacacagatttcttttccatgtcagagggtcaagctggacctttcagcctggccctagggaaggctgtgttggcattttccatttttgtaaatgacatcatagtctttcaactgaatggctagtgactatgtcctatttttttttaagacagaaatatgtgaaatttaaggaacagctttctctacagctgatgatgtgggaggtttgtgaataaccgttggcaggtcctatgaagaggaggagctagtgttccatggggacgtgtgcacatgtttttatcctgggaatattgcatttgtgtgatatcttctctttcagaatgtatcaaaatagaagcttgggccaggcgcggtggctcacacctgtaatcccagcactttgggaggctgaggtgggcggatcacgaggtcaggagatcgagaccatactggctaacacggtgaaaccccatctctactaaaatacaaaaaattagctgggcgtggtggcaggcgcctgtagtcccagctcctcgggaggctgaggcaggagaatggcgtgaacctgggaggcggagcttgcagtgagccaatatcgcaccactgaactccagcctgggccacagattgagactccatctcaaaaaaaaaaaaaggaagcttggggccagtggacttgttggtgcatattaaatgggttagagagacacgttcttaatgttatggctcttcaaacatactccaaacctctcctatttgaccagccagaatcttatgttattagtgttgctaacccctttttccctatatttttgatagtacgctggaaagaaatgtctgtctgtcttgaggttttcagtctttatttaaggttttgacgatacctgcaacatagacaaaagctaggattttagattgggggaaatttcctactagtagtccagtagtaccggcattttctaaccccaaatttatgtttcttcttcatattactgttttaaatattctgtattggctgggcgcggtggcttatgcctgtaatctcagcactttgggaggctgatgtgggaggattacctgaggtcagaagttcaagaccagcctgaccaacatagagaaaccctgtctctactaaaaatacaaaattatcccggcatggtggcacatgcttgtaatcccagctacgcacgcaggaggctaatgcaggagaatcgcttgaacccaggaggcggaggttgcggtgagccaagatcatgccattgcactccagcctgggcaacaagagtgaaactccgtctcaaaacaaaacaaaacaacaacaaaacaaccgctgtattgttctgtgataggtgagcaggcacttgtgttactttgtaatactgtcttattccattttctgatgttatgacagaataccaaatggaaagaacatatatttatttatcatagttctcaaggctgagatgtccaggatcaaggtactggcatctggttagggtcttcttgctgtgtcctcgcatggctaaaggtgggcaagagacatgaagcctcttttacaagagccttaattccattcatgagggaagaacactcatggctgatttcctcttaaaggcctcaccttttaataccatcacattgtaaaatacatgaattttggagaggatacatttaaaccatagcattaaattaaggcattaaatcaattttggttgcttatgacaaagatctctgacaacctaactttattcctgtagttggtatttttactgtaggcagatttggtcaattaaaatgtaatcttgtgagtcacatgacaaaattttctttcttcttctttttttaaggttatgtaatagagggagagaactcactagtcctgggccataaaaactctgggcaaaggatgtgtgacttctcttctgtcaactagaaattatatggccacaccacaggtttgtccgaccagtctatcgggcagtttacatatcagaaatttgaagagcaggtctgagtaattattgacatgaaaaacaaaaatagaaacacaaagcacttctaaaatatgtgtgtcaaaggagtgcacttccagaattttctccttctggtctgtaaggcaaaactttttcaggtgacagtgcccacaatagacaaatgtgagtcattttcctacaattttgaaattattgttagttcattattcttagggttctactgtagatgtgaatttagagaatggaatctaactcatcatggatgatttcctttttgcaaagcatcttgtgggacaagataatagtattaataacaagagaaatggtaatacagttgaacccttgagtaacgtatgtttgaactccttgggtctacttatacgtggaattttttcaatgaatatattggaaacctttttggggatttatgacaatttgaaaaaaaactcatagatgaactgcatagtctagaagtatcaagaaaaaataaggatggtatatcatgagtgcataaaatatatgtagatcttagtctatttatgtgttaatcaactgtttatgttataccaactgtttagttggcaaggtttccaggcaacagtaggttatttttagttaaggttttgaaaagtcaaaagttatatgcagatttttgactgtgcagggggtctatgccccaacccccatgtcgttcaaaggtcaactctattagtaatggtaatagctattagtaatagctaacatttatttagcttataatgtccaggtactgttctagagtctttacatatgttaataattatgacttacaggctgggcacagtggctcatacctataatctcagtactgtgggaggccgaggcaggaggattgcttgagaccaatagatcaagaccagcctgtgcaacatagtgagattccatctttataaaaacattttaaaaaaaagttaggtgtggtgatacacacctatagtcctagctactagaggggctaaagtgggaagatcacttgagcccaggagttggaggctgcagtgaaccatgattgtgccattgaactccagtctgggtgacagagcaagactttgtcatttacaaaaaaaattataagttactattttcatccccactttacaggtgaggaaactgaggcccaggaaggttacgaaatttgcccacagtttatagttggcagagagggatttgaacattactttcttatttcagatttttttgcttttaaccactatgctgtgtttcccaaggttctgatcatttcagaaggtttgttttctgttgcataactatgagagctcaattttggttgaattctttcaagtggcatcagtgttttgaagtctgagtaggccaggtgaacaacatccattttcttacctgggttctgaagaacttgggaaataaaagaggaaggcagatataagattaaaatatcaaatttattaccgacagagagcttgttcttgggaactgtccccaagaggaagaaagttgaggatgcccacctgtattcgtccgttttcgcgctgctcataaagagatgcccaagactgggtaatttataaagaaaaggaggtttaatggactcaaattccacatggcagagggcgaaaggcacgtcttacatggcggcagacaagagagaatgagggtgaagtgaaagggatttcgccttataaaaccttcagatcttgtgagacttactcgctaccatgagaacagtatgggggaaacctcccccatgattcagttatgtgggtccctcccacaacatgtgagaattatgggagctacaattcaagatgaaagttgggtggagacacagccagaccctatcaccacctatttctaggtttaccaatcagctaagttaagccatctcctgggggtaaagggagtgaatgggacagaaagagccatggagtgggtgggactagagggaattcttcttactggacaccagaagagtgttaaaagggatcccctgtaggcagagcacggtggctcatgcctgtaattccagcactttgggaggccaaggcaggctgatcatgagatcaggagtttgagaccagcctggccaatatggtgaaaccctgtctctactagaaatacaaaaattagctgggtgtggtggcacatgcctataatcctagctactcaggaggctgaggcagaagaatcgcttgaactggggaggtggaggttgcagtgagcagagattgtgccactgcactccagcctgggtgacagaatgagactccatctcaaaaaaaaaaaaaaattaaaggtgtcccctgtaacattagcattatgtgttaagtctggaatctagtgaaaagttcacatttctgttagaacagggaacggaagggttaatgatgttcaggaacggttttatggctcagtgggaaaattgcatgttgttagaaatatagttggattcctctcctgagttcatgcgaaattgctgcgtatttcgcctctcactgattgctggaatttaaaaatgcattcctctggaccaaggtagttgtgtttcctttccatgtctttgaagtgcttttctcccccttaacttgtcagtggcgtggcgtacatgtttttgttactgacagtgtggccaattattgtgttctagaaggcattgttgtctctgagaatgttacatgatatgagtagcaagtctgtttattcagaaaaacacctcagatctcaaaccaatttagagagctcagaaagcagtacttggagagacacttccgagagatagcttagtacatcatcagagtccttattcctgattctaaggccatttaagcatgggtcacactggactgctagttggcatagagaggaagtgattggtggtgaaatctgtggtacttaaaagcgctgacagtgtaggaggccagatttcaatttctagaggtgtcattttagaatggagtagggaagacatatgtgtcacatagtggtttttttggtttatttgtttgttttgagacagtctcactctgtcacccagggtggagtgtagtggcgtgctctcggctcactgcaacctccgcctcccgggttcaagcgattctccagccttagcctcccaagcagctggggttacaggtgtgcaccactacacctggctaatttttgtatttttagtagagatctggtttcaccatgttggccaggctggtctcaaactcttgggctaaagccatctgcctgctttgcaaagcctcccaaagtgctgggattatagacgttgagcccctgtgcccagcctgtcacatagtgtataatgacagttatgcatagagatcgaaaaatgttggtcagagggcacaaagctttagttagacgggaggaatgagttcctattatacagcatggtgactctagttaataattattatatacttaaaaattgctaagagagtaggttttatatgtccccaccacaaaaaaaaggttgattatgagaggttatgactatgctaattagcttgccttaatttcacaatgtgtacatagatggaagtatcatgttgcacagtttttatttgtgaagtatgtctttgtcgtgaaagcagccgtagtctatgctacagggatgggcgtggctgtgttttgataaaaatttatttacaaaaataggaggaggggtagattcagtttgctgatgtgtcaaataaagtaagttttgttcaaaactgtttcatcataacatctatgagaaaaaaatgaaatggattcttggccagggctagtgtctgggtggagtttgcatgttcacctcatgtctgcatgggttttctctgggtactccagtttcctctcagcccaaagctgtgcacatggcattcactggcatgtccacctgtttgcagtgtgagtgtggatgtgggtgtgagcgtgccctgtgatgggacggcggcctgcccagggcgggttcttgcctgacaccctgagctgctgggatggaatccagccacttgcaaccctgcactggaataagtggataattatcttacttttttattaatctttcttaaataaatgtgtagctcacatttattttgatgttgagtagcagaagtgttttggtctttatttagaagcttggtggtgtttttggatcagaaatgtgctgtaagaacttaactcttgtttttgcctttttttttttatttttgatttccataggtttttggggaacatgtggtatttggttacatgaataagatctttagtggtgacttgtgagattttggtacacccatcacccgagcaacatacactgaacccaatttgtagtcttctatccctcaccctcttcccaccctttccccacaagtccccaaagtccattgtgtcattcttatccctttgcatcctcatagcttagctcccacttgtgggtgagaacatacgatgtttgcttttttattcctgagttacttcacttagaataatagtctccagttccatccaggttgctgcaaatgccattaattcattccttttaatggctgagatgtattccatcatatatatatctcacagtttctttatccattctttgattgatgggcttttgggctggttccacatttttgcaattttgaattgtgctgctattaacatgcatgtgcaagtatctttttcgtataatgccttcttttcctctgggaacttaactcttgtttctatcaatcagcctgtggtaaaactggtttccttgtaggtcctttcccttaaggtcgcagtttccaagaacctatgcacaacactaaagatttgctgtacatgtgataaacaacatagcatgctgattaagaacatgaactctgaggttagaccacctgagtttgaatctctgcagcttccttctgtatgaccttgagcaagcgatttaacctttctgtgccttgctttctcatctgtaacatggaataataaaaaccttcctcataagggaaaaaaaaagagtaagaacctgcactgttcaaaatgtaaattaagtgttatcagatgcccattgccaaattctcttccttttcatggtttttgaatgcttgtttgtgtgtagcttgacctagaagctttgggtgatgtgaaaaaaaataggaagaaaaatagtgacagctaacattgtgcacctatgatgcaccaagaactgtgggaagtatcccctatcattgcttcatttcactccaggaggtagggaccattttacagatgtggaagctgaggcctgtggtggagctcctttcccgtggtctcacactaaatggggagagactgcagacctagccctgtggaccagctgtagcatcgcatcttctccaggaaaggagagagggtgggcagtgctttgcttacctgatttcattctggttgaggggataaacctggaaaaatacttaaatgcctatattaactcatgaaaaaaagaaagtattctacaggagaaatgtagcactttgtggccttttatgcatggtggggatgggtggtttgctgttagtattatagtttttcaccttttgggtttcattatgtttgcaccaatgagacttgtcctttaatattacttgaatgaaggacgtcggttaaaggtctgtgcccaaaggctggtttcctgctgccccagcacagcttctggtgacccggaagtgatcctatgatggggaaagttggaaggctgtaaacatcccagagttcctgttggtacattgaattcattggttggtgacccggaagtgaccctataatggggaaagctggaaggctgtaaacatccccgagttcctgttgggacattgagttcattgccatcctgatgctccacacaccaggcctaaagtggctgcgggggtggggaaggtggcattggtgccagttagcatacttctcaggattcacatgctgacaggtgtttattttttcttgatcaaaacacaacagaataaaaaccagagggctttaaactgaagtatatcgtgcccttactgtaagctcaaggacactgcatctccatgggttctaaacataagatctcccaccaaccctgcgtccactctgactccagcacctgatgaccttgttggggttggagagatttccctctcagcatcatctgtgtgtgctcatatataacgttaggctaagaagatagccccccctttttttatatagagctttgccatttgcttccacaatgcaatctagattatttctttggtgtcctcatatgtgttttccattttaaaggtggataaaatgtggaaatagtacgttaccctaagaaaaataactagaattaatcataaaagcaactgtcttgtatttatactggaaggacagaattaaaaacaaccaactaacaaaagaaaaccaaaattgttgctcagataggcaaagagaggggaaatgtaactgtaatgacagattcaatttctttaaaaataaatgttaccaatattatccctaatgctattttatttgcttagaagagaatgctgcattaagcttcacctttatatgccactattataggtctagatttgttatcaaatcacttcctggaaaacagacaaagcaatacctaacaatcacttgaaatgaataatcagatctctcaaaattatactacatttttttttcaaatcaagataattgtaaggaattgacattgaaagtagagacagcttttgtagtattctgtttttcaagaaactaggttatctttttaccaaatgcagacttagcccttcccctgatagttgtcttaatagaagtcagttgtatactgggaatgtttttatttttaaaatgatactcctggctgggtattgcggctcacgcctgtaatcctagcactttgggaggccttgacgtatgtatcacctgaggtcaggagttcaagaccagcctggccaacatggcaaaaacccgtctaaaaacccctctactaaaagtacaaaaactagacaggcgtggtggcacatgcctgtaatcccagctactcaggaagctaagacaggagaattgtttgaatctaggaggtggggcttgcagtgagctgagatcgtgccactgcattccagcctgggtgatagagagagactcgtctcaaaaaaaaaaaaaaggatactcctcaaattatgcctacttgtaatttggagtatggtcgctttttcctgtgcacaagttaaatctttgataatcttaagaaaagcatgattttagcatggagtgaggattatgagatttgtttctgtagccgattgaattgttttgtttctaagtggttgtatatcaaggaatatcaaataactatatctgtcattttcgtgtgtctgtttttccccacttattttttaagccagttaaatgccttgctgaatgagagtgaggggaggaagtgggggtgaaatgaatgctttttagaacttcctcaacacatttagttcttttcattctttctttttttaaatagagatagtgtctttttttctttctttctttctttctttttttttttctgaatagagatagagtcttgccatgttgcccagactggtcttgaattcctgggcttaagcgatcctcctgcctctgcctcccaaatagctggaactacaggcgcacactactgcacccatcttttagctcttgtttgctagatgtatatggggctatgatggagagcccagcattagcagtagagggtagacatggcttattaaaataaatgtcaagccttgcttggattttgttttacccacatcagcaccccttgaggctaaaactttctgtaaatctctctgtaaaacagaacaggattatgaacatagaacatggtttatcatgttctctgatgaggagaattgcatgtggatttagaggaatccccagccaggcagtctgggactcagtggctggtagggggcttaagtttataacactgtggtcatggcctaagcaagtagcaagccttttccacttccctactcccaccgcatcttgttccacattgcttcttcaaaggaggcagcatggatatctcttctttgccatgaatgaaggtggtgatagacaaaccaccacttagcatctctgagacttctgtggacaattgctgtaatgtgtaggtggcaaataagatgaggtcttcccactactgacccagtattctttagcgtttttctagtgaattaattttaggtagcaacttccttattctacttgagaaaatgtgaacagaggagtgatactgtaaaatacatacttggtgttcaatctctttttctggtacataactcctaaaatccttagaatctccaaagtgatgtcttttgtatgctaatgaactgattgatggcttgcagaacctaggtagcttcagaattacttctggtcacctaaaggacccaggcaggaaaagagggttgagattttcagccccacccccaacaccccggggagggggagagggtctgaaggttaagttgatcactcatttccaatggtttattcaatcatgccaacgtaaggaagcctccataaaaacccaaaaggacaaggttcagacagtttctgtatggctgaacatgggggagtggaagtttctaaagggtgacatacctgagtatcagatggtacctccttgtaccttccctcataccttaccctatgcatctctttatctgtatcctttgcaatatcttttacaataaaccagtaaatataagtaggtgtttctctgagtttcgtgagccactctagcaaattaatcaaacccaaggagagggtcatgctccagatcctcgcaacttgaagctagcctgttagaagttcccaaggccctacgtctggactggttaccagtgagaagtagggggcagtcttgggagactgagcccttaaccggggaatctgaggccatctgcaggtaaatagcattagaattgaataggaggacaaccagctggtgtctgctgcagaactgattgcttgcctggtgtgtggggagaaaccctcacatatttggtcacagaagtcttctgtgttaatgatttgtgtggtatcagagcagagggaaaatcaagtttgagtttttcctcactcaagaggacagaaagattttgaatgctggaatgataggaaattatgcttgaatgtgtttcaacatggaagtcatttttgttgactgcatcacccacgggatgttagcagtaagctatgcataaatgatatttttatcagctttgcacagaacgataggatatagaaggagaaaaccaggaagcttacagaaaaagagtgtgaagattgaagaaacaccaccttcacttaggcagggcacctgtgttaagagaaaataccctgagataattcctatgttccaacgaatgctgtaaattagtgtttggtaagtatctgtgtttccattcatttttatgcctaaaaaggtgtttatactgcaagaaacacattgctaaattggaatttaggctgtttttagaagatcatagattgctttttccttcttgcagtttctccttgcacaagctcagctacatcagttgaacaaaactttgtgttattttggggagaggagacatttatgatgtggatgatcattttaggtggatagctttttttttcttcttgatcttatccagcaattttatattagttcttgatggaccctttttaggtgactttttatactctgtttttcttgagtgaattctgatgaatgtttactccatttttgtgcatgttacatggctagaacttagcatatgcatgtcagtcaagagtaatggctattagttttgctattcccagcttggtagtcttattgttattttgaaatggagtcttgctctgtcacccaggctggggtgcagtggtgcgatctcagctcactgcaatctcttcctcctgggttcaagggattctcctgcctcagcctcctgagtagctgggattacaggcatgcgccaccacacccagctgcgatgacaggggcacaccaccatgcctggctaatttttgtatttttttttttatagagatggggttttgccatgttgcccaggctggtcttgaacttgttgtcttgagctacccatccaccttggcctcccaaagtgctgggattacaggtgtgagccactgcacccagctgacaatgtcttgaaattagtcaagggtcaaatttttgaggacctttaagatattgggtctactggtcagagcaagagacatatacatgaaatactgtttaaccaacctcagggaactcgcatggagtatgtgttttccttgattattagattattatgtcctgaagtaacttgaccaaagaataaatcctttattcttcagcaagaatcaagtctctcccatgccattgcaccttttctcctacagacacaaattcttagataacaaggtcatggaatcataagaagtggctggaaccttggaaaggaaccctcgaatcttcctctatcatcccccactactcctttatcaaccctttggctgtgtctagactgaattcataatatttcccagaatgtgcttttggctactagcaaattttggcatttcatatctttatgaaatcttttacatacaaagcctatgaaatatgcaagagtttatatctaaagtatctgttcggtgggagttggcgtgtcattgaatctcaggtgttaaaatacgtttttatatactccatgttggaatgatacaaagtttgttaactgagggaatgagttaaaatatgtaaattgaaatgttgcaaatatgctcataattgtaaaatttctttttgttatgattattaagcaggtggcagattgaaggataatattctggacattagaaaatatttgtagatagttgataaattttgcatagatatgtagaaattaaggtataatacttttttaaattgttctttcatttagcaacattttggggttactattttccaaggatttcagtaaatgtaggggattcaaagttgttgtatgtggcttctgtcatcaagaagcttacagttttgtgatttttttttttaatgcccaagaatctagttaatttttaaagtagctaatggatggtgtggaaaatgtgccctctattgttaatgatagaagtctttaaaagcactgatgtagtaaccccccctggggttcagggtccacttggtgtccctttgaagggtcatgattcagaagcccaggcctcttctccacacttctgactgattgttgaaggagtaagttttgctgtttgatgtcttctctccagttcttctttattgacttttcctctgtgtatagtatttgcaaaagagtagaaaacattctaaagcactgtgatttaacaagaggtacttggctgattttagctgaaggctcttgtcaggctcttgaggtcggatctagcctttcccaagttgctctctcctgttcgctactgcacagctgttactgagttggcatctagcctctcgagagcagccctgaaagtgaaatctggagctagtgttcagctgatggagtcacatggggatttatataacttctgatcttggcattaccaatcagcttctttgtcttggttagttttatggtttctgtaaaccatgggaatgtttctcaaagtggttcccagatattagcctcagttaatctgaatttgtggcacagttccttctgtcgtcactggcaagcacagttggagttggtggagtgaactgctttttgtctggttttccaaacagttggaaaagtttgtgtttgacaattgcaattgcaatactgattgacacccccagcagatgtgaggaaaacaaagttaagctgacttatataacccaagtaacaagtggtcaaaggcagtgatagatgccttctcttcatcttttatggagatactgtcccctcatcctttaaggctaggaacttggtcattaaaatagtttttagagcaaggtgtagggtgcagatgtggcatcatttaaatggacagatattaagttttactgtgtcgtgcatatgtatgttggaggttagcattgaaaacaagccttcatgttcagtgcatactcatattggatgacaacattgttctaaattgtgtgataaggatttttctcaaccctctagtcatcctgtcatattctgaaggaatatggtgcctctatgagcacatacttcttttccacagtacgcaatcgtccatgtatttttcaaaacaacagtaacaatagcaaaataccaaaaaacctcacttacaaattgggaagtgttattactaatgacaaatcaatggctttcattatcccagatctaagtaggaaaggaaagggtgcacctgccctgtttcagacacttgctagttcctgcattggctcacctctcctttgctcgtagcactcattgtgagaaagtagatcagtcaatagtactgagcttttcttggtttgaactctttttatttgcagtgttatcattaatttttttcttaggaagtaccaggaaaagataagaaatttatgaaaaatgcagatggggataaaatctatgtccaaagagttagaatagaggccaagaaatgataccaatctagagtttcaggatgaatattgacatagtaaaagtcctagacatttacaaatttgtcctgatattttattttgtagatgaggaaatttaggtttaggaaaattaaatgattgatacaaggttgtgcagatagttattggtagagaaagtctaaagctcttttcaatattaaaaataaataacaaaaaacatggaagtgagcaggcagcaaactgctgcagtttgctttgggcagtcagcaagagaaaaagaacttagattgagtgtaagcaatttaagatagagttttccataatggaaactcttaataatgggatggcgtgctttgagatatcatgttgaggaattatctacaatataagatatttttggtatggtcctttcctaaaaggtgggagggaaattgttggaggctctatccaaccattgacagagtatcctttgattagtagtgatacggttttgctctgtgtccccacccaaattttatttcaaactgtaatccctgtaatacccatatgtcaagggagggactggtaggtggattctcccatgctgttataatgatatgagtgagtgcccacaagatctgatagttttataagggtctcttccctctttgtgctctccctctctcctgccgccatgtaagacacacctgcttccccttccaccatgattgtaagtttccggaggcctccccagccatgctgaactgtgagtcaattaaacctcttacctttataaattacccagtctcagatatttctttatagtggtgtgagaaaagactaatacaagtagtatcctttgttagtagtatcctttgattaatagtatctgttatttactacagtgttccttgaggatcttatagttcagagaaggaaattattgatgaatataaatgaataataaaattctaagcctccaactgactgaatggacctcgctctaggccagaggacccaaagaaacctgaaaaactagttcatgctatgaaaagaagtggaattggacatgttccgttacactctcctccctttggaattcaggcacaattggccagcatacacattaaaacagaaatctgaagactgacaaaacacactgtagcaataagataccaaattcagacctgactctagtatagcatcacatgacagataacaggccctgaaagaaattgaagcatcttaccccaaaatatatttctttgacatattttgaaatggctctgcaaagctacctcttgtggggaaaatctacattttgtagagaatcccttacccactcctagtcttttccgaattgactaaggtttggcatctttttaggactaataagagacatttaccatctgttatctctgaaacttgctacctggaggcttcatctgcataataaaaaccttggtcttttcctttcccctctcctcctctcccctcccctttcctttttcctttccttttccctttccctttcccctttcctttcccctttcctttcctttcctttcctttcctttcctttcctttccaacagggttttattctgtcacccatgctggagtggcgcatcatggcttattgcagcctcgacctccagatgatcctcccatctcagcctcctgagtagcaggaccacaggtgtggtccacaccagtagctaccacacctggctaatttttgtatttttagtagtagagacagggatttcaccatgttgcccaggctggtcttgaactcttgggctcaagtgagtcttccttcctcagcctcccaaagtgctgggattacaggcgtgagccactgtgcccagcccttaactctttcaatcagaaaaatctttgagtccacctatgacctggaagtccccctcccccaacagcttcgagttgtccagcctttccagatcaaaccaaagtataccttacatgtattgattgaggtccttctgtaacttctgtccctctaaaatgtataaaatcaagctgtaacctgactaccttgaacacatgttctcaggacctcctggggctgtgtcatgggccttggttactcatatttggctcagagtaaacctctttaaatattttacagagcttgactctgctaacataataaagcactgataatcttaacatctcactttgtcctctggtcttggcctccttctccaccatgaagagccgtgatgaggactgtagcaccgtcaggcagactggtcgtactggagttctcttcttttgatctgtggctaaccaacacatccaggtcaataatagacctgtgggtcaccttagatctgtaagagatttgccatggacctttgcagttagtggcttgactttgttttgaattgcatagtgaaatattctctaacatatttactagcatttgtaagtagatcatttgtggaaaaatgacgataaaaggtacgaacccaattagtatgagttaggggcatccaggtgaatgattgttctataccagtcatcagcatcatacaccagtcggactctgttctcactcctctttcatgaagacattgagtgtgctcaggattagaaacaggagattttcccataaaattacatatattttaaacaattaaggcaaaaagttatgatgcaaaagctagggtgaacttttcccatctctatatatgcatatttatatatgtgtatatatttgctattattattccttttgaaaatgcttctgaacttatgcaggtggagtgcccaggcttttgaagcagggttgtttgtctggggtaatacccgaggcttgttgcctcacaccaaggcaatcaaagacacggacatggagtgaggttaagagcagaggtttaacaggcaacagaaagtgaaaagcgctctctcctgcagagagaggggcttccaagtgggtcttctggttccatggtgaaatgcacggggttttatagagtagcttgaggaggcggtgtctgattttcacagagcctaaaagattggttggaccaggtgtgccatttgcatagcacatgaagaagctggccgcctcaccctaatcttttattatgtagatgggttttctacctggcctgcatctccttgcctccttctttactgcacacgtggcaacaaagaaaagggaggagggagcctccatgttgaatatacctggctatctatgtttgcagcttgatttttcaggctgctttgtgttagaaaagaaataatttgggggctgctttttattaaaagggaaatcttaccgaggactctcttacctcacagcctaaataatttctttttagctcctgtatcactttgattatcatacagcagtgtgcttgaacaaggctcttaattttttcagcagtttctggactaggtagtgtataaaccaagagcacatctcactttttcatcaactgtttactctatcacgttgcaaggactctgagggatagttaagatttaaatattcccagcagggagggaagaagtttggataaaagaatatctttccctctctctctttctctcaggattttatcattagaaaagatcattttgctcgatcattaaaactgccattagtgcttaagcacaagagacacattcgtttaccatatatagtctgttgttttcctggtgttttaattccctagagcaaaaaagtatttgaattccaggtattttcagaagttttggcattctgcagatgtgaggttgccgtcgtctaaggcagctagtagccctcttttgccagaagagttataattattagggatatttggagttcatttcttgtccagcttttcaacactacataattctctaatgacacaattctggagcactgaatattccataatccctcaaaaaagtgaatccaaatataattctcattgtgacccttggtttatatagcccccaaacaccttttattaataaagaaatttactgaaactgttttatgcttaagtagaaaaacaaaggtgacacatttgaaatttatatactgttcatggtcctgtttctcactggcttagtggccttgagtaccatactataaaccaaacttattttcacaatgataaaatgagcgtgttctactagatgtcatataaattcctctttgtctttgaaattatgactaaatatttttattttatatttaaatataataagtcaagtgttgtattgccccctctataaaagccaaaaaaaaaaaaaaaaaaaaaaaacagtgggtcagacataccatgtagaggatgctcacattgtttgctaaattgggataaggatctttaagtttccttcctactccaagatttcatgtgaaaggtactttcttcccttaaattatcttatcattgttttcagttggttggttgcttaggatagaaaaacatttcattttatatataagtaaaaccatgaaaacagtaatgctacttttaacattatcatcatcttaagatgatatggcattttatatttttcaaagaacattcacaggtaacattttagatcaaatggaaataaggtcaaatgaataacatggtacatgtatatgccaaactgtaattgttagattcaaggatggtagcattttaggcagaagacaaatctctttaattagaaatgcaggctgctaagcacagccagtaatgaggagagaagagagaagtcacacaggacatagtttgaatgcagtgctcttctgtccagatcagttggtcatactgtaccaggctacggggttatactgattgtacatcagcatatctatggtgtcatccatgtatgaagcatccttaggttaaacatgttgaaacatgataaaacgtgtcttagaattaacgaaatgtaatatatctctagagctaattttggaagccaatgggcaacagtttggcatttgaattactcttggtcaggttaaatgcttcatattaaatattgttggtcactatatttaaatatctctaaatggagaatgtgatatagtgatatgtggaactatatctgtcacagggtaaatctcaaaattggggttcagcccaggaggccaagtgggttcttggcttcacgcaggaaagaattcaagagaggataacagagtaaagagaaagcaagtttattaagaaagtaaaggaataaaatggtggctactccataggcagagcagctccaagggctactggttggctagttttatggttatttcttgatcatatgctaaacaaggggtggattattcatgagttttccaggaagggagtgaggaatttccagaactgagggttccttccctttttagactatataggataacttccagacattgtcatggcctttgtaaactgtcatggtgctggtgggagtgcctttagcatgctgatgcattgtaactacgtataatgagtagtgaggatgaacagaggtcacttttgtcaccatcttgattctggctggtttcatctggctttggctggcttccttaccacatcctattgtattagcagggtcttgtgacctgtgtcttgggaaactagtcctacctcaataaatagttgaaaaggtggatagtagatagaaaggcataattttcttcttgactattttaaggatttgaagtcttcagagaaacaaagaaaaagaggaaaagtcctattactgctagatacactatagtgaatgaaaaagacttttttccagtatgcctaaacagtattttgatcactgttttttttgtttgtttgtttgtttgtttgtttgccaggtttggggcaataaaatcacatgtgaaaaatcctcagagatttttaaaaagtaggagagactttagaaatcatctagtataccttcttcacattactaaatagtaaacagattcagggaagtaaatgctgtatttagggggatatacctaagttattcacaaagctagccctagaacctcctagctcctagaccaggacaattttaggataactaaatgcaaggacagtagaaagcagaaagatgattttttaaaattcttctgaattttaagtcttgtgaagtagatacttttgagccataggatattatgtgacctaggagaaattagagaagatttttaccaactcagaaaggtttaatactcaggacgtgaatccttagcatagacattttcacgttactatgcactaagggcttgagaaaatatataacatgaatattcatgaaagtcacttcagcacaggtccctctgaaatttcctacagaaaatggccttctttcattgaaaaggttttaggcttacagctctgtgaattggaatttgaaagttgtcaatgctgtgttgatttactcgagttactgatgataggagccttttggtgtattggagctcttttggatgtacgtgcagaaacccaactgaaactgacgtaagccaaagtaaagaagtgatgtgttattgactcacataagtgaaaagtctggggtagggctcaagtatgactttttccagggttgcaaactctgccattataactggccccactgtttcttggcagtgtttccttcagtgttggcttcgtatgcaggcaggttttccccaggtgtttccaaaataactctccaactgctattttcccctgctgtcacaccaccacaccatcaacacaggagacttctgtgaccggggtcaggggaggggttccccatacaccaagcatgaaccctagctgagtgtcctcttccaattcagtttcacactatctacctggagatagtgtcagatcccacaggttgggggctcagtccccacaagcccccagtaaccctggacaccagtctctaatccaggctcccagaacttctaaccaactggctttgagttggggttcccatgaccccctgtttggatttaatttgctggatcagctcacggaactcaggaaaacacttatttacatttacgggcttattataaagactcctgcgaagggtacagatgaagagctgtgtagggtgaggtatgtgggaaggggtgcagagcttccatgccctccctgggcaccaccacccaggaacttccacatgttcagctatccagaagctcctcaaaccaggactcttgggtttttatggaagcttcttgatgttggcattcctttccccaggctatagcgtgggaccctatctggggagggtcttaaaaaccacagtcagaaaggttaggcaagattagagtcctgccttggggcaggtgaaaggagggaggagaagatcagagagattctgtttcttgaggcctgctcctggggcggaacacacccaacattataacaaaagacaataggagttatgagccaggaaccaatacatgttatggacaaaaaactatacatatatatttatcataacattataacacaatgtggcaagaaggtcaccagccgctccagtcacacattatgccagctgtgagataggcagagagagctcctccttcctcagtttcattactggtatttattctccttgcaccatcctgggtcatgtccctaggaagatgggaggtatcggtcactggtacagaggtgtgagaggtgcgtgatcacctttatccaaatcaattgaactgacagtctggagagtggatggctccctctgaagaggaatatcaaggtgtctcaccaacagggccagtgtccatagggctgtccaaacaacacatagcttcttccttttgcttagatgtcaccgtttaaggatgttcgtgcacaaggtagtatttagaaatttagaaaataaatcatctttccacattcagtgcatctttgcttccagtctgattttgatacgggagttcagaagaaagtacctgggcagatagtgagggtaggggcatcctcggtaagattttccttttaatgtaaagcagcccccaaatggcatgttcagaatggcggctccatctgcccttctctctatcagtcacgtgtagagtaaggagcagagaagatggtgtccttagagtggaaagtctatttgcataataagattagggtggggtggccagccttctctgcaagctatgtaaaggtcactcctgatggaaccaatgtgttggccctacataaatcagacaccacctcctcaagctgaaatataaaatccagctcatccatcccagccggccttttcctctcggaatcccgtctctatcactagagagggagctcttttcctttctctttctttctctttcttttgcctattaaacctcctctcctaaactcctcctgtatgtctgtgtcctgaattttcttggcgcgagacaatgagccccgggtatttaccccagacaacgtaccgcttgaattttactagtccagtggaggctcccattgtcaaagccctttatagcaaagctcttaaagtgtgtttatttcctaaagtccaaggattcattgtcttattttaaaactaatgtttaatcactcactgtttttatgctttatcagcacttgttaaagataatttggcttgaggccaagagttccagaccagcctgagcaatatagtgagacgctgtctctaaaaaataaaaaaaaaatactaaaattagctgggtgtggtggtgcatgcctgtagtctcagctgcttgggagactgaggcaggaggatcccttgagcccaggagtttgagactgcagtgaactatgatagtgtcactggactccagcctgtgtgacagagggaagctctgtctttggaaaaaaaaaaaaagagatagctaagatagcttgtatttgtactctgatcagcctctttggaagcccttgtagttctgtttgaatgcctctctttggagcttgggcatggcatggcttaccacattgagcaatggcatgagaccatttctatgtaggcttctaaagggaaacatgctcctgttaatgtggaaataaattcagctgtaagtttatgtttgtcagggcccaggaagagtaagaatacagggtgagaacgcgtagggaaatgctcatttccattaaagcatataaatagagggaggttagagctgtcaaaaacaaatcctccccacatttagactgttaatataaattaagaagttgtcaaccgtgtatcaaggtggaaggaaagactcaacaaagataatgttgggaaagggccatgttgattacagaggatttatagactaattttgatttaggaaatgtattatatcaacaattgctgaacattttctttaattctagaagcaaaagcaactttaatctgaagtcactttatgcctgcttgttttgatctgttttttctttttatttttttgagacagagtctcgttctgttgcccaggctggagtgtggtggcacaatctcggctcattgtaacctctgcctcccaggttgcagtgattctcctgtctcagcctcccaagtagctggcattacaggttcccaccactacacccaactaatttttgtatttttagtagaaatggggtttccccatgttgacctggctggtctcgaactcctgaccttgtgatctgcccgccttggcctcccaaagtgctgggattacaggcgtgagccaccacacctggctgatctgttttctttccttttctttttatttttttgagacagagtcttgctctttcgcccgagctggagtgcggtggcacaatcttggctcactgtaacttccacctcctgggttccagcgattctcctgcctcagcctcccaagtagctgggattacaggtgcatgccaccaagcccggctaatttttgtatttttagtagagacagaatttccccatgtttaccaggctggtctcgaactcctgacctcaggtgatctgccagccttggcttcccaaagtgctgagattacaggcgtgagccaccgtgcctggactgttttctttcttttctcggttgttttgtcctgtctctgccaacagcattattgaattagctgggggttgccagtgcttcctttccctttcccatttcttttcatggggtcttgctatgttgcctcaaactcctgggctcaagcaatcctcctgcttcagcctcccgagtagctaggactacaggcatgcacaactgcacctggctttgtgttattcttttttagagaggtatattcttcactttgttggatgccaattttgtttatgaaacatttgaattcccaagtaaccttggtacttttacttattttaaaagtaattgaatcttcctctcctttcatatatttttggcctgattttttgcagcatttgctttcttattatatttgattggaattttgctcagaaataagatttgtttctgatgatttatttttggatgatttgattccatctataggattacatgacttaataactactagcatataaattcactcatgaaatagagaacctaaaacatttgattgtcaattttagtggaagatgcatacaaagtttcgtctcagttaccaccttatttcttgtggtcctacatattattttgcgagtggctattgctattaactgaaagataactttttgaatttttattttgtctagtagtagcactagtataaatattactgtcatctgcttctcattttaatttgaaagaaaacatcttttaatgattcctgccttataaaccctataatgattttctttcctaatttttctatgagactgcttgagaaggacggagaaggaaaagctctcgacactgtgaaatagcttactggaagagtaagcatttaagctcgtgcaaaaataattgtttctttaaaaactgccttttcgctacagctacacttttcttgtcatttccttttgctctccagttttaaattacacagactttcgtagagtgcccactctccctttctcacctattcattgtggaaagattcctgtcagggctaatctttaataagagaggcagttacagtaactatagggcgaagaagggaacagtaaaagttgagcccactcagatgtcatggacctgaaaggtgctggtgggttggaagcttcattatgctcagctgctacaagagatttcctctttttagattgattaagaaaaggggctcagatgacaggttaataggctgcccctcaccagccattgtggctcatccaggagtgggcacaccatgggaagaacacacaaaagagaaacattttgcagaacaaagaccactccaggagtattgaggtaccaggaggaaggtggaatagaaccttgtggcaatgaaggaaagaaaaaaatcattgttttaagagggagatctgctgctggctctgctggaagaaagtagagtccaggatatcttaggtgagtcttaaaactgaaaagtaacactgtaattgacaatagggagagggtgaggaaagatccagagtttctgtccatgctggtacctcaactacaaaacaggaggcttaagggttttcgcagaatctgagtagaagtgatacaaaaatgatacattggccgggcacggtggcttatgcctataatcccagcactttgggaggccaaggtgggcagatcacgaggtcagaagtttgagcccagcctgggtaacatggtgaaaccctgtctctactaaaaatacaaaaatgagccgggtgtggtggtgcactcctgtaatcccagctactcaggaggctgaggcaggagaattgcttaaaccacggaggcagaggttgcagtgagccgagatcacaccactgcactccagccttgacaatagagcaagactccaccccccgcaaccccgcccccccccccccccccaaaaatgatgatgtatcatttgaaaaaaaaatccattggtttcaaaggagaaatactgctttgggttgtgcattagttgctatttgactaagtcatgttttgctaaaagtatcttcaacatgaactctggggttattttcttgttttttatttcccctcatcagtcatcacccagagattcccaggctggaaattccttctttctttattcatatgaaatttagtttttgcttataatatagacttcacactgtttccttcttagaagaggatgttttaatgtaactgggtataagctgtattgaggcatgtaaaacaatgaaggaaggaacccatttttatgatgaagagacaggaaaatagagttgtgacactaccttagtactgagaggttttttaaagatctagtttggatttttgaaagacatacacagatgactagacattgaatgaatgtacatttttttttttttttttttgagatggagttttgctcttgtttcccaggctagagtgcaatggcgtgatctcagctcaccacaacctctgcctcccaggttcaagcaattctccaacctcagcctcctgagtagctgggattacaggcatgcgccaccacgtccggctaatgttttttgtagttttagtagagacggggtttctccatgtcagtgaggctggtcttgaactcccaatctcaggtgattcacctgcctcggcctcccaaagtgctgggattataggcgtgagccattgcgcccggccgaacaaatgtactcttagacatttttttaatctttagattgagcatctttggatatcagataccagctgagtttaaataactagtttccattactagatgaaattttgatgagaacctttagaaggttagtaatttctttgtccaacccaaatgtagtttttatattactcatagtaaatgccattttacattttccttcaagatttgtcttgcttaacagtgctgtctgtcttccatgagtcatactgacccagtacaaggtcctcgtgggtgatcagatctcaccaaaattggtttctgatgctgctgaaactgcatatgaccttgttcatgacctctggtgctactccaagtagcttggatatggatattagtattagtaactatattatggtacttcatagtttacaaagggctttcatatattttacttactttgatctttatggtaattatttgatatagttaaggagcaagtgtagattttttattttttaataaatgagataattgaatctcattgaagtggattattccaaggttgaccatctagaaagtgagagatttgatatttttaactcaagtgttttgactcctagttcagagttctttccactctagcattggcctcaaaatatcaagccctaagaaattctgttagttgcttcctttatttttgtgctttggctagagttttattggttttatttttaaatttgcatctttttactcactcattcaatcatcaaacactcactgaacatctgttatattccagggatgatgatacacacaggtgcagcaagaataagacatgaggctcattcttgcagagtacagtctaagaaagagagagtcaaaagcaagcaatgtgatgagggttgtgaagcgtggtcccagtgaggaaattcatcagtctactcttcgatttacagagtggtttacactttgatcctgtagaaatgcattttttaggcaacttagaacggtctttcttaatatgcctcaggtagtaatgggatggactaatctgtgtgaaggtaaactgaatggcagattgggaatagctctacaggactgtgttacatttaacagctggggagacgggcacactgctcccagcgtggctcttgccttccacgcactgccctggcatcctgatcttttttgtcttagacctgtgttaacacagacactatcatgatcagttatctgctggttccctctaagtggtctctaagtgctttgagtgcccttgttgccaacatttttagaatactcaactcagcatgtccaacttgttcacatgctagtagtgcattttatcttctcagccattcttcttcttccattttctatggtaataccatgcatttccttggtattttagagcttaaagatagtctctcatttaaagggatatcgtccaatgtttaagtcttgtcctcgtgtctaatctcaagtgtgtcctggcagtcctccctttactaaggcagttccctgtctcgtattcctcaaagcccgtcttcccttcccattctcagctgatttcactgagaaaacagaagcagttggaagagaacttatacatcctttcacccgccaaactcccagccactttacctttgctcctatctgaagccaccacctccacctgtgctttgatcccaggtggagatacacctatcccatctcttgcccaaatcactaacttcttatttgatcttttcaggattatttccatcagcatgtaaacatgtgatcatatcttcttaccgtccctcaagtgtatcaaaaacactgttgttggaactttctcctagctagcctatgattttctctctcacaaattcagattatgttagcagagggatcttccctgtatagcccatttaaaatatcaactcccattattgctctgtcctaccctactttattttctttataccaattccccaacagatgtgtgtgtgtgtgtgtgtgtgtgtgtgtgtgtgtatgcatatagatacattgtctctccctattttatttctacaaagacaggagttttgtctgtttcgatctttcctttccatagtgcccaaaatagtgcctgaaatgtcacagacagccccagatatttacttttttgactccatatcgtcttcagctactataccatttctttgctcacctttgtaaaacaagtcaagagttgtctgtacctgctgctctgctgcttctcttctcattcattcttaagtcccctccattctggatctcttccccacagctccactgaaatggcccttgaccagaccaccagtgaacaccacgttgccaaatgtaatggcaattctaaactgccttctcactcaacttccaggtagcattctacctggttgactattttttctctttgtaatctgtttagatcggttggcccctgactttctttctaccttagaggtcattctttataattagcctttgttgaattcctcccctctttccaacctcataatgttggtgtgcaccagggttcacttttagatcgtcctgtctttagttacctattcattcccttagtgatctcagctggtatcatgtctttatatatgttcttcacagggatgagtcctaaatatttatcttcagccatgacatttttcttgaattccagatttgcatatccaactgccaacttgatatctcacttggaagaacatcatcacaaacctaactcatctgaagttggcttcacattctcctcccctatcactaactgcctttcccacagtattccccatttcggtacatggtaccaccatttatccagttgttcagacctaaacccttctaattattctttttcctatcgttatcccacatcagcaaatcctgtcaattccatttttaaaaaaaatatatctggattctgaccttttcccggcacttccacaggtcacaccctaatagaagccaccatcgtcttttgcttggctacggtaacaacctctcatgcccctagcatggcttcctgagtggttcttttagagtgggaatgagtcatgtccttcctctgcttgcaactctctgtggctcccaaggtacttggaccaaactccaaagcccttctcagtcctccgtggccctctgggtctaccctgcctggtctctgcactcatttcctcctactcaactcagcccaccagcccatttgttcttcctggagccgactgagacatttcctactgcagagcttttgtgttggctgctctttcctgcctggaatattccacaggctcactcccagctttatgcagttcttggattagtgtcccctcatcagagaggtcatttacgaccatcctgtaatatatccaccttgatccttcagccctgtcgttagaattcctggcttttatcacgagctgacattacattttgtaactattcatttacttgtttatcaatctcctcccaagtgtaagctccatgggtgtaagaaattgttctgtctcattcacagtcttatgtgttgaatgaatgaatttaatttttacaaaaatagaaatgaggaagtaacaagtattcgtagtcttttatattctggtaattgtttcctgggtactttgttaaaattatattttgattaatcccttgtgacaatcctctaaggtggagatttcagagaggaaaaacattgcaatcccagtgactagtaaaaggaaagctagagagctgggatgcaaaccctgggtgtgtctattgcaaaagcaaatctctttccacttaatccatattctttatttattataaattataaaataatggttgggcacagtggctcatgcctgtaatcctagcactttgggaggccaaggtgggtggatcctttgaggtcaggagttcgagaccagcctggccaacattatgaaactccatctctactaaaaatacaaaaatgagccgggcgtggtggtacacgcctgtaatcccagatactcgggaggctgaggcagcagaatcgcttgtacccggagagggagattgcagggagctgagatcgtgccactgcactgcagcctgggcaacagagcgagactccgtctcaaaaaaaaaaaaaaaaaacaacaacaaaaagtgaaatagtaagtatacagtggatattacaaattattattatattattatttctgtctaatagatgagatcactgaggatgaagtgacaggtgagttacctggggtcatgccactagaccccaccactcatgctggaaaaaggacttcagaacctggttctgatttggcttcagtgggctctttttgtacaaccacaagatttctgcaatgcagatactttgtgtatctcactttatctgagcaacttttacgttttccatccattatattttaccccttgtaaactggcagaggctcacatttgtaagttaaacaccaagcttttcaaaacctagtcctaaaacttgtatcatgattttgcttcatgtgcaagctaacctttgatttctcttcacagtacctgtgtaaactgaatgaaaacagcagttgaactgaaatttgctgttttgcttgtacttactttctcctctgccaatgtacaacctaacttttatcaggaatagtttattgctcaggtatagtttgctggttcatccgttcattttcaggctggagaaaagccttcagctgaaatatctaccaattgcaagaaaagtgaggtaatttacggaaagtctacaaaaatagggagtcatggtgcctggtacaccagatgataatcaacatgttaattaaagaattatgtttataattagcctgaaagaagataatttaataggttggccaattacagagataaattggaggctgaaattgcaaacttatatttcactgtgtttttcaaaagcacatctatgaactgatagataaatgttatgtccatacacacagagctatgaaacccttctataaacatgaaattggggagatacatgtcaaaacatatcccagaaacaagattaaaattacttctgtgaataatgctataccatgccccatgtttttgctgaaaactcattggtgtttattctcctatgatggtatactaaatatctgtccagattactgttattttttttatttagtcttgagaatttgccctgtgtttgtgcaatacaagaaaaaatacacttgctgaaggtcattgtgttgtgcaatacaagaaagaaccatgtcttcaaaatcaccttatcttgaaataatagattttggatagagagatttaggtcttgaaaattgcttctaaaattacttctccatcttttcttgtgcagtatttggagcttatgcaataaaccagtcttttcagtatctctctttaaaatgtgatattttcagtgtccttacttaacatggaataatcgtacacagtggttttcttttcagaattttaacatggtttgtacaatctgagtctggtataggtctttgagaatgtctaccacttgtttattgtggtctcattctttagagaggaggaggatggttttcagcattctaaaatatgcaagcaacggacaccaatctgttatgtgtactctatacatatatttatacttacacatgggtctcatctgctctaaatatttaagcgtggtatgaataaatacatttaatgtttcatagacacataatatctcacagtttgtagaacagacaatgctctctggtgtaattaccaggctgatcctaaggggccagcctgtctggcacttgctttcatctctgaatactttatgcttatggataaaccaggtgacaaggagatgccttggagtgctaaattctgcatgtctcaatgtttgattttaactctttatgtgctaatgggaacactcattttctttaacagccatttctttgggcctgttctactttaggtatgagaggctcaggaaaactttcttatcctcagcacacacattatgatgaagtttaaccagagtcttgataagtgagcaatcttcaatgccaactgggaaattcagatcattcacaactgggaacataggcatagatttgattcatgctattttttaagtggaaaagagaaacaggtgcatttttgttgatgttactgtttggtgaatgtatctgtcgatgttaatctcatctcacatgaaacagacactgaatttgaatgtctgaaatatgtccagtctttttagatctgatatttttactcatatgccaactttcttatgataattgtcaaattaaatgctaaattctgatagctgcttccattggtggattccacatagatgacatctatatccaagccattttaggctcttcacttctttttatctttttctaaaagttaaaacatttcaggaccttacttagtttaggggatttataacataggaacaaaaaaatttcctttgcctcctggtttctgggaatctgtctttctttctttgcttagtatttatcaagaagtatagtttgccatcactacatattagatgacattcatgagggcagtttcaatttttttcacacattttgaaatcaaatttcactagacaatagatgggatctatcacgatactgaaatggattttccatgtgatcatatgggcacattgatcctgactatatcagttcttctgtgattggcactcgattgattgcaggattgtatctgcatccacaaattatttgtgtgatgttctagttgtgctgcttgctataccagtgtgtgtgtgtgtgtgtgtgtgtgtgtgtgtgtgagtttagcttttctttagtaatttcacagctctactattctatggcctgccaagggggacacaggagtgtggcagagggagaagtcagccaggtgatttggagtttattccctgacagtctttagaattgccttttgatgtggtttggctgtgtcgccacccaaatctcatcttgaattgtagctcccataattcccacatgttgtgggagggactcagtgggagataattgaatcataggggcagtttcccccatactgttatggtggtagtgaataaatctcatgaaatctgatgattttataaggggaaacccatgtcgcttgtctcacattttctcttgcctgccgccgtgtaagatgtgcctttcgccttctgccatgattgggaggcctccctagccacatggaactgtgagtccattaaacctctttttctttataaattactcagtctctggtatgtctttatcagcagcgtgagaatagactaatacagtaagttggtaccaggagtgtgagaacagactaatacacctgtgtatggtgattatagaaaggaaaccaaattttcatcagtagattaccatttcaaagctccctacaaagtcatcaccttcttgcctgcatctggggctggctgtgcccttgactccttcaccttccttggttctctgctgctcctcttaattattccgtttcctggattttagggtaacatggaaacttgtgaaagcggtaattgaagaggaagacactctgctggcttctgagccaataactttgttttatcaagtactttaatgaattccaaaggatatggcagatgttaatacattcattcttcctaaaatagcccaaaaaagtaggcttaactctagtatttttccatctctaaaatgcaaagtgagaacggtcgctttctcatcttctgtgctgatctccctcttccactctacttttttctcctttaccaaaaatttgagtgactttacttgaggctgcccttccttagtctaaattttaattacctattcatgatatagccaaccttctctttctcacctcaccattgcatcccactcctccattcaaaccaatttgcttggcattttctgtaaatttgtttttcatgtggttttgttgtcattgacactattcagggtgcatacgataagtctagagtctattcactttagctgtagcctactatctaaagatatttgggaaatcacaggactgtactttgtcttttaatgcagtgatttgatatcattgtaggagacaatatagtcttgaggctaggagcatagattttggaattgtgtgggcccagatttgtctcattcgaccacctgcgcatccatgagcaaatggcttactcttacaatggctctttctgctcatctgtagggtaaccataataatagtaatagtaattaactcatagagctcttcatttcttagccattgaccgtcgcttctgtgccagatgctgtgctatatgataggtataagttgataaataaaactaacatgaacctccctttgctatttcattgagataatgcatagtacctgggagtagatgcttaatgatacacctaggaaggaggtagttctagaatgtaatcaatggtagcttctttcccttttaaaggtatagaaagtatcattcattctttattctccaaatagaggactgaatatctactatgtgctgggtaccagggatgcggtatgaacgaggtcggcagagtctttcttcatgcagtgtgcgtgcttctgttccagaagacagtgagcaaggaaacagttgagtaaactaagcagttatagagtgtgatgcatgttatgaaggaactggagagataatggtgggaaggaaggtagggtgagaaggagaggagagggctaataaggtaagaccttaaaaatgggacagagcaggttttgcaaagatctggaggaagaacaagcaaagaccttgaggtagaaaagggctttgtggccaggcacagtagctcacgcctgtaatcccagcactttgggaggccaaggcgggcagatcacctgaggtcaagagttcgagaccagcctggccaacatggtgaaaccctgtctctactaaaaatacaaaaaaagattagccaggtgtggtggcaggtgcctgtaatcccagctactcgagaggctgaggcaggagaatcccttgaacccaggaggtcgaggttgcagtgagccgagatcgtgccattgcactccagcctgggtgacaaaagtaagactccatctaaaaaaaaaaaaaaaaagaaagaaaaagaaaaaaagaaaagggctttgcacatctgaggagcaaaatagcggtatgtgtggttggattgtagcaagcagagtggagaatgacgtgagaaggtgttatagatggaggaggaagtagatcatgcaatatgtctgatggactgtgagaagctgacttcctctatggccagagtgatgtcagggcaggtaacaggactacaggcagtcaggaggaggaagtcatcaggatgctgcctgggaatctggcattcattactgtttgcttgacagtgccacttatcaagataaggaactatgggggatggcaaaatttggggtaatagacctattaaaatgtgatcattattggtggctattcatgaaataaaggcatatctatatattcttttatgtacctcttggtttctgtgacatttaagaaaagtgttcaagactttctttgaagatggctcaagtttttatttttgctgcttcttagttggcaggaactaaaagtccaggtcactaaagattgctgatggcttgtgaggacagccctgagtgagactgaatcagttggttgacaacagactgtgacagaatgctaaggcgttaatttagagtttattggtgcagtatacctgctcagcactgatggatttcctgatttagtgtattaaagatgaaaaagtaaagttcctttctgatagaagtgtttatttctactaaactgggactagaaaagcattgatgaaagtttatatattcagagcaacattctgccttctgccttctgcttggccagctgccatctctgactgatggaaataaagtgagggctctgacatcatcttgatggtgtctggtatttgggtgtttctgtccagctccctttggctgacattaccaaggcacactgttaatactggcctcacaggccataatctcttatgtgtcattttgtatttaaacttttgcataagagtcatcagcacagaacaacagattacttctgtagctatattatttttgagatagaaaagatactactggaccaggcatggtagctcacacctgtaatcccagcactttgggaggccaaggcgggaggatcacctgaagtcaggagttcaacaccagtctggctaacatgatgaaactctctctctactacaaatacaaaaattagccaggcatggtgctgtgcgcctgtaatctcagctactcaggaggctgagacaggagaatcgcttgaacctaggaggcagaggttgcagtgagtgagtcacaccactgcactccagcctgggcaacagagtgagactccagcctgggcaacagagctctagaccatttaaaaaaaaaaaaaaaaaagagagactaccgtcaccttgtataaaaccacacacacagcataaatagttaagcctactaatgaaatatcctgtcatttcctctacttaatagaaggctacagataggcttatacagtaaacatgtgaaaggtacagttgacttctctgcttgaatttgcacatggggggaattcgttctcttcttttgcccttttcacagaaccgtaaaatgtgaggactgaaggcaccttggaggatgcccagttcatccactggtggggaactgaagactagacagttacacggtagttcaaatgcaatcatatcactgcaattaaaactatgagaagactagattattctgtaatatcaccacattaggaatatgaatcactgtcaaatagcagatgcacatcatatggatatgattgatgtgatcacatcacttcttttagagtctgtggatgactggtcactgtgtattggtttttagttcatgcatacaaggcaaagtgtgtagtgttgttaccttcttgttccccagtgatccaagatttacaaaaaatgaataagtggaaattggctaacagatgaaagtacatcaaagaaacaaaaagtgataacattgggaactggaattccaattgaacataaaggagttctaaaaggatgacctggctatggaaggatgacagtcctgccctttgactgcctgtaaatacgcacccagaggaacttagtgaaagtgagcttattgacgtgtgcaaggaaaatggttctgacccataggatgtaggtgttccagagtaaatgacaccaggtgaaaaacttcacattaaagaaccctcagagatatttcagcacgttgaaagcacaaaggagaaaattcccgaaggtgattcaaatgtaggagcatgacaatttgtccagggatagcaaagatgcttattccactgggacagttatattgtgggatgagtgaaggcaggtcacaagtgttttacaaaggaataaaacactttgatggggtgccgtgggtcacacctgtaatcccagcactttgggagaccaaggtgggcagatcgcttaagtccaggagttctagaccagcctgggcaacatggtgagaccctgtctctacaaaaataaaataaaataaataaaacacgttaattctcaatgtttccagtcttctaaattatagtgtactaagtacatttagttttattatttagaaaatgttgtctatacatttataaatcatagggagtttgtcatgtttggacaaaaattcttaaaggtcatggaacaatgataaacaatgtgaattttcccaaagcttgtctgaagacatttttatggtcctgtactagcatgcaaactgaggactgcctgtattttaaatgaataaatatagactgagtgaaagtccaaaaatattggcttcttttatttggaattatctcagcttattctgttaactacttatttgctttaacaaaaacaaaaaaatagcatagataacattttatttgtctgtatgacataaatgtcaaaagcaatgatgggataaatgagatcaacttgtaagcacttatcaccatgcctgcaacataactggaacttgataaatgcaacgcatatctagaatttgatcatttctctctacttccactgctaccattctgttttgagccaccatctccctccctgaatggttgcagtgaccccccttgggtaactgcttcttccttgcctttctacactctacatttagtacatgacccagtggctgcccatttcccccagtaaaatccaaaggtcttacactgacatcaaggctttccatggtctgggcccattatctctgacctcatctcccacccacttcccctagcctagtctgctctagctgtgaattttctgacgatgctaagtccatgctttcctgcctagagggctttcaccagctttccctctccctggattgctccccctccactggtgctcactccaccgggacggttatattgtgggacgagtgaaggcaggtcacaagtgttttacaaagaaataaaacactttggtggggtgccgtgggtcacacctgtaatcccagcactttgggaggccgaggtgggcagatcacttaagcccaggagttctagaccagcctgggcaacatggcgagaccctgtctccacatcgtcatttgatcaatttctcattcctccttaaagtctttgctcaaaagtcaccccctcaatgaggccctggcaattctgttcaaaacctcaacttcccccaggctagtagcatctccgatccccttatactattcttttttttctttccatagaacttttcaccttctaagattttcagatttttagtttattttttaaaatttgtcctcttctcttgctagaatgcaagcctaatgagttcggggatcttttgtttattaggcaatttagctcttataatatttcctagcatgtattgcatctgagtgaatatcttttaaatgatgaatgactatttgaaaggaactgttgatgttgtttgagaattgttctccattctgtactgttccagcagacttggcaacagtgattgtagaaatcatgtcttatttactcatcacaaaattgtcagaatccagtactccagttctggcctttcttccataaatattagatctctgttctaaagagtttttttttttttttttttttttttttatgatggagtttcactcttgtcgcccaggccagagtgcaatggcactctcttggctcactgcaacctccgcctcccaggttcaagtgattctcctgccttagcctcctgagtagctgggattacaggcacacaccagcatgcccagctaattttttctatttttagtagagatggggtttcaccatgttggccaggctggtcccaaaatcctggcctcagttgatccacccgcctcggcctcccaaagtgctgagattataggcatgagccactgcacctggccaagagttttatagtcacaggaaatacagaaaggaattcaattcaacatatattgactgaacattttctatgtacagttgtctaaaatggataattagtaacttaggttttcactaaagcatttattttcattaagccactggtttccgtggagtttaagctgatgtgctggagagataaccacaggataagatacatatagtgagctttctgagttgatgctaattatggaaaaattctcaggacataacttagaggaccagttacacaaagcctaaacctggaaaaaaatctcggaagactggaggagtaagagtttagggaaaatacttggcatgatgtgagagattttttttttaatgactagagttattaagactatttattgagttttcaagagtataatatatgactgattcgtttagattatgtacacaaagagcattgttttacttaaaataggggaaaaagaagggactgcattgctttttttcagtgatgcattgggttttatattgaggctgtggatgcttatgatacattaaaatttgtcacagcaataatagacaggatcggtaattttcctccaatattgccctatttcctggctgcatgaaaccatgaaatcacttaatgggatcatacaataccagctttgattggaaattaaataagatcttaccttggcagttctaaaaagagactccatctgtcagcatggcagcatgtatttatgaataatcttaaggtggattgtgataagcaatcacttattgagttcataacatttgcaggcacagtgttagacaatagagatgtactggtgagcaaaccagaccttgttcctgctctcacacagatcctaatgctattggaacccatagaaatggacagaattgggtctaagtaactgcaaagaagtgatttctgtctgcaagtaacatcactgtcatggtttatgaattctgttccttgttattaaatatcaaccaggaaactgatgtgaaagtggcatggggagatactaaataaaatgcgtaggctcacccttgagtgcttcaagatgtttgtatgggaggaatggagtatcttttgtttgattcttatttgttgtaatggaaaggcagaagcccctctaaataccacccccttgctgggatcaaattggattagaggtcatctatgtatctatttaatagatattttttgattgagtgcttcctgtgagccagcattcttacaggctttggtgatcaccattagtaaaagtgacaaggtcctttcccttacagaacttgcattctagtgggggaggctcagaaaaatttaaaaaaagcaaatagcatataatatagtgtcaggtagtgataataaaggggaaaaaataagagaagggactcagggtgataggggctgctattttagatagggcgaccgtggaagtggttttctgtgtgtgtgacctcacaggtttgtgagcagcagtcaagctaactttgctcagaattactaaatgtacaaacacacatgcacatgcacacacacacacacacacacacacaggtgcatacacataggctttcccataattcacccctcaacatgtccccattatatccccctcttccactgtcgccacccctgctatccctaagctttgggctttctctgtctcctgctttctacatctcctgattctttgaaggttttctattttctttctcttgttctgggattagccggtgtacagtctggccaagtgtgaggtccctaggcatccctgaatgccttatctactttctttgctaactaaggcttgtatatatctgcattgtagctacagttccttatttggccaatcctcagtatgatgatttggggaaggcaacatttcttcactattgagaaagatctcatgttgagctttgtttttgaactgcaatgtccaaagtgggcaattcaatgaaagggtagtgctgatttagtggtattaacttattacaaattttgggcattgtttgttcttatccattcattcaactactattgattgaggcccttttatatacctgacattatgctagatactggggctataattctaggtaaaaacagactcagtttattttttattattattattatttttttttttttgagacggagtcttgctcttgtcacccaggatggagtgtagtggcgtgatctcggctcactgcaacctccatctcccgggttcaagcaattctcctgcctcagcgtcccaagtagctgggattacaggtacccaccaccatgcctggttaatttttgtatttttttttttagtagagatggggtttcaccatgttggccaggctggtctcaaactcctgacctcaggtgatccacctgcctcggcctcccaaagtgctgggatgtgagccattgtgcctggcccagactcagtttaataatcagacattaataattacacaaatgaatgcatgataacaattgaagaaactaaaagagaaaatacaatgttatgggagcacaaaacaaaagaattaatagcctggtgggtccaatctcaacacagccttgaaaggatgcctgggttgagatttgaaagatgggtaagtattaactagagaagagagaaaggggtttaatagtgcatgcgaaagtcctgtaggagaaaaggcatgaaggaaggttggttggagatattgggctggtgccagaccatgcagtgcagagccttgtaggctgaaggatttttttgattgtttgtttgttttttgagcgggatcttgctcagttgcccaagctggagcacagtagcacaatctcggatcactgcaacctctgcctcccgggttcaagagattctcctgcctcagcctcccaagtagctgggactacatgtgcacactaccacacccggctaatttttgtatttttagtagagatggggtttcaccatgttggccaggctggtctcgatctcctgacctcaagtgatccacccgcctgggcctcccaaagtgctgggattacaggtgtgagctaccgcgcctggcctgctcaaggattttttggcttttatctttagagcaattggaaaccattgaagggttttaagccagcatgccgtatagtacagattgatggtgtggcctcaagctaaagctccttggaagggagtgtgcagtgtggagaaccattcagtggattttgaagatgtcaaaatgagagataattgtagcttggactaaggtggtgagaaattgatggattggaaaagtgttgatggagtagaatccacaggacttggtaactccaaggtggatgtcacccttttgttaagtccttccatttatctgattgctcttgaggtttcttttaagtggttgattatttattatttcatccagaatttgtataaagaaagatcaataaatttgtttcttcatgtttgtttagtaaagggtgagtatttaagggtgctttcagtgcttctgggccaaggtgaaaaaaatgatggtcatcatgtgcatttcagcactcagaaacactattggcacaggcaaccaaaatgcaaaagcaagacatatgaattacaagtctgcacctcagcggctgaatagcaaagactaattcggaagaggccttatgacccaggaagacatactttaattaatatctttattgtcctgtcaggtaggttaaccctctggatcccatcagtatttggcagtgttggtctttattcttggaatagaaactagattgtgtgtgtgtgtgtgtgtgtgtacatgtatgtgtgagcatgtgtgcatgtacacaatatcctcatgtgcatttcatatatatgttacctaccagatgtattacatatggataatcataaatagaaaacattaagctatttatcaaaacctctcaaatgcctactctgcatgctgtcagaccacagtgattctggagaggaagtgtgctctgagatgaatgatggggttaattaaaggcaactggaaggtggcttgtgaattggtgtttggttcattaaatgttcagtatattttactttctgtccaaaaggaaccttttgattactggaaagtaaaatagaagcagctcctgggcaaactggcaaaagctttgatgagtatgtcagattaggttgtatcattcaaagttgaaccacgattgaaagctgtagctatagcctctctccttggtggtatagcagagctctcctgaactgaaccatgattgaaagctgtagctatagcctctctccttggtagtatagcagagctctcctgaactgaaccatgattgaaagctgtagctatagcctctctccttggtggtatagtggagctctcctgaacttaatgttgcttcattaccatgcactccatcatacaatgttaagggactggattgaagtgaaactttgcgtaagtgagttggtctcatacattggataggatagcttaatatagtatttaaatccattcctttcccttagatgattggtacatctcacatactgatgggcatctccacacgagctctaatttctgatttgtccaaagtgcacaggcttattttaatatttgactgttaaagattgtcttcaaactcctataggtttcctatatcatatatcaaaaagatactcatatctggctgggcgcagtggcccacgcctgtaatcctggcgctttgggaggccgaggtgggtggattgcctgagctcaggagttcgagactagcctgggcaacatagtgagaccctgtctctactaagaatacaaaaaatgagcagggcatggtagcgcttgcctatagtcccagctacttgagaagctgaagcaggagaatcacttgaacccaggaggtggaggtggcagtgagctgggatcgtgcaactgcactccagcctgggtagcagactgagactctgcctcaagaaaagaaaaaagagaagagaagagaagaaaagaaactcgtatatttcttaggatccatatattttctgggtccctttctgggccctagatcctcatctaacaagctctcaagtgtggctcatattgagagcttcttagaaatgcacaatcagccccactcaagactttcccaatcagaatctgcaccttagcaggatccatgggcgataggatgcaccttacagatagagaagcactttaacatacatggtaaaatcaattgagtctctagaagcagtgtgggatgggattacagactgaattatctgaatctaattcagatgaattaggtttagtgatcaatttctggaaatatgtctgataagccctctgtgagtaacaagttactttatgtctcattttcctcatctagatatgtgtgggtcctctttataccacaggggtagagtgaggattaaataagttaatgccaggatgggcattcactgtacttttggtaaagacggtgtgccttctcttcttccggggcttactgagtaagctctgttactcccacttgtcccatatatctgtggttttgtttttacctcatcttgctgtcttctcttattctcattcccaaactgtctttagttagttattaataatgtattaaattgtatttagatagcctctagcatccaaaagagtaagagtgtagttacttacccaagagtgtagtttgcatgttagagttagttccatagggtaggtgagacaaaatagtaaaagcctctggggatttgataaggcattgaacacaccagcacaatttttggttctttttttattacaccacaatatagctttgatcttgcagattatataagctccaaagtacttcatgattgtttttattatagccacactgcacatgaatttatattcagatatacccatcctatgggaataatgctatttttttagcagattattttttaaagcaaacaaatgaatgttcactggaaatcagtgagcacctggagggtcagttaggaggtggttgttaaaaatattgggctttgcctgtggctggtgctataagctacgctattaaatattggtgctaccatataggaaataaaggcaaatacagccgggtgcggtggctcacacctgtaatcccagcactttgggaggccgaggcgggcggatcacgaggtcaggagattgagaccatcctgaccaacatggtgaaaccccatctctattaaaaatacaaaaattagctgggtgtggtggtgggtgcctgtaatcccagctactcgggaggctgagccaggagaatggcttgaacccaggaggcagaggttacagtgagccaagatcatgccactgcactccagcctggtgacagaggaagactcttgtctcaaaaaaaaaaaaaaaaaaaaaaaaaaggaaataaaggcaaataaaagcattaccaggattttaaatacaaattagagtggcacctttccaatttatatagcatattctttttttttttttttgtgagacagagtttcgctcttgttgcccaggctggagcgcaatggcacgatctcagctcactgcaacctccgcctcccaggttaaagcaattctcctgcctcagcctcctgagtagctgggattacaggcatgtgccaccacgcccagctaatttttgtatttttggtagagacagggtttctgcatgttggtcaggctggtctcgaactcccaacctcaggtgagccgcctgcctcggcctcccaaagtgctgggattataggtgtgagccaccgcgcccggccatatagcatattctttaggttagctaaaaataaaaaaaaaaacaacttgccgtctgcttttgagtctttattcccatcacctctgccctgccatactaccttggtgaagggcttctagaatatacttgtgtgtcctttttctctctaattagaatggttgatgattatattgctcttttactactctgttatgttttcttttgtttccttgaggttgagatgtcaaaacacgtaaatggtcagactttttaggcccttgccacgtagaacctgtgttttccattttcttactgtgcatttggtgccttttgtatgctagtcattatgtaaggtgctttatcggatttacttcgtcattttagaaattcagtactttgcctcagatcatataacctagtacatggtgagctgggatgggaatccagatcttgcttgtcctaaagtccgtgattcctgcagcactcccactgcctgtattgagtcattctaattttcgtctttccccatgtacagtttcttcagtaaccttgcttaatgaattgattggaaacctgttttggctttcagaggactgaaataaattgtctctccatacatttttaagcaacccaggatcctttctgatatgatcaagcaactaatgcttggttgaactaagatgacttttaccatcactttgaagtgagaaagttctgttattgacctgttttcctgtgtgagttttgaaatgacatgtgtgcctgctattagaatctgttccgttcttgatgatacttggtgtcctagaaatgtgtcagacaatttcttgttaattttgatgactaaaatagtgacgataatatgaaaatcctgtattttacttttatttgttcaggttgcctctggggatcagtcagtacagtcagaaaactactgattgccttgaatggccgtagctcccctcttttcccctactcagttgcctttttgcaaataaaaagtacgtgagggattgattccgtaggggtttcttttggttgtttttttgacagtagtttttacattcggcacagatttttaaaatgcactaaaataatgttcttcaagatatgatttggactgtgcagtcatgtcacgtctcacttatttttccctctctttctccccctttgcaggatgatgaagtggttctgcagtgcaccgcaaccatccacaaagaacaacagaagctatgcttggcagcagaaggatttggcaacagactttgtttcttggagtccacttccaattccaaggtgggatgaagtctttcaaggctattcaaatatgcaagttttactagtggcattgaagttatttatgagctctctactattttctgtggaatacatactatataaatgaaagggatataacaatgttttccatctccattttgctgatttttaattgagtctctcctgggtacaaagaactagggataagattattagcaagaacacagaaagtccttgccccatgaggtttatattctagtagaaaagcaaacaagtaaatcagtgatataatttgaaaactgataagggctaggaagatttaatggattattaagtttgtaaaggaaccaatagtcttaggctcattgtatttttttataagatagactttcaattttccatattaacgaaaagtcaaaactctaaatcccagttcatgtttaaaatacgtaaacctgggtctagatgcagttcacatagatatatctggatttgactttcattggtagaaaatgggatatggcttttttttttcctcaaagtgttatctcttgcattgatcataaagggcaaaggacagaaagattgttggtagtaagtagtcagatactgtaaattatagatatactctttgaaatgagcccagcaatatcttaagctacagaattttaaaatcaaaggcagaactaactttttgagacaatcgctccgaggatatttattcttttaggctgatctttgcctaaaagagaatggttcataatatcagcatagattttcttgcagaaatataaacacttaattctgttgatatgttttgattaattattcctgattcctaattgtggatatttactgtatgttctgtatatgaatgaattttcatctgtgtctctatatttcagaaattagaagttgaggttttgcttttaggaactattcactttgagacagacctaccttgttattattaaaaattcagggagaaatgaagccttatcaaaaaggcatagtttttcatctctttgaatctccacatgcaaccagaaagagctatgaagagggtaaaactcacagccacagacaatacagtatctaagacaaactaagtggcaagttattcctacgtatggtgtcagtaaatgtataggaggaagtgcaagagaggtgacatgatttctattgtctctgaaagtcagtgacaaatccttgctggaaagcctggtgggccaatgtgaaaacagtaaccactccaggcacggtgtctcatgcctgtagtcccagcactttgggatccaaggcaggcggatcacttgaggtcaggagttcaagaccggtctggccaacatagtgaaaccctgtctctattaaaaatacaaaaattagctgggtgtggtaatgcacacctgtaatcccagctacttgggaggctgaggcacaagaatcccttaaacccaggaagcgaagattgcagtgagccaagatcgcaccactgcactccagcctgggtgacagagcaagattctgtcaaaaagaaaagaaaaagaaagagaactaagaggaagcaaaggaaccatggcatagtgaggtgagacgtttctggagtaaccttggccctatggacttttatagctaactatgtaaaactcccttacaggtcaaagtcctcctctgaggagaaattgcaggggcgatagaggcaaaggatagagaaggatcgaaccaaaaaaaaaatagaggggggaagcagaacccatagatttcataagaggccatgtttcaagtagtggggagaaccacagaacaaggagctctagagctgtaaagctgaaaaaaaggctacactctctcttctccctaagagtataagaaaaagcatttcaatttttgtctggacatttgatgtgcttgtgttgcctgtagacattataattttataatatatataattatgtataatttatatatattagtggagtaatctaatttatataattataattatgcttaatatataatttatatgtgtatatattgttttatatataaaaagagaataagaagcagaataatatctaaaggtaataaaggtcaactagttaaataaacataactatttaaaaatgaactaaaagaaattaaaaaaataagagacactatgaaagagcaacatacattcttaactcagaaacaagatgagtagagaacagagatttggaaaagggagctgaataacaggccagaattccaaattaaagaaaaactaattttagacctggagactgcatgagaagggacaccagagcacgtaaacccacagcttaacatctgtagagatatagaagatggaaaagtgaaaacctttgaaaatccaaaggaaatgattttatggaagacgattttcccatgaaccggggctggagggtgttttggggatgattcaagcacattacatttattgtgcactttatttctattattattacattgtaatatataataaattctagaactcaccataatgtacaatcagtgggagccctgagcttgttttcctgctactagatggctatatctgggggtgacagtgacagatcgtcaggcattagattctcataagagggtgtgcaacctagatcccttgcatgtgcagttcacaatagggtttgcactcctgtgagaatctaatgctgctgatgatctcacaggacgcagagctcaggtggccagtgagggggagcagctgtacatacagatgaagcttgcctgctgctcacttccggctctgtggcctggttcctaaggggccactgactggcactgatccatggcccaggggttggggacccctgccccaagaaaaccaaattgcagtacagactgtggcacgaggaatggtggtgagcattcaagacacatttccccaaggaactgagatggaatgatggttttaggggagagtgtcttatggaatggctctgtcctctgacaaggttaagtaagtatgactaccaaaaatgggagagtgggtatagtttataaaaattcaacttcctgattgctttatagatgtagtctaaaagtaaatataactttcaccagagataaataatatattagctatttgcaatattggtcatagaactaagaaatagtaatcaaaaagagaaggtcttaagaatattatttaaaaatatgagtgttagggaagcccaaacttcctaaacaaaagagatatataaaaatatatttatatattgtatattttatgaacatatgtatattataaatgatataataaacataacaaaacatacaagtattataaaatatatattatatatttatattatataacgcatatattaaatatatttatattataaattaatgtacattcatgtttattaagaaatacatatatattttatattatatataatatttataatatattataaatatacctttatattatatatatttaatgtagatatatgataatgtagatatatatgatatgtaggtattacatatgataactatatatttctatttaaatataaaaatgcatatttaatgtacatattatatatgatatgtatatcctatgtatatgtgtatatatgtatcacgtatatacatatgacacagctgtatgccacataccacatatatgacagtggtcccataagatcataatggagctgaaaaattcctattgcctagtgatgtctggatgatttcaatcttgtgtaggcctacaatgatgtgaatttgagtcttagtttttaacaaaaaagtttaaaaagtaaaaaaaaattaaaaaataggaaagaggtgtctagaacaaagatataaagaaaatattttcatacagctgtgtttgtattttaagctaagtgttattacaaaaataaaaaagctaacaaaattaaagtttataaagtaaaaagttacaataagctaaggttaatttatcattgaacaaagaaaattttaaaaataaatttagtgcagcctaagtgtacagcgtttataaagtttgcagtagggtagtgtcctaggccttcacattcacccaccactcactcactgactcaccagagtaacttccggtcgtgcaagctccatttattgtaaggtgtcctatataggtgtaccgttttttaccttttatatcacatttttactgtactttttctattttgagatatgtttatataaacagataccactgtgttacagttgcctccagtattcagtatagtcatgtgttgtacaggtttgtagcctaggagtaataggctataccgtacatacctaggtgtataggaggctgtaccatttaggtttgtattacatacactccatgatgtacacataatgataagatcacctgatgacacatttctagcatgtgtccccatcattaagtgatgcatgtctgtatatatatatcatccatgggtgatgcacacacacacatacacgcacacacacacacacacacatacacaccgcacacataaaatgttttaaataaaaggaaaattttcattttaaataaaaatgaaattatatatttatagtattttttaattaaaatatgcattttaacaatctaggagaattgaggccaaagtgtattgattatataaacaattataagtgagtttgacttacctattaaaataagaacttaaaattataagcatgactacaaagccaaatctaacactatgtatacaaaaacaaaggcattcagaaagggaaaaataaaaggatagacaaggatataccaagaaatgcaaacaaaaagaaagcagatgtctttatctcattatttgacaaggcataatttagactaaaaaactttgagacaaagaaggattttttttttatcatgccaaagggtacatttctcaatgaagacaaagtagtttcatggccccaataacagatacaacttttacaaagtagaaacctcagaagttgcaaagagaaacgtagaaacataccaataataagagacgtaacacacttcaacttgaaaaaaataagtacaatgcttagcataatcaataaggttgaccttatagagatatgtcaaaatctgaacctcaaaaatagaatatacctttctttaaagttcacataccatattaaagaatattgacaatattttaggccacaaagaaaacttcagtaagttccaaagaataggaataatacaaatataactataaagaaactagaagttaattttttaaaaagcaaaaacaaaatcagccccctaaaaaataaaaaccacacaaaagacttttctatctgaaaattaaaatgtacactattaattaaatcttgggtcaaaggcaaaataaaattgaagagtttcttgaacatcatgataatgaacatgtgatgttttagaatgcatgggatatagctaaagaagttatcagaataaaatctatagcattaaatgcatatattcgtattttattttatttttttttgagatggagtctcgctctgttgcccaggttggagcgtggtagcacgaactcggctaactgaaacgtccacctcctgcattcaagcaattctcctttctcagcctcccgagttgctgagattacaggcacccaccaccatgcctggctaatttttgtatttttagtagagacggggttttgccatgttggccaggctggtctagaacgcctgacctcaggtggtctgcctgctttggcctcccaaagtgctgagattacaagcgtgagccaccacgcctggcctcagtgcatatattattaaaaatgaaaatttaaatcaatgaattaaacaaccagatgaaaactgggagaagaacaacaaagcaaaataaagcaacaaaatggtattaataaagataagaaagaaattgctgagttaattctgaaaattggtcctttgaaaaaaatcatcaacatagacaaaccatgaattagcctaatcaaggataaagggagtacaaatatttgattattagaagttacatatgagttggaaggggataatgatcacaaaaggaaattaagtcataagggaccatttgtctaactacatacaagtgaactttaaaatcttcatgaaatgaataatttcaagaaaataaaaatttaccacattaagttcaaacagaccaattatcataaaataaatagtgtggtagaagtattccctgacaagacacgcgccaaggtcggatactccctacttaactatgttccttaaattattccaaagcataataaaagaaggaaaagtttcaaatttattttgtcaagtaaatgtaatttaaatttcaaaattaagaaaaaattttttgcaaaggtaatttatagatcgatttcagttttattgatacagaaattttctgagataaaatattttaaataaaccaatgttgcattaaaatctttatcatgaccagtgaaggttattccaggaatccaagaatagctcaatacgataaatcaattaatataattcttcatattaggaaagataaggagaaaaatcctttgaacttactcatagggaaaaggcactgaacaaaatttaaattctatttatgtttaaaaaataataaaatacctccttaacattattttataagcgcatgtgcacacacacgcttcagttcaaaatcagcactttctttaaggtagtacactagcagttaaagtcaggtgtaagttaaggatgtccagcatgccctctgcaatacatgcctgtgttggaggtatgagccaatgtgattagacactgaagatcagacatggagaggtaaaactatttctagatgtagatgatttgattatatacctaaaattcccaaaaattaatcagtggaaaagctgctataggagtggattgatgagagaaatccataatgtagcaggttataaaatcaatggccacataacctggcaacatagcgagaccctgtgtctctacaaaactaaaaaattaggcgaggtttggtctctaaagaccagaccctgtctctacaaaaatttaaaaattagctgggtctggtggcatgtgcctgtggtcccagctactcaggaggctgaggcaggaggattgcttgagcctaacagtttgaggctgcagtgagccgagatcgtaccactgcattgcagcctaggtgacagagtgagaccctgtctcaaaataagtaactaaataaacaaacaaaaaataatagccttaggccaactgttcacaaatataaagtcattaagccttaacactatgtttatttgctatttttgataatattactaatgtatttattatgtttttatcatgtatacatgtgctaataaattaatttcctatatgtgtgttacatcagtaaatttttgaggatcatagatttgaagtgctgtttctgtttttctttgtggatttttttgttattgttgttttgtttttttgagtcaggatctggctgttttgcccaggctagagtgaagttgcatgatcttggctcactgtagtatctgcctcctgggctcaagcagtcttcccacctcagccttccaggtatctacgactacaggcacacactactatgcccagctaatttttgtattttttttttttttttttttttttttgtagagatagggtttcactgtgttgcccaggctggtctcaaagtcctgggctcaagcgatcttccttcctcagcctcccaaagtgctgagattacagctgtcagccaccgtacctgcctgggaatttttttaaagctcaaattggataagagggttataggaatatattcatctatcatatagaaaagaatatgtgctcagtcccaggaaatagaaaatatattaccttatttatactgttttaattaatgctttttaaaatctgattaactctgggagatagtaggatagaataaaatgatttctgagtaggagataagtgaatataatttgtactcctgagagctggtgttaaatttttgcaacccagttttactcatgggcagacctttttaaaaggaaacacccacagtctgtatgaatttgattctcgtgtggatagtatagacttaagcactgaacatggtctgagcaggtttgctttgctgcttaccagcgattatagtggaaaatcctactcctggatatagcagctctgtaataatagccactgtcaggacttattagggaattgctcttcgtttctccttttcatttataatcactttataatcagtaaaatatttgattaagtggaataactgccagttaaactaatgttcctttgataatatttgggttattctagggttttaagttgaattagatcaagaaacaattcataattggtgttcagtggttacagtcagtatatttaatatacgagcagattttaaataaatgctatatgtttttttcatagagcagaataactttaatccactgaaatggatcagactagtttgagtttcctcttcaaggactgaggatgtttaaacaatgatcataagaaaagcgggctaaataaaactgcctttacacttttctgaaggattgctatagtatttggcttgacagtttcactggggactaatttatttggcttttcatgttcatgacagggtgcagtttataataataagcaatggttaacacaaatcattttataagactctctatactgctgagtctcaccttgttcagatgatctaaaactcatgacaataagtacttaaaaaataattaatatctaattttatactaaattaaattctgatgattgcaccactgtactccagcctaggcaacagagtgagactctgtctcaatcaataaatcattaaatcaattaattaaatctcaaattctactggattattaagcagtgatagtttttaagtgtttgagaatgattattatagaaatttttaattgagcaaaaagttttgcaaaactgggaaagattttagcatcgttacacaaggttgaacctcatgcaacaccaggatttcataggagcacagttttatacagatgaggaccattgttttatgcagatgtgacaattgaatcaatagtcatgcagtgctgcccctacaaaagggacattcattaaaaaacagtaaaagccattcttatttaattatctcactgcttcaagcatagttttctggtattcatcatcgtggactctggatagaggcagtaagaggatctttgagatctgttgcatccaatatttcaattattctgtatttctgagactgatacacattcacagtatgtatgaaacagtattgttgatttttatcaggtttccaaaaaggaagctgggccttgtagatgtaacaatatcaagagctctttctgtttcttccaatttctatggcgtcactttaattaaaagtatttcttctcataatggaacatgatagagcaatactttatattcggtgacttctcattattcaccagcataaataatgcattaagatattaatgatgcataatagttgtgatattccagatgaactgatcttcttattcaagtgagaatttttgaataataaaaatgtcggtataagataaatgctagatgatgtaagaaagattcacttcatatatagtttatgaaccatcttaaacagcagatacttgtttcttgacgatttctctaaaaattaattgaaataataaaacaattataaggaaataaatattaacattattgctgtttcttctctctactttattcattttgactttcacagaattttgtttgtgcaaatgagaggcaaaagaaagaccactgttttgtaaagaatataaattatcaataactatatttttcaatattcttatgtttcagttatataatatttatttcccaatatttttagagaaaaataaagtagatggtaagtgtggcagaaaggaaatatcctaatattttgtgactatcttgtcaatgtagaataagtgattagatacttgaacagagttccgatagaacagaagagttgaaagaaaatatttaacagttttcttggcagattgttgaattggacctgaatggaactgcttgttaaattgtgattcataagttatgtggaaataattcttcttactggttttttttttttttgttttctgagatggagtctcactctgtctcccgggctggagtgcagtggtgcaatctcggctcactgcaacctccaccttctaggttcaagtgattctcctgcctcagcctcctgagtagctgggattacaggcacgcaccaccacacctggctaatttttgtatttttagtagaaatggggtttcaccatgttggccaagctggtctcgaactcctgaccttaggtgatccgcctgcctcagcctcccaaagtgctgggatttcaggcatgagccaccacgcctggcctctttttagtatttttaacatgcatttatgctggtatccagttaaggtagagtggtgacacaaagggcaaagatgacataattgaaattcccaaaatagaaggcattttatggaatacttgaattacatacctaattttatactaaattaaactccagtgaggaatacaacatcagtgtcttgccttatgatgccttacgccttatgatgtgaactaaagactcattctggaaatttttaaaagattttaaagaattctcattgtagtcataggtgagctcctaatttcccattatgtttctcataagatgtagaaaatgaagcaacatgaaaacttaggaaaacactgatgtctaagagatctccattaattataaggcagatgaaacttgttggaaaaaacctacctggagttcacctcttgcacacagtttcatctcaaacactgcaaaaagattggcagatattttaatccacctaacctgtcagcttcagccaaagggggctgtgcttacaaagtgcgtagccagtttttgttccttccttctgctctgctgcatcccgtcagtgcagactccccccagatggtgcaggcattggtaggcagtaagctggtgatgacccattctgttctggaagccttagttctcacaaatacaatgctgagggcttattgcaaacaggaacagcactggtggaagtacagaatagggattgtggttttgatgatggtgtatccattgtaataacagagaacagaactaagggtaggggaaggagaagctgttaattcagatggtcagagctgaattaagtgaatgtttgtgaaaaactgaaaactacacttggagtatatactgcagagggcccgctgccaccgttagaaccctggtaacagagtatatactacagagtgcctgctgccactgttagaaccctggttatagagtatatactgcagagtgcccgctgccactgttagaagcctggctataaagtatatactgcagaaagtatatactttctgaatctaagagtatgatttagccatcactggagtgaacacactgcagcaaatgaagctctaacacagaagttggcgcatttttttttttttctgtatagagccagatgggaaatattttagttttgtgggtcagatgttttctattcagcttggacattgcagtgtgaaagtggccgtggaccatatgtaaacagatgaacatggctgtgttccaaaaaacctgtacttacgggcactgaaaattcaatttcatattttcatgtgccataaaatatttttttctttttcttgcaattttttttcaactgttgaaaaatgtgcaagccattcttaactcttgggctgtgatttggtccatggccatgatgtgcttagcccagctctaacatatggaaagtattatattgctaaagggaaagctagacaaataaaatgggagcaactgtcagagatatgatagaggcaaagtttgctgccaataggttagatgcacttgccctcctaaagctgggaaggagaatacttatgtcaggagctactggtgaagttttatgaaagtatagggatggcatttgagtgggactccttgacagatggtacttaagttaatgaatgtttttgatgtttgaaaggatgagagaataaatgggtaaaatacgaatatagctcaatagagtgtgatatagaaggaagcatttcataaggagaatgagaacaaaggcatagagaagaagcatttgttggtggctgggaactcccaagtgttctgctgaggggtaaagtcaggtttcaaatgccatgtaaccagcacaactttatttgaaagatgaagggagcttctgaaagctttctaacagtggattgcattatttcacctgttgccacttgccaatttgcacacttagacatgcataaacaaccctggaggtataaacctccagttgggttttaataaaagatgacatgcctttggatatactctgttctcgctcttcctggaagacccttgcgcgttcttcacctgaaggaagtctcttcattgtttaggtatctgtcaaatgttttttcctttgtaaagtcttcctgtgtttacaatgcatctccctcctttatgacaaataattctgttttctttcttgcttgcctgtctacctggttgctttctatttccttctcttcctctctttctcattcacttgatcgctttttctctttttcttcctccctcccacgctcctctctttcaagcaaaattaattcctcctttgactgcgtaacttgctgctaactcatgtgtccctttacatttactttggcgtttctcaaattatgaaagcacctgcaggcagagacagcctctcagtcatcttgtatctcaggtacataatacagttttgaaggaagtagagcctcaataaatgtgcattgatttttgactggatttccttatttaggctaataatattgatgtatccattttggcagtttatcagttcatttgactttttatatcctactgtactctccaaagaatacacagccactgtcttcctgtttcaaggaatttaatgttttcaaggttgctggagtaaatattcatatttgttactataataatgcttaatcctatatagattgataatggtcttggtatagtacatttgtagtaatatttaatttactacttggtatcaatttctttttttccgtaagttactggagtacaggtggtatttggttacatgagtaagttctttagtggtgatttgtgagattttggggcacccatcacctgagcagtatacactgcaccatatttgttgtcttttatccctcatcctccttccactcttcccctgaagttcccaaagtcatatcattcttatgcctttgcatcctcatagcttagctcccacatatcagtgaggacatacgatgtttggttttccataactaagttacttcacttagaataatagtctccaatctggccaggcgtggtggctcacgcctgtaatcccagcactttgggaggccgaggcgggtggatcacctaaggtagggagttcgagaccagcctggccaacatggagaaaccccatctctactaaaaatacaaatcagccgggcgtggtcgcgggcacctgtaatcccagctacttgggaggctgagtaatgagaattgcttgaactgggaggcggacgttgcagtgagtcgagattgcgccactgcactcctgcctgggcgacaacagtgagactccatctcaaaaaaaaaaaaaaatagtgtccagtctcatccaggtcactgcaaatgctgttaattcattcctttttatggctgcatagtaatccactatatatacatatatataatatataaaatatatataaaatatatataatatatgtattgtgtgtatatatatagtgtgtgtatatatatattccaccatatatatacacacacacccacacacagacccacacacacatacacaccacagtatgtagtatatatgtatagtgtgtgtatatatatatatattccaccatatatatatatatatgtacacacacacacacccataaacacccccccacacacacagcacagtttctttatccacttgttgaagatgggcatttttttattattattattattttctgcagctattgtaaaaggggtcgagttcttgatttgattctctgcttggttgctgttggtgtatagaagagctactgatttgtgtacattgatcttgtatccagaaactttgcttaattctttttatcagttctaggagttttctggaggagtccttagggttttcaaggtaaacgatcatgtcatccgcaaacagtgaaagtctgacttcctctttactgatttggatgccctttatttcttcctcttgtctgattggtctggctaggacttccagtactatgttgaagaggagtggtgcaggtgggcatccctgtcttgttccagttctcagatggaatgctttcaacttttccccattcagtattatgttggctgagggtttgtcttagatggcttttattacattaaggtatgtcccttgtatgctgattttgctgagttttaatcataaagtgatgctagattttgtcgaatgctttttctgcatctattgagatgatcatgtgatttttgtttttaattctgtttatatggtatatcacatttattgacttgcatatattaaaccatccctgcatccctggtatgaaacccactttatcatggtagattatctttttgatatgttgttggattcagttagtattttgttgaggattttagcatctatgttcatcaaggatatcagtctgtagttttcttttttgggtatgtcctttcctggttttggtattagggtgatactggcttcatagaatgaattagggagggttccttctttctctatcttgtagaatagtatcaaaaatatgggtaccaattcttctttgaatgtctggtagaattcggcagtgaatctgtctggtcctggacatttttgttgttggtaatttttaaattaccatttcaatctcactgcttgttattggtctgttcagggtatctaactcctcctgatttaagctaggagggttgtatttttccaggaattcatctgtctcttctaggttttctagtttatgtgtgtaaagatgttcatagcagccttgaatgatcttttgtatttcagtggtgtcagttgtaatatttcccgttttgtttcttaatgaggttatttggagtttctctcttcttttcttcattgatcttgccaatggtctatcaattttagttatcttttcaaagaaccagctttttgttttatcttttgtatttcttttctttcaatttcatttagttctgctctgatcttggttatttctttcttctgctgggtttgggtttggtttgtttttgtttctctagttccttgaggtgtgtccttagagtgtcagtttgtactctttcaatatttttgatatagacatttagggctatgaacttccctcttagcaccacctttgcagtatttcagaggttttgatagcttgtgtcattattgttgtctggttcaaataattttttgattttcatcttggtttcgtttttgacccaatgctcattcaggagcaggttatttaatttccatgtatttgcatggttttgaaggttccttttggagttgatttccagttttatgccactgtggtctgagggattgcttgatataatttcagttttcttaaatttattgagccttgttttatgccctatcatatggtctatcttggagaaagttccatgcgcttttaatagaatgcagttgttggatgaaatgctccgtatatatctgttaagtccatttcttccaatgtgtagtttaaatccattctttactttttgtctcctttaactgttgttgctttaaaatttgttttgtctgatataagaatagctacccgtacttgtttttggtgtacatttgcatgaaatgcctttttccacccctttactttaagtttatgtgagtccttatgtattgggtgagtttcctgaaggcagcagatggctggtgagttcttatccattctgtggttctatatcttttgagtggagcatttaggccatttacattcaatgttagtattgaaatgtgaggtacccttgcattcatccagccctttgttgcctgtgtacttcattttttaaatatgtttttgctttttaacttgtatttttgttttataggtcctgtgtgatttatgctttaaagaggttctgttttgatgtgtttccaggatttgtttcaagattctgagctccttttagcagttcttgtagtggtggcttggtgatggtgaattctctcagcatttgtttgtctgaaaaagactgtatctttccttcatatatgatgcttagttttgctggatacaaaattctaggctgtttgaggaggctgaagatacggccccagtcgcttctggcttgtagggtttcttctgagaaatctgctgttaatctgataggttttcctttataggctacctggtgcttctgtctcacagctcttaagattatttccttcatcttaactttggataacctgaggacaatgtgcttaggtgaagatctttttgagatgaatttcccaggtgatctttatgcttctgtatttggatgtctacgtctctagcaaggccagggaagttttcctcaattattccccaaatatgttttccaaggttttagatttctcctcttcctcaggaacactgattattcttaggtttggttgtttaacataatcccagacttcttggaggctttgttcatattttcttactcttttttctttgtctttgttggactggcttaattcgaagaccttgtcttcaaggtctgaatttctttcttctacttgttcaattctattgctgagactttccagagcatttcacatttctaaaagtgcatccaaggttttctgaatttttgattgttttttctttaagctatctaattccttgaatatttctcccttcacttcttgtatcattttttgtatttccttgcacggggctttgcctttctctggtccctccttgattagcttaataactaacctcctgaattcgttgtcaggtaaatcagggatttcttcttggtttggagccattggtggtgaactaatgtgatttttgtggagtggtgaagagccttgttttgtcatattaccaggtttggttttctggttccgtctcatttgggtaggctctgtcagagggagggtctagggctgaaggctgttgttcagattcttttgtcccacgaggtgttcccttgatgtagtactttcccccttttcttatggatgtggcttcctgtcagctgaatcacagtgattgttgtctgtctgctggatctagccacctggtgagtctacccagatccaggctggtactgggggttgtctgcacagagtcccatgatgtgaaccttctatgagtctctcagctgtggatacaagtgtctgtcctggtgcaggtggtgcgagtgtgcaatggactccataagggttctttgctttggtggctgaatgctctacttttgtgctagttggctgcctgccaggaaatggcactttccagagagcatcagctctggtagtattgggaggaactggcggtgggcagggccctagagctcccaagattatatgtcctttgtcttctgctaccagggtggataggggaggaccatcaggtaggggagggctaggcacgtttgagctcagactgtccttgggtgggtcctgctgcagctgctctcgggggtgggggtgagatacctaggttactggagttgtgtacctaggaggattatggctgcctctgctgagtcatgcaggttgtcagggaagtgggggaaagccagtagtcacaggcctcacccagctcccacgcaaacagaagggccagtcgtactcccactgtgccccccaacaacagccctgagtctgtttccaggcggagggtgtgatgggtttgaacacttaccccagggtacctgccttccagctgcaaaataaaagggcttggttcctcccctgcctatggagtctggacactagatttgcaccctcccctgagttctggccaggaggcctctcaccccattcaaattgttacaaaggccagctagagatttccttctgcctgtggagttttaccccgtgctcctctcccattggatccctgtggtgccaggcaggtatggggtgcttggggacccagcgagctcccagggcctttctgctgcttcctttaccccctgtatgttgctcagctctccaaattgactcagctccaggtaaagttgtaaacttttcacgcaaacagaccttcggcttctccagtgggggtgtatatttgggagaggagggccgccctttcctacttccatggttggggcactcacagttttaggggggtctcccgggtcctgcaggagcagtccgcttccttcagaggctctgtggatcctctcgggattgctggtttgttcttgcagctgatctgggtctaaaattaacaatgcgagcccccacatactgctctgtctagagctgcaatctagtcctgcctcccatccaccatgatgatcctctactagtttgtattagtcctttctcatgctgctaataaagacctgagactggataatttataaaggaaagatgtttaattgactcacagttccacagggctggggaggcctcaggaaacttagaatcatagcagaaggggacgcaaacacgtccttcttcacatgatggcagcaaggagaagtgctgtgcaaagagggaaaaggaccttaacaaatcatcagatctcatgagaactcactcagtatcacaagaacagcagcatgggggtaaccatcaccatgattcaattacctcccactgggtccctcccatgacatgtgggaattatgggaactacaatttaagatgagatttgggtggggacacagccaaaccatatcatactttatataaaggatacatttttgtaagcatgcttatacataattaaaaaattcagatactttacagaaaaatcattaaaatcgataaataattattgataaatttggtacagaaggaaatgctaagattttttgtcagcataactttctgatactttggcataaaactattttagttgcacatgttttttccagtaggtaatacagaacttaaaattatatttcaatgcaaatggtggtcactttggaaaacagtttgtcagttccttataaaattcagcatgagtttacaatacaacatagtggcctactcatggttatttacccaagagttatttgtccctgtttctacccagagtcttgtactcgtatgtttggggcagttttactcacaatagcctaaaactggaaatgaaatgaccaaaagtgtcatcaactgataaagggatactatgtggtaacaaaaagaatgaactattaatctgtgcaacaacatggatgcaacgcaaaatctttaaggaaagtgacagatgcagggcactaaagactgtataccaaatgattccatgtatatgaaatgatagaaagggaaagctagagtgactaaaagcagatgagtggttggcaagggctggaggaagtaggtgggaatttactgcagagacttgcaaatgtttttattccataaaatagatggaagtgtcctattttgtgattgtggtgatgattagatgattgtagaaaagtgttaaaactcatcaagttgtatacttataagtggtaaatttcattgcatgtaaattatgcctcaataaagctgattttaaagtccccaaaagcacaaactacaaagcaaaataaagatgtatttggctaaattaaaattaaagacttctgaatatcagcaaataccatagtatgtaaagcaaacaaataaaacagagcaacataaaaacagcactaccaccaacaacgaaaatacaaacctcagattgggagaagatattttcaacatgtaaatataagtggataaaattttactatcaaaaattataaagatttcctagcaatcaataagaaagaaagaatatccaagtaggaaaatgttcaatatgtttgaagaaatatttcacggaaaagagaactcagatggcttccaaatattttaaaagatgttgaagattattagttataaggaatgcacaaattaaagctgcattcaaattcttgtgcatgaaattggcaaaagcttttgagtttgacaatggaaaatggtgacaaagatatgaaccaataaaaattctcatgcatttctgttagaagcgtaaattgatactgcctctttaaaaagcaaggtgattatacctactaatgtttaagaaggtcataattgggacccagcaaattcaatccaagaaatatacctggcctaggccaactcttgcacttgggctcatgaaaacatgcacatacgtattcatgtcaatgttattttttgtaatggcaaaaacaagcagaagatcactatacatctatcagaagagtgaaaatccaaaactcagacaacaaccaatgctggtggggatgtggagcaacaggaactctcattcattcttgatgggaatgcaaatggaacagccactttggagaacagtttggcagttattttcatagctaaacatacttttactgtacaatccagcaatcacagtccttggtatttacccaaatgagtaaaagcttatgtccccacaaacacctgcacatagatgtttatagaaccttgtttataaaaattgccaaaatgtgaaagcaaccaagatgtccatcagtaggtgaacaaataaactggtgcatccagacaatgggatattattcagtgataaaaagaaatgagctatcaatccgtgaaaagacatggaggaaccttaaatgcatgtcactaagtgaaagaagccaatctgaaaaaggctacataatacgacattctggaacagtcaaatctctggagacagtaaagagatcagaggttgccagggataaggggcagggagggatgaataggtgagcacagggtatatttagtacagtgaaactattttgtaagatactgcagtggtggttatgtcattataaatttctcaaaacccatcaaatatccaacacaaagggttaaccccagtgtaaactatagtctttgggggatagtgatacctgaatgtaggtttgacatcaattgtaacagcggtgtcactttgatgaaagatactgatagtgggggaagccgtgcatgtgtagggggcagaggtatatgggaactctctgtgccttcctacttttgctgtgaacataaaattgctgtaaaaaaataaattctatttgaagcacaaaacagcctaccaaccaacaagagatccctaaatgttcggcagtagagaaattgataaagtatagtggattcaagcaatgttatactgtatatacagtgaaactgtaaacacacatatcaacaagaatcaattacaggaatgtaaaattgtgcaaaaatgaaattgcaattggatataggcaaattggagatgaacagtataataccatttatatcatgttacaaattaaaatttgcaaaataggtacaaaatattagaatatataaatgtgtgtacaggaaaatcctaagaaagtacacattaatgataaacattaaattcattagtggctcctacttcagaacaggcagaatgaaatcaggcctgggtacctacttagctttgactgtgtgtgtgttagaatatcggtatttattttagaatgtttatatattttgtattgatgaagtactctgtcagaaaatagccatggaaaattatgctggatttgcagccagaaaattttaaacataagcagcaaacactcaagaagttaatctgggaagtttttgatgctgtgaataataattttttgtcttgtgtgatttacattttcaaggttacacgttaaaattctgcagaagaaattgctttcctagatgttgttgtaacccaaagtttgtgttgggggaaggtagttaagctgatgaataggaatgttggagaagagaagagctgagaatgtttgcacgagataactgtactgcaactgtggatatgaccgggctgcactttgcatttattgtctggccagtacttactaaagtctcttagttataagcctccatttgcataaaacttatgctcaaagtcagggttccagagttctgatgaaaaaaaaaaagtcttttttttctcttctcctctcagacaccactcaacacaataattctgataccagatatgtgggggcttatctccacacaccaagcaattctccagcaatactaagtgttctgtaatttaactcaattttgacatcatcatctacctggagatagcatcagattcttcaagttgatgccttggctgcataagactgccctctacttcaatttaatttttcttttttggttgagggatggagtctcactctgttgcccatgatggagtgcagtgacacagactcagctcacttcaacctctgcctcccaagttcaagcgattctcatgtctcagcctctcaagtagctgggactacaggcgcgtgccaccacacccggctaatttttgtatttttagtagagatagggttttgccatgttggccaggctggtctcgaactcctggcctcaagtgatccgcccaccttggccttccaaagttctgagattacaggtgtgagccaccgcacccggcctgcccctacttcagattccagctgcaagtagtagattgtcatctttacttctgtctgactgatttaaatcaggggttcccatgatccccctcctcatgatagagcagctcacataactcaggaaaacagtttactaatgtttacctatttattataaaggatagtacaaagcatacagatgaacactcagatggaagagatgcctagggcaggaaatgtgggaagaggcacagagctcccatgtcctgtccagcgcattaccctccagatacctagttttagttcagcaacctagttttaattctgactcttatctttttgggtttttaaggaggctccattttgtaggcatggttgattccatcattggccattggtaatcaagtcaaccttcagcccctctatcctccatggaggtcaagggtggaatgtgttgggggaaggcttaaagttctgaccccccagttgcattgttgcttcccctggcaaccagccaacatcctgaggctatccaagagcctaccaagagtcacctctttcgaacaaaaaaggatatttttacctaggaaattttaagggattttaggagctctgtgtcaggaactagggtcaaagaccaaatatcagaacagatattttccatattctccttgaacttctgtcgagaaggatattaggagctctctcaggaactggggaagtgagcaagtgtacatttcttattatatcacagtatcacaagagttaattcagtctcccatgttcatggagagactgactgtgcttggcattccttttctaattttcctagacacagccactcagtattttaaaaatgcatttttccaggtagctactaccaatcagtagtacctgaaataaaattgatttgctatcctgatctattcaggataggctaagttatgctttgataagaaaaaaaaaaacccaaatctcaatggctttcaatacagtggctttaattcatgtacatcattgtagttgtttatttggtgtctattgagaaaatggaaaatgactaaaaatgctagtatgaattcagaaacactattacatatttaagtaaaatattttatttgattaatcagatacattttaaaattatacttgcaattgcaaatatgtgtgtgtgtatgcacacacgcatatacattttcaaaatatataaattattcagtatatagataatgcttctggagtgtatggtggtttcattgattgtttcttataacccccaaccccctggcccacaggtattggggattgcaggaagggttgcttaactagatcacaaagtctttgtaaggggagttattgaaataatattaatgggtacagtttttttaggggaggggaataagggagtgatataaataaaatgatgtttgagaaattgtacttataggccaggcatggtggcttacgcctataatcccagcagtttgggagactgagatggaaggattgcttgaggctaggagttcaataccagcctgggtaacatggcaaaaccccgtctctccaaaacgtagagaaaaattagccgggcgtggcagtgtgtgcctgtagtcctagtgattcaggaggcttatatgagaggatcacttaagcctaggaatttgagaatttgaacctgtaatgagttatgatggctccactgcacttcagcctgggtgaaagagaaagaccctgtctccaaaaaaagtaaaataaaaataacaaaagaagaaaccgtacttcagtgtttggaaaaaaaaaaatgagtcaggaaagtcagaaggaggaaggattactttttgcagtaattttgatcataatgcagtgaaaaatctgatctagattggtacaaaagggaaggggcccagaaaatttggagacaaagctgtggtagtcattgatgatatattgcacattgctggtaaaatacagattaaattccttaaatctggagtaacataaaatatgttactcaagacaacttaaaaagacattgaaatgttggctatctgcatttctcttaatcaccgaaaatacaacaattcagaatgtataattaactctatgtaggatttataggtaatatgaagttctggagtattttaaacgttgtaataagatcttttaatatttttaccgctagaatctctatgaacattgtctaaaatgaatagatgtaattgggatcttttaatatatgtgatagctttctataaaaaggaaaaaatattgccataaaattcatacaggtttagtgtatatttaaaatatatttgttatattcacacagtaaacacgctatttagagtgttgatgacgtgctaagcaatgtccaaagtcatggggacagagcagagatcgagacagagtgcaccatctcatggatatttcattctagtagataaagacaggaaataaaccatttagctaataattagtgatgcatgtcatggagataattaaaataagtaaggtgatgggtctgttggattggattggtttattgtagaaggcctctttgctggatagccagaaggaaccagtcattggatgcttagagagagaagcattgaatctatgtagaagagatagtgcaaagaccctaaggtgagaatgagtgtggactgttcaaagacagaaagaggccagtgtgattgaagtccagcaggtgaagggggtaagtggtatgagatatgatgtggaagagatagttgggggctgattttcagggactttgaaagctagaacaagaagtttggattttattttaaattcaatggaaagctgttggatgtggtgtattataggaattgaatgatgtttctaaataattttactccatgaagaggggattggagaagacaagagaatgaagtaactcaatagggatggtagtaaagaaatactttgattcagaagtttcgtcagattggatttaagaggtaagagagaaagaggaattaaagagttttggatttgaggacattgttgagatgaggaaggcagaagtcatagagaaaggcagacttattaagagtcctgttttgattgtgtttgttaggttggtggtatctgagtgaagatgtcaagtaagcagcttgatgttagcttggagtctaaggagacgtcagggctggtgacatagatgtgagagtcattgggttatattatggtatttaaaaccacaggttggtgtgagaatcacctgcaggaatatgtagtcacagaagacaaaggggctcaggtcaagcacttctggcatttagaggcagatcagaggagaatgacctgcaaagcagacacttttttgagtcttctaaaaagataaaaatctttcttggaatccttattgtctaaataaactgaaacaatgggctattcatttaatagtgcattagtacatattcgtttaatatgggcactaaagtgtaagttctatatacagttgtattttagtggtaactctattttgttgctgcaaaaattgaaatgcagatgatgaacacaaaaaataaaatcacaattttggaaatgacgtaacaaatgaatgtatctggaaaaaatcagggatgtaaaaggaacaaaacagttgccaaaaaagcaaacgataaaagtacatatataattattgtcatatttcttatggggaagcagaaggaaaaaataaaactaatagaaaactccatcacagaatgcgagggcaaagattgatttatgaagaaaaggagggaaagaacaagaccaagccttgagctgatccatgaatttatatatttataaggaaaggtgatctttatgctccactataacaaactgcaggaacagataagctgtccactcttcagtgtgtttaacacgagtaataacttctatgaaagttaaaatcatcgtctgccatttttgtaataccctacccacaggaaagaaaagtaaaggtgggtattagacttaaagacttcagtacacctttagaactcaggaacaatagctatttcaaacagtttaaaaacattttttgtgaatccacatcaattgggagtataatgtgatggtttgatgcagaataagcttgaacaatatttaggcactgaagtcttctcagtttctaaaaagtactctgcaactcacattgagagtttcactgtaaaagagtattcctaatatattgggagcgttcacatataagttcagtgattgacttctttgaaaaggccatggtttgtgttgacataatttttttttgagacatggggtcttgctcttttccccaggcaagaatgcagtagtgcaattatagctcactgcagcctcaacttcccaagcacaggtgattctcccacctgagcctcccaagtagctgggactacaagcacgtgctaccatatctggctaattttttgtattttttttttttttgtagaggtgtggttttgccatgttgcctaggctggtcctgaacacctgagctcaagcaatcaggccacctcccctcccaaagtgctgggattacaggtgtgagctacagtgcccagccataatgtttaaaaatattacaatgatgctactgaggaatgggaatcatttgttccttcagaaacaagttacatcattctcttaaccaaccacgttattctttgtcatcgtcactcattcatcactcaaccatgggtgcacattctcattcatcagctctcccatcacctggatgcaggcattgtgcttggtgctggcataggaagattaagatgcagttcctgaactcaggagggcggagtttcatgcatggactctagtaatccaaggatggcctgcaagactccattctttgatgttatatccaaaattatttatcagcatatagatttttaaaatcagattatcaatgagatgtgtgtccaggaagatgaaaagacaaagaatcattggtgtaggctttacagatggaatgtgtggctgaaatacacagtttttattgttttcaaattattctaaattctttaatcctctttacttagggtgtcaaaatccttaaccttggctctattagcttcatttggatttctgtgagcttccatcagcaccaagagaccagtaccactgtagcaacataacagagttatgttacttttttatataaaataatttttaattttttctatatgacagaaaaatatatttttttaaagatttattagctggatgcagtggctcatgcctataatcccagcactttggggggctgatgctggagggtcatttgaagctgggagtttgagaccaatctgggcaagatggcaagaccccgtttctacaaaaaattagaaaattagccgagtatggtggtgcacacctgtagttccacatacttgggagtctgaagtgggaagatcccttgagcccaggaatttgaagtgagctatgatcatgctactgtgctccagcctgggcgacaaagtgagactcccctctctaaaaaataaacatttattattattttgcttttgtatcatatgcatgcctctgttaaattattcaacacatatctaaatgtgctcaatgttatttttcctgatcaaattatgaacagtgcaattcctagagtctttttttttttcatttcatttcatagttctacataggttttggcctaaatgagaaactgagagtaaatctccgcttaaatccttaaaatgctattgccttttcttttccctcttctttattctcatggtagaattaagagttatcattgaccagagtgttttcactctactgtggctcccagacagtgactttctgctagagagaaagagctggagatgaaactgaccctatttgaatacggaagaataaaattataaggttgagttattcagtgggttaataagagaaggaattatacaaaataaaattataaggtggggcctttgaacaggaaacaactatcaaagctctgcaatagagaaaattctcaatactgtaaagataattttgatgtgctggacttctgggccagaagaggtttcctgagacacccaagatgcttttcccacatccattagttcaaagttacaaaatagtaggggctggatctaagtatattatccctgagtggtgggttatactgccggctaataaaaagttttatactttgacatgttctgctaagttttattgtgggttgtaaatgtttaatatcctcctaggggcttttaggagaatatgttttcacagcacatgtggtgctgttatactccgaaccaatctaatgggctttaattatgccaaggtctgtggatcccggagatgctgacaaattcataatgtgttttaaattgctaggatggaaagtacaaatcaaaagtttaatctggagtagtgtttagaaaataatttcctttgctaagatgccacctgtcattctcctttctcaagttgaagaatgtggttgagtcattcattcatgaatctcatgtgacattcctatccttaccatggagcagatgaaatgctgaagttgactttaggaaacccagatttgaggcccgagttttcactcactttttgtttgaatcggtacaagtcacctgatatgaaagacttcattttccatgggtctaatataggggagtgctgtaacatgggaagactgacttagtattattgagagaatcaaataagatgatacacggaccaccaggaaacatctgagagggctcttccttattgttttggttgagggatgtttaaatcgtaactagcaggcctgctagaagttctctgcttagttgggaatctagttgattctgttaatatttttcccttttgatcaacattgcaatcttctaagctactgcattcccttattctattaacatggctatcttgggactataccgtacttccttttgcaacccagttgacatgcaggtatacgtaaatttggtatttgcctgctttcttagttctgaaaatgggagaggaccaaacactactctcgtcattcaaatactgagtaaagctctgctccagtgataaacttttcagtgatcctgtatacttgctgactttcatgagttgctgatgatctgcaagacaaaattagatcttcagtgctgagttaggcaaagcgcttcgctcctcatcttcctgatgacacccctacagtttgccatcagatgcagatagtgatgatgatagtagggcattaactggtgcttcaaagcataccggtgacctttccacattttttataaaataaatacgtccgagtttgctaggggattccaatcttcactcccataatgctgaggacagcataatatcaatgaagtctgttcagctttctgccagtcagaccaatgtggaaccaaatatgtattactgtcttacaataatcgaagtgaatttcatggaaaagcagagttcctggtacattgtaaggactcactagatgtttgtgaaatcgaattgataagacctttcattctccaagcagaaggaagttgttgtattataagtagttatagaaattatgaacacatggctttaagtatatgctgactttgcagtgcccagtcaagtgccaggtaatctttaaatactgataaattgaatccaatagttaattaacagactttaaaaaccacaatctcataatgaaaattctacttagagactgaaaaaaaactctatgctaatctctctttatgctcatccaagatcatccctgattgaatacataccattcaaatctgtaaaactcaagattgcaagtattagtattagaatatgtagtttattgtgttttgtgagggttataaatattgtttgtctttttttaagaaagataaaaaagttgtgattagcatactgtaggaacttcatttactatggattcataaagagtattaccagtcactgtaggaaagtgtttgtccttacaattgcaaaccttccaagcactgtagttgataagagttcaaacagtcacgtaaccccttttctaaatacagagcttcctgctacaagtttaaattttcttctttaagatatttctcctaaataaggtattattaagcagaaccagtttcttagtaatgaagttaataaaacaggccagtctgatgatgacttttgtgtctttctaagaacaaaagacaaaagcaatctaataatgactttagatctgtagtctatccagagttaaagtgcttgccttttcttttccctcctctttattcgcatggtagaattaagagttatcattgaccagagtgttttcactctactgtggctcccagacggtgactttctgctagagagaaaaagctagagatgaaactgaccctatttgtctatccagagttaaagtgcgtgtgataaaaccagtagcctcacctgttaaggcccattgatctaaagaaaaatctcaggtgcagtataattgtgtaattgttgctaatattgttatcaaattatttgacactgttctctttgaacaacgaactctggcccatactacttgaattcagacataatttaaatgaaatgtgaatgtgtaaatatattattgcaatatgtgttttcactgcactcataaaacttagagtgatcattaatgacatatttttaaaaataccaagcctcaaacttccactcaaaagcttttctgttattttactgattcatacatttattttctgtcaaacaagcaaacactgaattaaaaatgggaaacttttacatattttgcttccctttaccatcaccttaatggcttaacataagtctttaatgtgataggaaacatacgagtgcgactcacaattatggtaaaaaattcaaatagggatataccctttgaacttaagaactctaggaatttagacgaaagatacaatcattataataagagattgtgagagagtcattacaagccttgatatatttacaatgtccattcttataaccagttcctagaataggttagttgtattggtaaactggtgtccctgaattatacaggatattcctctcactacagagtgagctaagcatatccttcagaagttaccttcattttaggttggctcttacaggcttaggaaataacaggaacattgttaggctaagagaatagaatctaaatttatcagacagacatggaagccagaataccttcagctaaaatcccagctctatcatttatgtatttgtttgttttccattttttttctacttataaacaatactacagtgaatattcatatatgaaataaatatctctggacactgttcaacattgccttagaataaattcctaaaaatggaattctagggtaaagtcatgtactttttagggcttttgatatttactgtcatattgcccttcagaatagtttacaatcttctgagctgtgtttctacgcatccatttgcccattcttacatctgcactgggcatcaaaataagaaaaatcttgctaatctgaaaggcataagatctctgttttgaaagaattgtacttctttgattagtggtgaggctgacctttccctgttcataccctttgcccattcttcgagtatttgtcttttttggcatatagctgccatttatacacgtggtcacaaaccacatgatattgcatgtatataacaatttccagttttcctgataacatattgctttggttattaaagttctaaagggtatatgtgttaataatttatatctattcatatgaagatagctctgcggttatctttttttttttttttttttttttttgagacagagtcttgctctattgcccagactggagtgcagtggtgcaatgtcagctcactgcaacctctgcctctcgggttcaagtgattctcctgcctcagcctcccaagtagctgggattacgggtgcacgccaccactcctggctaatttttgtatttttagtagagacggggtttcaccatgttggccaggctggtcttgaactccttaccttaggtgatctgcctgccttggcctcccaaagtgctgggattacaggcatgagccactgcgcccagctggttatcctttaaaatttaatattttaaaatagttatgtttatactacctgaaaaccttgtgaattcattatattaaatatacatatgtacctttttctcactttgtcctggcaatcatataaattgtgacagtctttgcaatcacattgagaggttttctctagttgtttaacatctgcctcagtgataactcaaatacatttggaggatgctttactttatataattatcttattgcttgagaatacagattcatgaggccaaatccaagaaatacattttatccaactggatagtcctagttatcagataattcagtaattccaaccaccacagccttgttttcctttttttgtgtaaattttctgtcgggtgtaagagatttgtgtctcagggaaatcttgacttagtagagaatgagtggtatggagagatacagatcactctactgtaattccatctcagcagttaatgggcccagctttgcaataggatgatttctgagtgtgatatgattcttttataagcagtaggtacaagttgactacatggatgagtcagactttaaaaaaatgtcatctcccctgctttgacagtgttcatttcttaccttggaaggcaatctagtgctgaggaaagcctgctggctagagatcaggagccctagacttgcctgtaagctcatcccatttttggcaagtcccttcagcttcttttgttttctgagttctgaagtgacaataataattctatttcctcatccattataactgaacatcatataaaatatgcaaattacactgaaaatacagaaagagctacacaaatgtaaattgctcttaaagaggaaaatctctgattattctgaatctctgtacgtaaactcagtgcccagaagatgcatatatgagctgtcacttgggccgtctgtttcaaaggctacttattgatgttgttatgcgtcctcaagctattatgccatcttccatttctgggtgtggggagcatggaatcaagttttcaaaagaaaggtggtgaaggttttctcttggcatttatttatatatgtattaatcttacatatagatagaaaggagaatcatttcatccattcaagagccatgaactttatatgaatgtcatttcaacaataaagcaaaaactacagactgtctaaggaaaactccgttttattatttggtttgttacttaccaaaacatacaatttaagacctgaaaatatctagaatacatagagtattatggtcaatcaatacaaaagtgacaaccaaatagaaaaaatgacagatgcatttcacagaagaggaaatgcagatgatcatttataatatgaaaacatcagcctcattattaattgtagaaataaaaattaaaagcacaacgaggtatcatttcacagattggaatgtggagcaggaggaactttcactcactcctgacggtataagcactttggcaaactgtaattatttagtaaatttgaagatacgcgtatattgtaatttaggattgtctcttaggtatatattctagcaagacttttgctcacgtgcacaaggaaacatacataagagtatttgttgcagtattgatgggagaaagaattggaaatagcagcagactgcagaagaaattgagctatagtcatgcagcggatgactctgagcaataaaaatgaatgggccacaggagtccacatccacatggattaatctcaaaaatataatattgcatcaccaaaagaattacagaagaatatacactttataatacatattttatgtttctagttatataaagggcagaactcagcaaattttttatttttgagacagggtctcactctgtcacccaggctggagtgcagtggcacaatcactgcttactgcagcctggacctcccaggctcaagcgatcctcccatctcaacctcccaagtatctgaaactacaggcatgcgccaccaagctgggctaatttttgtattttttgtagagatggggtttcaccatgttgcttgggctggtcttgaactcctgggctcaggtgatccaccagccttggcctcccagaatgctggcattacaggcatgagccactgtgcccagccaacaaatttaaataacatactgtgtaggtctacataaatttgtggtaaaattataaagaaaaacaggagaatgttgtggagagacacagaaagctccaaaattactcataatattgtattcttcaacctggttgatggactcatgggtgttaattttatttaaaatatgcatttctttacatacatattttggaatatatgatacaaaggtatttcaataaaactatgagggcctagaagatgttggtttggactcagtctgcaaactctgaacatagcctacagaaatgttggcaatacatgaaaaattatgtcttaactacaattttactaatgcttcattaataagcagaagagtttgtatatagataaggaaatgattgacaaactgagaagagaaagaaaatacttactaggactagattattaaataatcatataggtagctgataggattaataccatttaataattttctatctgtttaccatcctaaaaattaatccaaagaagtcttgtgttcagccacaaaatgtaaattttactgtggcctaaaggtaatctatgtgcctgttaaacatcaaatacatgagttcatgtatttttatccttggattggtcaatgacttagcaatcaatgacagatagtaatctggcactattttaaaatactcgtgtatgcagtctatggactattctatcatttaatctatttatgatagcaagtttcacttatgcacatccaaaaattttgaggacatttaaattgatttctttggatattaatgagaatggaaaataaccagtcaacattgttctctaggctgtactttatattattgacatttaaataattatttgaccttttgtgtgataaacatctttctcctgatatcagctttgacttttttcgtgtgggttttagttttcatgatttaagttgtctttgtggcattaaaaaaccacagaagtagatttgttaaggatgtaaccaaaaagagctagaaggaactttagaaataattttacgtcgtctgctggtttcatcttgaagaatttggggcatgaaaggttagataacctaacaagaattagtccttttaatggtagaatcaagccttatttgggccttctgagtttcagttcatcgtttctactgtatcccctcttccttaatatgatgattcattgtaacacaaatatacaatttaattagtagaaagctgattttaactcttacgggtacgtacttatactactttcagtaacttgttcctaagaaaactgtaatacctcgatgagtcatatttagcttattttctccattatatgtcctctgtcacaagatcccatttcgtgggctgtatttgagcttgtattttcttttctacgtaaaagctctaggatgataatgtcattaccactttttacatgcacctggtgtatcagagactctgctaaggcattgcacatacgttttttcacttgctctttacatcatgaggaagaatctaaactttagagagtgtaggtgatttactccagatcacatagctgctgagtagcagaaccaggattctaatccagttccttctaactacagcatgacaaattgtgcttagcatgaactaagcactttgctcagttgtgaattcacagatgttcttaaactgaaaaggaacaaggaatgctagtctagatttttatagtatgagatagtcacattattgtacattattgtaaaaagtagaatttttacaataattctgtaattccttttgtaatatgttcagtatgattttacttctacatatattcattggcttatctactttttgaaatttgtcatttatttatcaagctaacttgagttttgtttttgtttttcatatttgttagcattctgtgaaacttcagggctcctgaaatattcagtgctttgacccttagagtctgttccattccttatgatatttatgtagatcctgaaaattatggctctcaggcctaaacccagtttattgtgactttacatatatgtaagttaatttgggctattaatagatgcctttcaagtatgagccttcggtttgctgtacttaatatttttttaaagtatacaataacaacattgtgcaataaagtttgcataatattatcagaggcattcgagccagagcgactccattttgagtgaaggctaggaaaatgaggccgggacttgctgagactccatcttgactgagggctaggaaaatgaggccgggacttgctgagactccatcttgactgagggctaggaaaatgaggccggaacttgctgcgctgcattctcataaagtcaggcattcctaccctctagatgtttattatggttaagggaaaaaattaataatgtttaaacagacccagacttaggagtgtccagatatcctgatatctagagaacaatggcattcctaattttgctttaaagataataatatcgattcttgcaaactatagtaattaagaaaattaatcctttatcacaaaccattggagcagaacacatctccccatatatacaagcattgtacctagggtggacacgttcctcctcttactttcaggaacgtcctactctgtctatgaagtagctgccctttcaccactgtacgttcttaataaacttgcttttgctttgcactgcgcactcaccttgaattatttcttgcatgaaatctaagaatcctcccttggatctggatttgtgtctggaattggtgggttcttggtctcaatgacttcaagaatgaagccgcggacccttgcggtgagtgttacagttcttaaaggtggtgtgtccagagtttgttctttctgatgctcagatgtgttcggagtttcttccttctggtggattcctggtcttgctggcctcatgaataaagctgaggaccttagcggtgagtgttacagctcataaaagcagtgcagacccaaagagtgagcagcagcaagatttactgcaaggcgtgaaagaacaaagcttctacaccgtggaaagggacctgagcaggttgcctctgctggcttgggcagcctgcttttattcccttatctggccccacccacatcctgctgattggtccattttacagagagctgattggtctgtcttatagagagctgattggtccattttgacagggtgctgattggtgcgtttagaatccctgagttagacacaaaagttctccaagtccccactagattagctagacacagagcactgattggtgcatttacaaaccttgagctagacacagggtgctgattggtgtgtttacaaaccttgagctagacacagagtgctgattggtgtatttacaatcccttagctagacataaaagttctccaagtccccactagattagctagacacagagcactgattggtgcatttacaaaccttgagatagacacagggtgctgattggtgtgtttacaaaccttgagctagacacagagtgctgattggtgtatttacaatcccttagctagacataaaggttctccaagtccccactagattagctagacacagagcactgattggtgcatttacaaaccttgaactagacacagagtgctgattggtgtatttacaatcccttagctagacataaaggttctccaagtccccactagattagctagatacggagcactgataggtgcatttacaaaccttgagctagacacagggtgctgattggtgtgtatgcaatcctccagctagacataaaagttctccaattccccactagactcaggagcccagctggcttcacctactggatcccacacaagggccgcaggcggagctgccaccagtcccgcactgtgtgcccacactcctcagcccttgggcggtcgatgggaccaggcgccatggagcagggggcggcgcttgtcggggaggctcggacacgcaggagcccatggccggggggaggctcgggcatggcaggctgcaggtcccgtgccctgccctgcggggaggcagctgaggcccggcgagaatttgagcacagcaccggtgggctggcactgctgggggacctggtgcaccctctgcagctgctgccgcaggtgctaagcccctcactgcccggggccggcagtgccagccagccactccgagtgcgggacccgccgagcccacgctcaccagcacaagcgccacgcgcagctctggttcctgcccacacctctccctccacacctccctgcaagcagagggagccagctccagcctcggccagcacagagaagggctcccacagtgcagcagcaggctgaaacgctcctaaagcatggccagagtgggtgccgaggccgaggaggtgctgagagtgagcgagggctgccagcacgctgtcacctctcagattgggagcgcttttctgtaacaatatcattattgtgctatttaggagaatggatgactactgtaggtattatactaatggtatctactgcttttgtagattcaaagcaattcagtgggttgtgggaatataatgtgaaaggaaaataaaaacttgggtccccaattcactctgccaaaaagaaaaaattaaactacaagctgagtcatgcaagaagctgcctttccttttgtacctaagcagatagctacagataaaaggttaaatatctccacaggtagctactttatgttcacctgtcttaggtaaacagctgatttacctgtgaacatgtaattgactattatcctacttgatccttttcttttgcaacttgtggattaccataccctacctctttcccctccagcccactttacccctttaaatattgaagcccttgaattcaactttggagaaaggcacacaccacagactgtttctgtgattctgtgtcattttcttctgggtgtgtctttaaccttggcaaaataaacttctaaattgattgagtcctgtctcagatactttttggtttacaataatgtaatatctctttatatattatttttatccaaaataggtaagaaagaaacaaaatttcattaatatttactacacagtttgactctctttccctcagttggtctgaatgacatttggttacacatcaccataatttgttgtctaagtaacacaagatattttgttagtagaagtttcacagttagggtttccttgatttgagcatatcgtgacaaaatatcaatttagtaggtatctatcctatataaacttcccgatgaagttactagatggtgagtgtttaaaacaataacaggcagagtaggcactaattgagtgtcagcattatcattattgattatattattattaagtattctggttctatctgaattcactcaaaaaatagttggctttaagagtttctgcagagatacacaagttgaaaattatactggttatgtaaacacaaatggggaaaatctaaacataaaagctgatatttctccattttctaacacaaatactttgccagctacactatgagctcaaaaacattcaagtctatcaggaaggtatatatgaatttacattattgttaattacaaatcttatcttatggggtctattgtgccttcagatataaactgatgacagtgtgaagtcattacagtgagacatttaaaacctaaacatttagaacatgaagtttgagtatgatatgacatgcaatgacctgagaaaaaatcctttttttttttttttgatactggatctcactctgtgacccaggctggtgtgcagtggcaagatcttggctcagggcaacctctgcctcctgggctccagtgatccttccacttcagcctcctgagtagctgggactataggtgtgtgccaccacaaccagctaatttttttttttaagtagagttgggatttcaccatgttgcccagtctagtctggaactcctggggtgaagtaacccacctgcctctgcttcccaaagtgttgggattacaggcgcgaaccaccattgtcgggactgaaaaaatctttagaactgtcttttgtgtcttccttaatagtggaagataaaaagtcatagtcatttgggaaaacacttactcttatcatagaagtggctgaaataatactgagaaaccatattatcacatgctatattgcagttctatgtcagtaaatattcttaaaaaacatgtggacaacattgctgaatatgtgaaagaagtattaggaaaattactcggtactgggagatggactatagaattgcactgattctgtttcaagaatgaaaatcttgaagagctactttttatgaggctctgaaggaaacatagagacaatagattgtcaggagtgagcaaattctttggtaaaagcaaggatttgggggaggtggttatgaagggtgttcataaagagaaataggtaaatataaccactaatagagttggctgcttgactggaaataaaataacaatccccaggtaagttcacaaaactagctccttccgtggaattcattatttcataggcaagctgttgccgcagagatgttagaacctgaatataaaatctgaatagtattttataatgagatgtgcaatgactttactgtggactgtcttcttgtaatcttgtggccatgtacttcaaatgatgaattttacaaaaagttaagtgtcccgcacttgcagtaataatctggagctttttatagcgtactcccttggagatatttccagggcgaagatgacatttttaacaatgaaaaactacctgctttctggtaaccttaccttggagagaatattttgaaatgaatgtttggatatgttttctcattatacaaatatgtcactgaaaatgatgtaaacacatcatgtataaaatctgtgacatagggagactataaacttaaaagcagaatttcctaatcaaataaagagcttagatgagatttgaaatatttattagaaatatgaaagtgaaatgtcatgtggttagtttgtaagaacttagtgaccatagggaaaattggaatttactattgctacctgaattgcaacaaaatctttttgtaattggtggattaaaatgaaaaataagagtcattttccatttgtgtctatacatttttgtaatctttctttttcggcctttgaagaccattaaaacaaaacaccaagatagactgaacttgaagccagtcctttatattattgactcacaaagttttaatacaagatatttaatataagatatgaagcatattcagttgcatagcattcataactcaagcaaaatattatctgttctattaaaatataaaatgtagacattttttcttatttttaattttaatttttaaataagatatgtaagtattgaagtacagatatagttaaaataattttattaatatgctcctttttgcaaatgtgtgttcaaatatttgcttatggagtatgtcgtaggctgaattatcctcaaagatatccagtttcgaattcagggaacctatgaatgttgccttatatgacaaaagggacttggtgattaagttaaggattttggggagattttccttgattatctgggtgagctctaaatgtaatcacaagtgtgcttataagggggaagcagagtgagatttgactgcagaagaggagaaggagatgtaatggctgaagtaaaggttggagtgatgcactttaaagatggaggaagggaccacaagccaaggaatgtagaaagcctttagaagctgaaaacagtgaggaaacagattctccctggcgagcttccagaaagaatcaatcttgatcatatttttactttagcctaattacactaatttcagacttctaatgtctagaactgttagagaaaaaaattatgttgttttaagccactgttcatggtaacttgttacagcaatgttgggaaaataatactaggtatgtaggaaaagaaatttgaagaccattatctctactttagtttctaacttaatgaaaatgcttttgctaggggttactgaaagtaaccttagatgttttatagcatcctgttttttatttattgacttatttatttactcactcactcacttgctggctggctgtcattttgctgatttccatgagtttctggaccagatcctagtattcaacttccaataacattttcaggtgtttttttttttttttttgaaagattacatgaataacgtaatggcagaatcaaatttagaaactcagcaaaaaaaaaaaaaaagctttgtgtttcaacatgaatttctttttttttttttttttttgagatggagtcttgctctgttgcccaggctggagtgcagtggcacaatctcagctcactgcaagctccacctccagggttcacaccattctcctgcctcagcctcccgagtagctgggactacaggcacccgcaaccacgcccagctaattttttgtatttttattagagacagggtttcaccatgttagccaggatggtctcaatctcctgacctcatgatccacctgcctcagcctcccaaagtgctgggattacaggcgtgagccaccatgcccggccaacatgaatttcaaaggcaaaaatgctttcacatatctcaattaggcagccttgaaaataaaacttaagaagaagctctcttttaaaatatatttatagctaaaggtttaaaataacatgggttaaaaagtggtactagccttccaggtgctcaggttgctaatctgaatttgtatatgctatgacaaagaaatggttcattttattgagcacatatcaattgaacatgagctatttaaggtggttagtattacaggtgcatcgtaaattgaagaaggttgagcagttaaatgcttgaagatgagaatgttcttttgaggagagatgaaggctttcctgaagtccgtgatatattatattgcttgctcctcacttgtctttgtgtcctagtgctctgtcttaaagatatttaatttggtttcttcaagaaatgagattggtttaacaaaaatgcacttcagcaggcaccagacatttaccagattcattcttgaaccactattgccataaattgtggcacaatgaaattaacataaactgggattagcttggagaaaagagaaggctgattattttaatgatggattatactattaatattaaatctctttatgagaatcaaaactaacagaaaccattaggttctattatggtatttgccaaaaaaataaaatttagaagtatgtaattttttcaccaaagaatttgactcctgtaaagatccagtggatctttccggttagtaacctacatgtgaatgaataagatgagtacatgtgtgttttctttctcctctttgtcctttgtcgaatttctaagccatcccttaactccaagcttctacctgtatgtgaacgaattgggtgtatatttcctacaaggctgcactctgaaataatgcagataaattctgtgcaagatagttttaacattttaatgtttgagtctgaagatactatgttttttttcaaaaccagcataaaccaaaatttttagaccatcatcaagtttttacattattttaacaatctactcttgaaaaatcatatctacattatttaaatatataagttattatttttaaataattcagtttaaaagtatttcttagggcttatttacaaatattttttggtggtccatttgcaatgagatgataagtgttgtcctttcacaaaaattaggtttttctgtaatatactttgaacaggaaacacatgcaacaatgaagaatatttaacaaaatccatagtgaataggtcctgtggaggatcacaaagccccagtagcttataaagtcaggtggaaaatatgttgtccataaatatgtgtaatacaaggcagtttgagtcatcaagaagtgtttcatggatgagtccatatctgagcttggagctgagggatggtagaaattggacaaaggacaaatgggagaaatgaaaatgtgtttgtgaaaagcagagttatctagtgtagtttaatagtaaccattatgtccaaactttataccaaaaatttaagataccagatagggagtttggacttaaatttttaaacagtgggattttttttcttctattaaatctctgacaggtctaacgtgatcttgagggaagtctaatttggtggtaataagtagaagggactggagatgaagagatgggggcagggggatcaggttagagagatgacatctaggaaattagagaagacaatcaggtgtgacgattaggaacattaccaagtaaaataaaaacaactaattttagaaattacattgagaaactgaatttaaagttcccttttatgtcagagtttaaagagtttttgcttgatttccagtatcagatatgggtattacagcttcttctttaggacattgatgctttaattaaaaatatatatgaatatattaatgacaccttacagcatttcttggctttcagatacttttatacttccatttgcagtagtttcttaaattgtcattctacatctgttattgttacgatacagaaaactcaatcctttatagcacttttgaaatagattcttccccttctactaaaattgtttccttaaatatctctggtgatatcttagtttcagatccaaaggctctgacttcctcaccctatttgacccacatactgtgatgtgtttgctctcgacagatgtattatcttcctgctcaaatttgtttctcctcctgtgttccttacgtcagctgatggcagcaccatctgtgcgttgtttcaggtttaaaactatggatcaatctccagttcctcctttaccctcagtgtccagttagttttcaaatccatttttcccttcccttgaatactctacatcacatttcattttttccctagtttaggttcttcttagctgtattttattttttaaagatgttcattttacttgcttctttcctgggactattattataagagacagaggtctgatcatcttgttcctattttttatggacctggtatagtctgtgtggacttcctggatgaccaacaaccacaaaccaattcactgtgccagagagaaactgcagccccagcttagagtgaagggggttcgtgtgggtcacagaaggactggtaggcattttctaaatttagatcatttccatgactattggaaagaaccctacctccccacctccacaaaaggctgatgattgtgcttcaaagtaaatggaagtggaccgaggagtatttatttatttcctgagctgaaatcagtgttgtccatctcatttaaaatgcaaaacttccaattcaaagaaacagtgtatatataggcaaaaagcaaagaatgttttgcattgtttgactagctagtcaaagcaaaaccgaataactctacctcagaagtgtcttcacttaatggtaagatctgttcaaaggcacgtcaacatggtcaaaattagttatatagttcttctgagttttagccaaggactttaaccatcctgatggggaaatgatacaaaagtttaaacatagttgcagatattcaatgtcttgattatttaaagaagacataatttattttcttactgatgctattatgagtgttcttgtttttctaattccatgtttcagatgttcttattagtatataggatagctgatttttatgtattgatctatatgttgcatccctgctacactcatttattagggccagtagttttttggtgggttacttggtgtttccaatgtatgcaatcatgacatttggaaatacggtttaacttcttttccaatctggatgcctttcatttttttctctctctctctccttcccttccttcctttcttttatgacctaatttcactttcaataataacagttcttgtctaaaaatcttttttgtgtgactggatgtagctgtttcacctcttacggttaatgttttcatcatgtgcattttttgtgttcttttacattcaacctatttgtagtttttaatctatgatgtgtctattatagagagcatacagttagatcatattttttatcctgacaacctctacattttgatagaatgtttagaacatacatattttgtgtgatataattggatttgcatttgccatgttgttttttcatatgcctgctgtattttttgtacctgtattcctccattcttgctttcttttgtgcagaatagtgtgccattttgaaacctctgttgatttctttactatgtattttttgagttatgctcttaattcttatgtactcggggattgcaatatgtgttattttaattcatctaaaatcgtaacttcacagtctacttcagaataatactcatttaattccagtaaaagatagaaaacctgctccaacatagcttcatttcctttcccttccttcatactctttttttgtgacatatacacccatacatcatacatatatgttccaaacccaataagatactattataactatttaactgtttctttatacattcttatctcttttaaagacgttaagaaataaaatttttacagtcttttatgttaatccacacattttcaatttctgacattttttatttatttctttggaattgaaggaagctccttcagaactttcttttgtatttaactgtgctaggaacaaattctcagtctttgtttatctgcaaatgtctattttgccttcatcttttgaaagatgggatatgagattcttgattgaaaggttttttttcttttggttctttgtcatctcactgccttctgtcttctcttttgtcagatgaaaagtcagccattaatcatatatccatttgatgggatgtgtattatttttctcttactgctttaaatacttctatttttgtctgactgtcatgcaaacaatttgactgcagtgtgtctgggtgtggatctctttgtatttatcctacttcaggtttattgtgctacttagatgtgtaaactaatatttttcatcaaattggaagtttggggccattcattatttgtttaaatgcatttttctgaccgcttctttctctcctattcttctgagactcccattacacgtatattgatgtacttgacgttattccactggtttctgaggctctgtgcatttttttgtcaatgatttttttttctgtgtacttcagattgaataatttctgataatctatcactgattcttcttcaatctgcaattgaacctctttagtatatttattattttagttattgtattcaaatacagattttccatttgatttatttttgtaatttttgcatcctttttgataatttctattggttgattcattgtttccatactttaatttttaaagcatgctttcctttagttctttaaacatatttataatagccgccttgaagcctttacctgctaaatgcctttgtcaaggcactcagagagtttctcaagactatgttttccccacagaatgggttacactttcctgggcttttactgtctgtgtcataattttttgttaaaactggacattttagataatataacaaccctgaattcttttatgtctctattgaaggttattgttgctgggtttttttattttttctttgtttagtaaattgtctgagctgagtctgtgacatgtctctccttgatgggtggccaataacgtcattgcttaatgttttaaaaaaattattcttatttttattttaagactagctttctagagactttgctattccttcatagcttagagttcaggtaatgatggtacagagattgtgctcagacactttgaggagtaagtttttagtcctctaccagccaacctgtccgtggataaggaaatgtataagaagttcaggtcattttcaagtctaccaagatttacttcctgctggttcctaggtgtctttcttgtgcatgtgcaacttcagtcaaaaatatactgagttagagctggtagaggatcaccaggtgtgtgctagcagatctgttggacctccctgggatgtgtcactttcatagatggtgcagtgtgcatggcatctgctccaaatcaagtgagttccctttgacaaggtggcacagctactggtcttcacagctagcccatgtcatgacatggtagaacctccacattagtcgagctgtggggagatgggagtagcccaggaaagaacaccacagatttactgttcttacccaaattgtggcagtttttaagcataaaagtttcttatatttttgtatgcctttggttaatttccacagctctgaaagtgttatttttgtcaattttatccagctggctttttaaggagaagatttgccaaccttctcacttggtcatggggggaggtgcatataatttatttaaaaaatgcagcgtataaatatttttatctatcctgaattgatccttcaacataaaaaagtgttatgttatggctgtatcttatcaggtgctcagcttctagagttatctttcaaaaatattctttgatttctttgtattacctataaactccttcagagccaaattatgtgttaagtgagatggactttttggttactgtattttttgtgttccattagcttcaactataggtttatcatctgtaaagattaataggactctgaagtacctccagatcacctgctgttaagtcagagtcacatctcacaaatacagctctagtttcagttccatataacattccttggcctcatatccaaaggtatataccctgacctagttgtttaattacaccatatctaattctatcatcaagattcttcaaccagaaaatattgtatctcctatggaagtggtgactcacctgcagtcagcaaaggaaagccctctgtatttaaatatatctacagcacatccatccagacaggatcacagtattattgccttccagcacttttgctcctgctagtacattcccagaggagctcatgtgaggctaccagcttctaaaatggcccttaagccaaagtcgtggagtatggggtattcatgactccattctctctgtgtgtgtgtgtgatttttttagagcaggctcactgtcacatttaggtttttttttttttaaatcaatcacaaatgttaccacaaatggacagggcaataaaaagaaaacaactgggaggcaggctgatatgaccttgtggaaggcagtctggtatgagttttaggctaagcagataggtcttttaatagtttctggcttagggcatgtcactcagttttctgattcactggttactcatttctaaagtggggataataatacttatttcatgatgagaattaggacctagcacaaagaggacccttaaaaagtgatatagctattattacttgtataattgtctctacatttttttatattcttgaaactgcatagaaatttcatgctagtacaattcctggcaagaattccaaggtgttgaatgtctcagtctgagtctgcttggagtttctagattttattatacttcattgttttttaaataacagatttcttaacttggagcccaacttcccagaacatgattccgatatacttctgtgactagaatttatgtgttttaaacacaacttaggaaagtgggccaaggatgttggtagaggatcactaggttcgatgtcattgagtgataacagaccagtacacagaaatagtgggctttggagcagagaaagagtttaataattgaatggcaaccaaatgaggaggtgggagggaacctcaaatcctcttcccagagggatactggactaggatttttaaggggattttggtacatagagggctgaggagcttagggctgctgattagttagggcagtggggatgaagtcataaattgtattcttatgttgaataagttctttagaggggatcttcagactggctggtgtcagtggaatacaggatctgaaaatatctcaacatgagaaacatgaggcttcttaatgttaaggatgttatctacagaaataaggaccttgtaacaggggctatgtgatttttaagcagtaagtacctataaggaagtggactatagggcaggctggttaatgcttagctatgcttctactcaaagtgtatgcttttattgaaaaacctagcaatttaattttattaattttataagaacagtttcaatgttactgagttgatttcagcttgatttgttcaaactgatactgagtaattaatttagctcttgccatttcaaattaatttagatgaaattaatccagctcattttcagagaatgagacacctgcaaacagtgagatggttggtatttgtatggttatgcctgaacgaatctgcactatattacataattaattgaatttgaagacatcatcttatcacctacacaactttaattgtggaagccatacttactgtcttcgcttttctcttctccttttgacttttgtgaaactctagacaagtcggaatctgttggttgccctcatctatgtgtttgtgtgaattatttttccttcttcaaggagggcatgagacaaggaactatggctgttgtggcaaaggtcatattccagacaattaagttgacctggttactgtaaaagatattttttgtcccagatactatatcaggcaagaaacctatgaatggattctacaaaatatccctgtcacagaactccctagagacaacactgttgctcatcagaaatgttcactgaaggctctatcaagtgtgttcaatctgtggtctactgagatcctgcagacggcaaagctgagatattactgcaaataacaagtatttgtgactaacaaatacttagctcatacactatttttgtcttagttattgctgatccttgttatcatgaataggctaacatgtaggatatttcctacatacgtaataaacacacacacgtgtgtgtgtgtgtgtgtgtgtgtgtggtgttaatttttttttaaaaaaaaaaaccttttttgaggaaagagtgaaaatgtgctccaaagtaattcgtggctagaggaactgcaacagtgtttcaaatatttccatttatatgtttgttctgtggtgtgttattcgtccatttattcatacatttattcaaacatctctaaactctgaatttagtagtaagactccataactcttcaaatagtagatttctcaacctagagctccacttttcaaaacataattctgacatacttgttcgggatacttgttttccagagagttggtatgtggagcttttattgagattgtgattttttttatcatgaataaaaagatagaaaccagtctgcctgaagtgagtttgaattagcaatgttgagaggcaggaacctacatcagaggaaccattagtttgcatatatgactttcaagatacatagtatcttgaggctcaattcatagcagaagtctcttttctgctttgtctttgagtggtttgcttgcaaagttccaggtaattgtatgcacatcaacaatggctccctctcaagatatatgtgagctgatgtgatgtaagccaacattagaattagagaggtatgatggaatggttcatccaatgagtgtaccttctagttttgcactgacacgtctgagtcatttgaattttaaaataattgtaaaaatcagatgaattggcctatctacttaatattaaaggatgttgtattatgaaagatgcatgtcaaggagcaaaatgaacaccgagcaaaccatatgggatgctacgaattcactagggattttcataattagctgctaagttggcacagctgtgggtctttgtagccgcaatgtactgctaattaccactcatttaaacgtgctgctatatcctctctcacctggacctttctattggcaagaatgccaagggaatgacttgagtgtttctgaagattcaaaggatttaagaccggggaaaacccagagacatcagcttcatttgttaggatcacatttagccttgtctttcaaaaagctgacctgaacgaatgagttgacacaggaaaaatctttccttcttggaggcaataatgttaacctctggcgcaaagtgggatgaagggaaaaagaacatgacaagaaaaactacccagaactatgaacagaggtgtgaagctctggaaataatatttccaaactaggaacatggtgtaatgttatgattggggttttgaagcaatgtaaagaggaaaaagtgaactaagatttttcttagatcttgcctgttacttcctttctacagtatttcctacgagtcaatgggatacaacaccatggttttttttgtcactggagaatatataaacattttaaaggatattattccccatctggtaagtgacattttgcctggttcatgtctctagttggtaaattaaaacaacaaccaccactttatctttcggaggacatagaatttgatatctccatcatttggggagaagtcgacactcaacagttacagtgccttcctgaaggccacacagcagatgggcgcctaagcaaaaacaaacctgcctcaacttcagaccatctgctctgttttaaagtatactgttttcacatctcttggtggaagaacagcttttctcttaatttatatctctctgattctgagctctcaatctgatttagggttttcttaaattaggcagataaaattataacttattggcattgtccaggttatcatgcattgattttcttctttcgatctctttgaagtcggataagtatttttccacttcataggcagggaagctcagcccgactcccctgaggtatcttggctagttacccatgagatctgaattccatgttcctggtacggggatttactgctgtcaaactgtcaacattaactacatcattcatttgcaaaatacattttgagatacctgtgttatgtcaaaggtcacttggagcccaattgaaaggcagtgtgaaaagcataattaacttgtttgcttttgtgctggaaacctagtgttaacaaaacagcccaaccaaaagcagatttgtcattagggctctaactgcctgtatccctatagtgtatgtgcatctgtttgattttccagaaatagatgaaatcatagtttgaggttagttcatcaaacatcgaacattttctttgtgtaagtcattgtattagggctgctgctggtggtggcggtggtcatgaggtagagtgggatccaagctgagtgacagtgttgcgtggcagaacacgttgattaatcttcagcaggaatatggtgtatctagattctgtggcagtcatgccaatgaagtagaaatatctttgctggcagacagtgatctccaggatatatcagtaaatttaaaaatggtaatttatatagcgtgaacccattaatggaaaaagctaatctatatatttctacatgccatgaatgtttctactgctatgaatacatagcatatgtatacatgtaaatgcatagaaaaaggactgcaaataggccaggcgtggtggcctgtaatcccagcactttgggaggccgaggcaggcggatcatgaggtcaggagatcgagaccatcctggctaacacgatgaaaccccatctctactaaaaatacaaaaatttagccgggcgtggtggcgggtgcctgtagtcccagctactcaggaggctgaggcaggagaatggcgtgaacgtgggtggaggagcttgcagtgagccgagattgtaccactgcattccagcctgggtaacagggccagactctgtctcaaaaacaaaaacaaaacaaaacaaaaaatatattaaaaaaagaaaaaggactggaaatatgcacactataaagggaaagtgagtataattaaatttggaaagagaattttcagttttccagtgttgtttgacgtccctacaaggagatgtttttatgtgtgattttatgtgtgatttaaaaatatgaaatagtgtgcataggtggggaccttcacgccgagggagaaaaaaatataagcaaaggcatcaggatgtgaaatggagtagtttattagtatgcagtttttacacataataatgagaaggatggtggcttaatgtggcttatatagtcctaaattattggttgttattcagttaaggtaatgacatgtttcagtaggtttttaagtgagttaggcagatacaactctggaagccaagtagttgatggatactttggttggaaacctaattgatttttacatagcctctccagagccagcaaagccagatgctgctttgtggttattcttgagatttttttccccctctaagactatacagtgtttgccaggcaggggaggatggtgaccagtttgtatttaaaaaaaaaaagaaacaagaaaaggcacacagccatgctgctggcttaaagtctgttacctttcccaaagtatatatattctgataaaatcggtgttgtctccatatgaaaagtattattaccctcctgcaagcttgctttaggcactattctgggtagaatagacagacacagatgtttagacagactgaatctctttctctgatttaattttgcattacaggtaaacgccatatgtaatgtgtaagaggcgggtaggtaaacatgctcaactgcagtttttggttttgtgttccgatgtgatctgagtatttcgaagcacttataatgcagagcgtactatatgaaagttctcatgatttgggagcacactcatagtaagggcaaggaacgttctttcacattgaagttctaaaaattaactgtctcagtaataagacttaagcaaaaacaaagtaagactaaggaaaagatgataattttcaaatgcttgcaaatgggagcctctactccccatgtttgtaaaatgttttaccttatcttccattcctggcattaggagtcattttggttcggggccatttattgaagctgatctttaatgaatgaatgagaccctttattttccagtgatgctgctttatttttgggaagtgggaacaaaggcctgacatgctaccatgggtataactgtacaaatttcaatgttatttgaagaaatagacatctaaatgaagaaatacttttagttgttgactttaaaaggtacaaattatgctgatgattctgtttaaaataactagatcatttttctttagagcaaaacagacaacactacaaatctctgatgtgtattaagttttcctgaaaggtaaacactatttttttttttaactgtctcagcttttctattacatttgtgtgtgtagggggagctgggtacaaagagaaagcatggtgaagatgactcagaacaaaatgggtggcgtttgtaagacacagggaattgcctttgaagattgttggcgtgtttatttatgctaactcccacgatctgaaaaaatagctgtagcaggctcattactctgtggaaaaataaaattcatttgacaggattaattcatttgaaacccatgtggttttcaaggatctttaaaataacatgagatattacagcaatccttactttaacattttgatctaagcaaaggcatgaaacaatttaaatacacccagaatatgaagttttaaatgttaccggaaagtgtcttttcttgacaatactggaacattttggatgttatgaacaggtgcaaaattatagatttgtgttttcaaacactatttgtgcgaagtagaatccatgcaagaaccgattttaagaaacaagtggtgcttcatcatttccagaaatggagaggaattacaatatgcaaaactaatgataatagctcacttattttaagttctttttatattcttgacactgtgataagctctctacatatattatttcatttattcataacaaccctatgagaagggtataattattatccaattttttttagggaaggaaaccaaagattataaaagttaacagctaataagtaatgaggccagtatttttgcttaggtggtctgtgtatagaatccatgctcttaactattaggatatgctgattctaaagcaattaataaatgttggtctgaaatcagtctaatggcacgctggaaacagctcttagacactgccaagggttgattgttagatattttggatttttgtaagccaatttgtaaactttgatactttgaaatcagcagtgattggagtatttacaccacagaaatgggcaaatgctacaaatcaaggcattttttttcaagtcagttcaccagcacaccatttgataacatagcgccctttcagcagtgccaaagtataagccctcacattttaaatggatataaatgaaataaacacttacattaacagttttttttacattagcatttgtcttgatctcaagaggacagactataattagtatggttagaactttaaaaatgaaatttaagagtatgtattcctaaattccagagtagaagagagtccttttcctagcctttgaacttttatatgaggattttagaaagaaagcccttgtctggccaactgcagactttaaatgcagttagctgtgccagatttgagaggactctttgctggctgaaattgtctgagcaggaatggaaagtgattgggttgggtaaacaggagcccatgataggaggatggcagaagccagagaaggaaattttatttaaaaaaaaaaaacaaaacagaacaaaacatgggaaccagtggggtttgtgtggtctgagtaagctttgtggccttattgtgggcatcatttatccataaaataattttagctttaatttgagaactctagtacttgatttttccttgtaaccataaagcatcattttatgctgtgatgaaaaatcattccaatggtagaggttcaatttaataaaaacttaaaacagtgtaaattgtaatgtggatgcattgcatcagcttatcaaatttatcctcccagtgttctttttatgaagaaagcgtaacttgcttacatgttgtgtttaatgtatttgtaatgttcttctgatatgaagatcctccattgaacatttgcttgtacctggttggactgcatactggatcctgcttgtctaagcgaaagcatacatgattaataacttacggttctaactcaccaatcagttctttttcattatttattatgatttattggaaaacatttccataaactgaaagaaaagaaagaaatgcattcacaatttaatcatccaaactgaattttcttcctttttttcaattttatttttattttttgagaacagggtcttgctctgtcactcaggttttcatacagtggtgtgaccatggcttactgcagcctcaaactcttgggcccaagcattcctcctgcctcagccctctgaatagttgggactacagccatgtgcctttttttatatttaaaaaaaattaaggcctggcgcggtggctcatgtctgtaatcccagcactttgggaggccgaggtggggcggatcacgaggtcaagagatcgagatcatcctggctaacatggtgaaacccccatctgtattaaaaatacaaaaattagctgggcttggtggtgcatgcctgtagtcccagctacttgggaggctgagacagaagaattgcttgactccaggaggtgtaggttgcagtgagccgagatcgcaccatcgcactccaccctgggaaacacagtgagactccgtctcaaaaaaaaaaaaagaaattaaaacatatatatgttaatatatgggaaggacaagtactgctctcctacgtgcatatattgtgtagtggtaagtctgggcttctagtgcacccatcacctgaatcgtgaacagccagtcaattcttatcctggttccttcacctcctgagttgtgattttgagaatctgtggtgtattgattgagatagcggtttaagagaaagagaaaaaaagaaaacagatggaggatgaaaaaataaagcaatacagatatacacagaacaggaccaagttagaggcaaaatatagcatccaacttgaataaaacaaagtaatcgctactttgtggataaggagaaacctgtgtttgggaatattttatactaattcagttttatatttgcttatctttaatattaatttgagacaactattatttttctgttctttaatttttttatcagcaaactgaatggtaagttagaaatgaatgtatgagagtcagagaaatctggattttaatccttagcgtgaaaattttataactctgtgactttggaaaaggaatctaacttctctgtttatcctgttcacacgagtgatagtaataatccttactatagatgaccacaggaattatagatacagctcccagggcaatgcgtatcagagtaagctgtgtctccttacattttcagagctgttattgttgctcaataaatggcagctgttgttatctgtgtttttgttgttgttgttgtttttgagacggagtctcgctctgtcgccaggtctggagggcagtggtgtgatcttggctaactgcaacctctgcctcctgggttcaaactattctccagcctcagcctcctgagtagctgggattacaggcttgtgccgctgcgtctggctactttttgtatttttagtagagatggggtttcactatgttggccaggctgaactcaaactcctgacctcaggtgatccgcccacctcggcctcccagagtgctgggattacaggcgtgagccaccgcacccggccactatctctggttttttaaaatgtattaaacatgaggagtaatgacagtgtttcttgatgactggggaacttgcagtagaaagttgacaaatactgtttctatgaaagaaactggagcctcctaaggtaagctgggtctggatgcttgatgaagatgatgctgctgactgctcttcctctttctgtgcagaatgtgcccccagacctctccatctgcacctttgtgctggagcagtccctctctgtccgggcgctgcaggagatgctggctaacaccgtggagaaatcagaaggggcaagtacccaatttatgtagacttgtagtattttaatgagctcagctactataggaacaatttctttcacaggtgtcagagattttctttttgctaaaataagtccatgcctttcagttggaatgtccttaggtttgactttctgctttatctagcatatttgtggtgtcttgaaaactaaaaaaatatatccaagcttgatgtgatctgtgtcactaggcctcgtgcttatgtctgttgtttaaaaccgacctttctttgagcgtttctgtgtttcattacattttcagagctgttattgttattattttaactcatagctttatgcatggctatttgtcattaacctttatttcattttcaaatgtctgtcactatgtgactatgttctgagctttttcatggaaagtaaaatttcatggcactgttatatattttaagtaaccaaattttggtgatatggctttaggctattgtaattttgcaaacagctaatccttctcctctgaaaattgaaatttttcttttcttttttttgagatggagtctggctctgtcacccaggctggagtgcagtggcgcgatctcagctcactgcaagctctgcctcccgggttcatgccattctcctgcctcagcctcctgagtagctgggactacaggctcctgccaccaccacacctggctattttttttttttttttctatttttagtagagacggggtttcaccatgttggccaggatggtcttgacctcctgacctcgtgatctgcccaccttggcctcccaaagtgctgggattacaggcgtgagccaccgcgcccagccctgaaattgttatgtggtttcctaatgcaagtatttttctttcaaagcctatttggttattttattttcaatgagacttcctgtgactgatatctgggctgttacccagtcttaaccaatttattaaagtttagaattaagcaggaggattaatggtcaaattttttgtttccaggttttttaatttttattttttggtatggtaattactgcagtgtatggtttaataaagtgtagtatttccagagagaaaactgaaaattttattttgccattattgatctatatgttgctgttgttattaatcattactctggtctggataaataaagagattaaaaaatggtaatatataaatgattatccatagaaaggagtgatcagttataacgttattttcatcagccttgtagtttttaaaattttagtgtcatgcagcttatgactttagttgatttgtgcattaattctaaattaaatttcagcagtgtactattaagtagggaagagaaactttagtgacttttgatattagactagaagcttattttacaaaagcttagtattttagtttttcaggttcattttttgtttacaacaaagtttgaaattattaaaatatataaagtttcttttaaaaatttctattctttcatgtaaaccttctcagttatgcttaagttatgaaagagtaaaacaattctcaatttagtttcatttctacctgaaataacccctcctgatttttaaacatccctgagtcatatcaactttgatatgcaaatcagcttttataaagaaagatcatttttatttggcattagcatttaaaaaatgcatcttgccatttcatctgtctttatagataacaacttagaactaaattgccataaatttaatttttttattgttaagttgcgttttttaaatttaacaactttgagaagatcttttatcttcttcaaatcatgaggttgggctgggcaaattctaaagtttcttgaaatataggaagtaatttgaaatactgttttaggatttatggtttttttgagatggggtcttgctatatggcccaggctggtcttgagctcctgagctcaaacaatcctcctgcctcagtctctggaatatctaggattacagatgcatgccacagtgtacccagcttctaggatttatgttttcaagacatttattagttagaatttctggatctcctcaagtatttttatttagctgaatttagttttgaattgttcactctctagaatgtctccatcacagataaagtagtaatttgtgtgatgtgttgaacactattttataaagcgcagtatagttaccataagacatgaattaggaagtataatttgaggaaaaactgctacaaggaataaacacattgcatgaagctgaaacctatttctggttattagtaacttttagaaagaaaccaatgtcaaatagctcaacggggtaccgtatattagggaaaaatgaaagtttctctcatactgctgagtatttttgattatacccagaaatgatattcattcctagcttgccacaggtgatgccagttaatgagcacagccccagccacagcgttggaggaggagttctggaggcctctattgtatttatggatttggaggtagcccgagcaacggggggtgtcctggaggacccctggggtggtcagggttagggagcactgtggggacttgcggcagcaactgtttaccaagaaggatagatattttccacttaaccattttattcataaggatgtgcaccagctagatatcatgtctgatgatatgtgactcatggatgctgctggcacttgtaggaaccaagtcttctgaactccaaatatcatcttttctagtgccttataatgtcccctttacactcattatggaactctaatggggaatttttttatcaatcaaattactatctccaggttaataaatcatgtgtagtttgcttaaatgaagagccacttttcctaggatgaagtgtgtcaggaaggtaatgtgaattttcaagaaatcatttctttcctttcagatgaacagtgagtcaaaaagaacctcgtgttgccctgattcccaactctttcataatcaactttctttacgaagccctgttcttttttatttaataattcttctttaatttcttacgtaattcagtaaattaaacaatacttatactatttcatgtccaaaatgttatatgcacatagcaatacaaacacacttgatgataaggaaaatttttccatttagaaccatgcctttgttttttgtggttaaggaccattttgctagtattcttgggtcatgaataaatacatggttttcataaaatggttaaggaaacttagcagaaaactcccaatgtcatttgtgacaaagtaaatcatgaacattacgataacagaagaagatgtgtaagatgaaatgggagaaaatattacctaatgtatgaagttttggttccctaaaaagttgcttattgtgactattagtaaaataactcatatttttgtggcaccaaaatcattctgaaggatttcatctaagtggattttctaaaatgtctgtttaattaaaatatatatatatatatatatgttaaaagagagacctagatccagtatttatataattacattgactatcatttagcttttattcttattaaaatcatgtcaatagtaaataggccaagacctgtctatctcagtagctgcccacagaagctttcagatcttgaggatggagacagtacacaggcaacgagaaggagaaggtgtctgttgagcagcaaccatctctttggccccgttttctctgggcgtctgcctatgcacattctggcttctgctgttctttctatttcccccactgggttttctgtggttctggataacttgtcgcttgcagatctacctctgtattgctcttcttgctcttcagatctattttgcgtatggatgatatagcatagggttaaaaacaggggtttattgtcttagagaactgcttgagaataccagttctgccatagttagctctgtggctttgggaaagataactttatcatcaaggcttagtaattattaaatgatggtgcatgttattattgttttatttattcttttttgtatacttttaaactccctgggttggactgctattaattcctgactgccttttctctgggcttgatggctttcttccttctctgggacatagccagtccagttcccacttcctcccctcgaccccagtattctcatcaatcctggcacatgtagtttgccgatttaatgatgccgcagcagtgttagaatagagagttgatgatagcatttgcttgtttccatgtgttttgtagttaataaagtttcataatttaagtaatattgtgcttttggctattccttttatcttaattcacaaaattatgatagacacttttctctcacacaactttatttgtaatgccaaagttaatttaaggatttcatctcctatgagcacagatatcaagtgagaggtgacgtagtatagtagaaagggctttggttttggagtccaggaaatttactgaaagttctttttcaaataatatttataataattatcatctgttgaaaaggcgttgctttggtttaatgccatgagtccaatatatggcttgtatattctgttgaggacagcgtattttaaaatacacgttgagtgtcctttctgtctttcgggtgaattatttctggggggattgtaggaccctgtccttttcaactttagcttatggccacttgactgggtccctttattattagaatattgtagattgaactagagaaaaaattaaaattaatcattctttgctccttacatcgtgctctttgatggagtaatagattaacatttataattcaggtgattatgatttggatcattcattcatttgctatataatcctcatgatcgtgggtattggtagtttaccgctatgtaagttatggatgatactttaaaaatctataaaattcacaatgtaatgttataaatattgtgatgagcaaataatattgaaatgaatattaaataaatccaattctaatcatttggtgctttttcaacatttataaggtaacttatatcttataaaggttctatgtatagaaatttaagtgtttttttgtcatcaatgagtttacaactgcagggatagaaaaacaattatagtataatttcatgtatgttatagaagtatatataattatcatgttggcatgaagaaggaattgtgtacgtggaacttgttgttcctttacattttcttggcactttttagaatcatttccaaaactattagaagtaatattaaaactattaatagaaaaatcatttcaaaattttttccaaggaacaatttgagctcattaggcaattccttaaaattttaatagaaaataatacttgtcaggaagacaatccaaaacatgtccagagatattcttaaaatgatttttatgtttcagtttagtaaaatggcttattgttttataagaaactgtaatgatgtttcctctttctaaattatgtactgtcttcaaagtacaaaatattacaatgacttaattattaacagaggtatagatcagactcagacatgtccagcttttatgaaaaatggagctgtagaatgtggagtagtaaaaaacttgtgttggctgggcacggtggctcacgcctgtaatcccagcactttgggaggccgaggtgggtggatcacttgaggtcaggagtttgagaccagcctggccaatgtggagaaaccccgtctcttatgaaaaatacaaaaattagctgggtgtggtggcgcacacctgtaatcccagctactcgggaggctgaagcaagagaatcgcttgaacccaggagatggaggttgtagagagcagagattgcaccactgttctccagcctgggcaacaaagtgagactccatctctaaataaataaataaattaattaattaattaaataaaacacttgtgtcattctttttataaaacccctatctctttaagacatgtactctaagaacattcaaaaatgcatggggctgggcacggtggctcacacctgtcatcccagcaatttgggaggctgaggcatgtggatcacttgaggtcaggaattcgagaccagcctagccaacatgttgaaaccccatctctactaaaaccacaaaaaattagccagacgtggtgacacgtgcctgtaatcccagctacttgggaggctgaggcacgagaatcacttgaacccgggaggcggattttgcagtgagcccagatcgtgccactgcactccagcctgggcaacagagcgagtatccatctcaaaaaaaaaaaaaaaaaaatgcagtgggaagcaactggctaaatttactggtaaataaattaaaaaaatacatttgtgaagcactgaagccccataaattactttttaaaagtacatttatcaaacactgaagctccaatttcacacaagtaattgcatctaagatcattttatataaatgcaagagcaaaagatgaagaagatctgtgtattatctcatagtggttaaagctcatagattatagtacaaactccctgagttcatttcctggtaacataagtgacttaacctttctgtgcctcaattttctcatttataatgtggggaaaataatagcatctccctttgttgtgggaatcaaataatataagtaaagtgtgtagaacaatcgtggcatgcaagaagcactatgagtatgctgtcatcattgtgatggtctctgcattgagtatgcctgagtaagctcctatcagatctgatccttctgaagaaaataactataatctctggacaaaatacaaaaacaaaactacacccacaataataaaaccttcaattacctgaagcccctagctatagttgctctatggccgcctttacaagttaccgctaagttggtggcttaaaacaacatacatttattattttctagcgttagaggtcacaagtctaaaatcaatctccattggctaaaatcagggtgttggcagcactgcattgcttccagggactctagggaaaaatctgtttccttgccttttctagcctgcattcttggcttgtgacccatcctccaccctcaaagccagcagtgacctaccatgtcacatcgtcacaggtgccagggattaggatgtggatggttccggtgtgccattatgtgggctaccctatcatggatgtgctgagctcgagtaagatgttattgacaagatcaaatggaagtcagaacaatctagttgaaaaatgactgaaaagtctactttttgatttgacaggagcctgattttcttgcaaaccgatcaataggaatttcagtctgtcttatgtacataccaatttatagattcacatacattttgtatttaacgggcttcattctctgaaggttttctgagtttccagtagttaatcacatgatttagaatttaaatttaagtatattttcatattgcatgcatagtagacactaattacttttaacaataacattaatcaaaaataactaaaaaaatgaggatatatataaatgcaatttgttgagttcctatcgtattccagacaggcatcttcctaagccatgaatacaaaatagtgagtgtggtattatttttctttgttaatagcagcctgttcagtctttggctatagtctcttctgtgtcaggtaacagtatttgaagtatggtcacagttccaacagtagatcttcatatttcttttacatcctcattcttctggtattatggtatctgctcagaggcactacatcgtaaagccttttttgttcaagctttagggcagatagatcaaggatcaaaatgaaaagagttaatgttgtgtccacgctagttgagttttatattaatgatttctttccattaaagcacattggggtaatgtggaggaaaaggagttgatgaattttgtagttcatatgatataaattgtgttctgtatattattaaaagtaaatttctcaaatggcagggctaatgactcactggaaaaaaatgaggtttaacacttgatgttcatccattttcaaatatgctctgtatgagtctccattaagtctctgtataagtcttctgtattttaattctgtaaaatacagaattaaactccattaaaatacagaattagtatgtaaaactgtgaccatactttaaatagtgtaaatgtagagatacctgccactgaagagactatagccaaagaatgaacaggctcctattaacaaagaaaaataataccacactcatcatgttttatttgtgtttcaggaagatgcctgcttggaatatgataagaactcaacaaattgagcatttatatatatcttcatttgtttatttagttatttttaattaatgctattgttaaaagtaattagtgtctattatgcatgcaatatgcaaatatacttaaatttaaattctaaatcattgaaatgttttatttttataacagtaatatatgagtataaaataaaaatgccctcttcatagtcctcattcccccctaagataaccacagctaaaagattagtatatagccatctataactttatacataaaaatattattatataaatggaatcatatactgtcttgtcatcttttaccacctaattatatatggtttttaaaaaatcaggacacaaaatgtccagaggaagagaagattcagatttagttgatccaagctctaggtgagatttctgtagttctctttgccctgttctgtgtttgcttggttcacaggctagcttccctcatgattacaggataccttgtaggaatttcagggatgatatccaaaggcaacatcatctataggcacaaaaaggagctgactttctttatttctaaaagcaaggcactttccccaggaattccctggcagaatttccctcatacccattgtcacacacccatagctaatttatttactcgcaagagaaaatggggccagcacaactggctccgaccatggggatggcaatagggaaggatactttgaagaactaggttcttttattgggagaaggaagagaactgcatgtgaaaatgaaggtcagataatttctaacattgtctgctacatcatatagcagatacatagttagcatctgtatgctttcactggaaatgtttatatttgggaccctccatgttcttgagccaaactaggaccaacaagtaaaatctttgcctatgaaaacaaatccaactctgtgctcaggtgtctccatgaccaagaaatagaaagcgcatgtccattctccacctgtctcattcgtacagtgttcattcaacaaaaatagattgagttgcttttgtgcattctggagctagggggacaggtatgaataacaatgcctccttgctcttgagaatcttagcaatctaataataaagagagaagataaatataatgtggtatgaatctgctttcatagtaaatagttcaatcagagagcagagaagagatctaattacctacccaacactctccccttgtacgtcctcataactgtgaaatgctgaatggattagtgtgtgtttatattgtagacaatacgatgctactagctatttatatctgaaacttctattctcaaatatctagtctaacttaaccttattttaagaggctgtgttctgttacctacctattgaagaacatccttggtaaagcataaatagtacttcaataattagattataatgccaataaattcacaaatttactaattaatgtaatatttagccagcatcttgtccaaagcctctgtatataaatatttacctacctgtcatctgcaaaattgatgcagtgatgtaatggtgaatgtgattataatctcttgaagggttcatagctaaaaatattcactgagcaacaattatccatctgtcacttaggtgaatgtggaaatttgtctgtggttgaaagatgcatctttcagttttactgcctttctgtttctagaaagacaactttctactcagaagccaaggatattccatatttctaagtatttgaatgacgtggtttccagactctgtcatcaaactcaataaagacgtcaatttaagcaggatgtaatttaatcacagtggcgtagttaggcactgttttagattatgaatcttaaatgtatagattattttatttgattagtctcattcaatttggacatcttcctcagctatttgtgtgtgtttataatagaaaaaattttcatttgtaaacatatgatagcaaataaatgacatggcatatttctgattcaatcttaataaactattctgcaatttatgagtgacttaaagatatgtggaacctattgagtcagccattctcaaacatttttcttttttgagatagagtctcattctgtcacccaggctggagtgcaatggtgcaatatcctccccaaaaaacaaacacaaaagcaaaaacaacaattaacactccttcctgcatttttttggtgtgttttcttcaaagcactgaacaccttctgaagactatgtattcgcggtctgtttattgccttcctatccccattagagtgtaaatctcaggaatgcaggtctttgggtctgtggtattcgcttgctataccactaacatccaagacaatgcatgttatgtactaggtagtaaggaaatatttgctgactggagggactgcaagatggaatttatagaccaaaatcaaggggctgaaaagtaccaaaaattctgtttctgctactgtagtaacagttttgaacatatgatagagcttttttgtctgttaaatacagctgtttttgaattgcctctctattgtgggagaaaaggaatgtttttgaaaggaaaagtcagaaaataaccttttgggttcggtaatcctccatcctcatttgcctgacacagtccaggttaatacctgtggtcacagcataatcactattagttccccctttcgttgtccaaagtgtcccagtctggatgagaaattacatggttatccctagtcatggtgtctttgtgaatcagataaaacttatagaatctatttacagaaggcaatacaaataatatgcacgcatacaaaatcttgtatttcatctctgatttgaagacttaaaagaagtcttcctttttgttgagttaaataacttccttttttttttttgagttaattcttgctctgttatccatgctggagtgcagtggtatgatcatagctctctgcagcctccaatgctgggtctcaagggatcttcctgcctcctgagtagccaggaccacaggcacaagccaccatgcctggctaattaattttttttttttttttttttggtaaagataggttcttggtatattgcccaggctgtccttgaactcctgaccttaagtgatcctcccaccttaacctcccaaaatgttgggattacaggtgtgagccacctcaccccactcatacaacctctttagtgattgttgcagtcacacattctgagaagatacacttttttgcaagtaatccctgaagtgtgagagaagggcaaagaccagcaggatctacataacttgaggattacagagaccagatggaacattctgagagtgagcatgaggtcagtactcgtagtacaaactgattactttcatgtggcttctgagatcaggccacatgtgacccatgacttcctggtgaagcattaagtcttaagaccacgtggaactgtagaagggtcctttgctggaaccagaaaccttagaactgtccttagaccactgaaaaaagtacaaagagcagcgcagcaagaacacacagaatgggcctaatattgccgcgcactgatttccatagccctggaaaatgtgagccatatgtgagacaagaagaacatattgaaagccttgcagtatctgacaaaagagaaaagtaggccaggcgctgtggcccacgcctgtaatgcaagcactttgggagtctgaggtgggaggatcacttgagcccaggagtttgagaccagcttgggcaacgtggtgacactgtctctacaaaagataaaaaaaattagctggacatggtggctaatagccatagccagcatacctatagacccagctacttcagaggctgaggtggtgggattgcttgagcttgggagatcgaggctgcggtgagctgtgtttgtgccactacactccaacctgggtgacagagcgagatgctgtctcaaaaaaaaaaagcatcccaaatctcacacaacaatgaatgagattggacaatgcaaagataaagctaaatgaaagttaaataacacgagagatcacagaagaaacagcagctaaaccagcaaaattaaatacttcataagctggtgttaattgcatttgttcactctattgatatatgatgagtaaccacgttctagattctgtgtagagtaaatagtgagagcgagctgaattgctacagaggcctcttccagaataggacataaatggagcgtgtgcattgtagtgtataaacactcaataagtgattttttttttcagatgaagaaatagaaacaatgtaccaaggtcagcgattaaaaatagtgattatctttacacagtcatggactggaagttttgtttctaatagtttccagaatagaagtatttgtgtgaatgacaattatatgacatgtaaggaaattaattatatcatttattgattcttgaggtacaggctctaaagctccagcatggatttgatgtggatggtactaatgatacagatatttaagttttgttgatttgtatgtagtttccccataagaggttttttgttttttttttttttttgagacagagtttacttctcattgctcaggctggagtgctatggcatggtcttggctcactgcaacctctgcctcctggtttaaagcgattctcctgcctcagcctcccaagtagctgggattgcaggcacccaccaccacgcctggctaatttttgtgtatttttagtacagatggggtttctccatgttggccaggctggtctcgaactccttacctcaggtaatccgccggccttggcctcccaaagtgctgggattacaggcgtgagccaccacgcctggcccccataaggggtttttagttcctcgggaaactattcaagcattggttaggaagaaatatgtgcagctgggtgaatccagctaatgatcggattattctcatggcgttttgccgggggctgccttgatgatgtcttcttggatctaggtctttaacttgtctgtaactattgcacgctgtccctccagcagaccgttcctaatttaactgctatcctgtgacctcagttcttacaaaggaatctaaaactgtaacctttctttatttctggctccaattagttctttatactattcgttctctatccaaactgaactcactccctgaatatgctacacttaattcaggtatatattctccacattcttactacactaattcctcaacctagaattctgagcctttcaaaagtttaccacccctcgcttctctgcaaatgtccaaggagttgtcttccttaaacactttcatgaagctcccagccagaagtaatatttctactcgtagagttccttatcactgggtgttcacattttcttatttttgtctctcattttatatagtgattatttggtatgtattttatacattttatttacattagaatatggttttgttcaatgtccattctttaaccaacaccacattgtcttgattactagtagctttatagtaagtcttttttatttatttatttattttttgagacagagtctcgctctgtcactgggctggagtgcagtggcaccatcttggttcactgcaaccaacctctgcctcccggattcaagcagttctcctgcctcagcctcctgagtagctgggactacaggtgcgcaccaccacacccagctaatttttgtatttttagtagagacggggtttcaccttgttggccaggatggaatccatctcccgacctcgtgatccgcccacttcggactcccaaagtgctgggattacatgtgtgagccactgcgcccagcctgtagtaagttttgaagttacataatgtctgtctctgactttgttcttctccaatgttgtgattattgtgggtcttttgccttcccatataaattttaaaatcagtttgtaaaaatctacaaaataacttgctgagattttgattgggatgcactgacttgttagaatgtgtaaaaatttttctgtattcctctgtgtacctgccagtttttcatagtatatagatctaaaatgtaagactttattatatgaaatttattattcataatagatctaagcccaggaggtcaaggctgaagtgagtgctactatattccagcctgggtgaaagagagagactctgccaaaaaataaaaaataaaaaataaaaaataaaaaaaaatatatatatgtactatgtacatatcctgaggatttgaacaaattcagaaaacactgaaacagtattacatgagctggaatttatttaagagtagtaatcaacttgatttttttctattaattttagctaagcaaaagttccatcattattcatgactgatgatttctttccttatatttattgtgatgactttttaatcatacatttaaactaatacacattcctagaggtggtactctaagctgaatattttctaacaaagtctatctattattatgtctaataccacatttatcactgtattttagaaatgtttaatattaagattagtccccctcattcttttcccctgacccccaaattgttcttattcttcttgactatttatctcccaaatgaaattacttgtggtatttaatttaacttagtaattctgataagtagcctccatggaagagacttactgtattatttacttagcacccatccatccacttgaatttgttaacattaaggtttatgcaacagccactttaacgtattctgtacttagagaaaggagatattgataattttgagttagtgcatatccaggctgggtgcggtggctcatacctataatcccagtactttgggaggctgaggtgggcagatcacttgagcccaggagttcgagaccagcctgggcaacatggcgagactctgtctctacaaaaaaataaaataattagccaggtgtggtgcaacgtgcctgtagtcccagctacctggaaggctgagaggtgggaagattgcttgagcccgggaggtcaaagctaaagtgagtgctactactgccactatactccggcctgggcaaagtgagagggtctacctcaaaaaaaaaaaaaaaaagtgcatatcctgaggatttgaacaaattcagaaaacattgaaatagtattacatgaactgttcctattctaaagtaagattaatttaggaagtagtagctcttagttctttattacctagtttaaattttaaaagaaagcatttatacttaagaataaaatttctaaaccctttccttgtattgagttgtatgtgtgttagtgtatgagattgctgagtttattgtactgagtcggcttcattgtatgacagatctaaaaaaactgggagagttctgcctaatactgcaaaaccagagtaaagttaggaaattgggctaatgtttaattaagtcaatcactggccttacttttgtgcttcatttgctcaattacacttatggtaaatttctttctcgaactgatggagaaaagactttgtgatctcatgccgttaaagtacataatcccatatgatattacagtatggagagatgcttttctttttatttataattctcccacattaatgtcatgtctgtctgttctaatttagtgctttgtatttttcattttaaaagtacctggtctgctcctgtgaacatttaggtagatacctcagtttgaggtcctgtgagtctgtgattctattatttgtaaacatgtatgaaaatggaaaagaggttgggcatggtggctcacacctataatcctagcactttgggaggcaggaggattgcttgaagctgagagtttgagagcagcctgggcaacaaagagagacccctgtctctacaaaaaatttaaaaaactagctggacgtggtggtgcgcacctgtagtcccagctactcaggaggctgaggtgggaggatcactagaacctgggagttccaggctgcactgagctatgattgtaccaccctgggcaccaaagtgagaccccgtctcaaaaacaaacaaacagaaaaaacagagagggaaaaataaagaaaaatacatatgtataataataggttctcaatatatattagtttctttccctttctactttcgggatgaattcactgcttgttgaaatgtaattgactgatctaaatgctgatgttttaatgaaaagtatataatgtggatttcatttaattctgtcctaaatgacagtttgacgacatacttaacaaatccctaggcaccaaggatttggggttttgttgggaagaaaacatctaggccagaaacgatgtacttttaccttgttttgaatcttttattgtttggatcagacctcgtttaaaaatgtagaggaaaaatttaatagttccatttctacctggaaatactacctagaaatagtattagtctattagtagactaatactccagctgtgggaaaaacaaaaaacaagcaaaacacccaaacctcccccaaaccagaagttttaaaaggattaaatttaaaggatttaatcagaatatattaaatttaaaaggaaatatgattgaggcattagaaacttctgaggtagcgaggacttgaagagacctaaatcccagcagtaagagaagtgcactgaggtaggtctaacattttttataccacttttccctttggggcatttgctgagtattcatttgggcagagattaaggcagaggagcctgcaaagtttatgtaatctctggcctgacaacgtaggcagaatttgaggatacaagatcttgaaggaaaaagagaaataaggcttacactctgaagaggctttccccttgaggtatttctctgttggtggtgacgtttttattattattattacgagacagggtctcattgtccaggctggattcgaactcctgggctcaagcaatcctctctcaagtagcttggataactggcatgcaccactattccagatcatttttctgttattagcctttgggaaacaagctcagaagcttagcagaaagcagatcaaaagctcagcagtatagtaagatgtgactatcgattctatgaaacaatactaataatgtctcatgaggcctaatcttgtgctggggggccaaaaattgtatttcagtggttgctaaggaggaggggttttgataatcattccaggctctcagttggaatccttggaagttatgattactaggagagagggtgaactaaagtcttgctaagtctgaaaacctgccttcaatctactcagctcacattgaattggtgttatctgcccatcatctagctgccagccgtaggtacatcttttctggaggaagaaacagaattagcttgtatacaaattttaacacagtatctgatgtgcagtcaaacgtgttattaggcatgtaaggagtcaggatcaagagaaaaaagatctgacagtagaaatagacccataagtgatccagatattggaattatcagtcacagaccttaaaacaattggggaatctacaatgaaaaaaatcaaatggaaattcgaacactgaaaaccacagtaagtaaagtaagaactcagaagattagtttaacagcagctgggacatagttgaagaaaggattcatgaactgaaaaatagattagttgaaaatatccagactggcctatgtggagaaaagaacattaagaataaagggaaaaaatcataaaagatgcattaactgtagtaataaaatctaacatgcgagtaactggattcccaaactgtgatggatttggagctacaatagtgagattcaagattactgtcaatcctaaggaatattaatacttataaaaccacactgggttaccatagtaaaaatgctgaaaactagaaaaataaaaaatcttaaaagtaactggaggagggaacaaaatttaaaagctgtaataagactgatacctgatgacacattagaaaaagttgaatcagaagacaaaggcatgatatctttaatgttgtgaggaaaaataatcactaactctgtattatagccagataaaagtatacttcaaaagtgagagtgaagtaaagacatttccagacgcatacaaattgagataatttagatacaggagatggggttcttcaggcagaaaggaaatgataccagactgaaaagagtaaatgcaggagggaaagaagactaagtaaatatatggccaaatgtaaattaatgctaactatacaaaataatcgtattaatgccttgtggggtttaaaatatatgtgcaattaaaatgcataacgataataactcaaaaggtggaagagtataaaattgtcaaccatgttcaaagatcctttttctggaacaaggtgaagttactaatttatacttataatgaaagagttaatcacaatggaagattattaaatgtcatggatgcccatgcaacctctagggtactaaccaaaagaataagaaagaataaccaacaactttccagagggaaaaatgcaatatcaagatatttgattaatgtaaaggaaggaagaaaggagggaaaagaagtaacatatgggctgaatctgttcttaaattagattatggtgatggttcatagctgtgtaactataccaaaaagcattgaaattgtgtaccttaaataaatgaactttatgatatgtaaattatatttccataaagctatataaagagaacatgagaccaatataatacaaataatatgaaaatatgataaatataactaataaatataaactcatattttaagaataaaactaaatgttaattgactaaatacttcaatcaaaattcatggattgtcagattttattaactgcaattgtatgctgctcaccagagatatactttaagactgtcttacagaaagagtaaaagctataggatggtaaagttgtatgtgtggtaaagttgaatctaaagaaagctggtataactatgttaatatctgagaaaagggctgggcgctgtggctcatgcctgtaatcccagtactttgggaggtgagtggatcccttgaggtcaggagttcaagactagcctgaccaacgtggggaaactctgtctctgctaaaaatacaaaaaattagccaagcatggtggtgtgtgcctgcaatcccagctactcgggaggctgaggcaggagaatagcttcaatccaggaggcagaggttgcagtgagctgagatcgcaccactgtactccagcctgggtgacaaaagtaagactctgtctcaaaaaaaaaaaaaaaaaaaaaaaaaaaaaaaatatatatatatatatatatatatatatatatctctgacctctgagaaagaatttagggcagaaagtattgcgagaaatcaagatggacatttccctatgttaaaaaaagtcagtttataagaaaaataaaataattctgaatttacatgaatctaatgatatagctttcaagcttataaaaacaaaaattgacaaaattatcaggagatctcaatcaacaatcaatgtataagaccatccttctcacagtattacaataatcaggcaaataaatgaatgaggatatagaaatctgaacagtatgattaattaacatatgtattgacatttatagaacacagcaccatatgctgagaaagtacacatttgtttcaagtgcagatggagcatttaccaaaattgattatggaggaagtataagcaaatttcaaaggtttgaaataagagtgtattcctttctcatcacataattcagtaagaaataagtaacaaaaggaattgcaaatccataagcctatgaatcaacgagttaatcaaaatggcaaattataagatattttaaattggataatagtggaaaacatggatacagttaaaactgtggatacagttaaaactgattagaggaagttattcggccctaaatacataagaagaactgaataatcagttatctaaatatctcaagaagacaaaaagaaaatattaaacctggaaaatgtagaaagaagaaattatgaagtagaatttatgtagaaagcagaatttatgaagtagaaagaaatataaatcattcaagccaatagctggatttttgaaatgactaattgatgagcccttggaaagactgaatacgaaaaagagagaatataaaattaacaatattagaaatgaaaataggaaatcactgcagaacctccaaacaatgaaaagataataagagaatactgtgactagctttgttccaaagaaattaaaacattctagaaacaatatagtgttagcgaaatacagtttaccaaccctaacactagaagtgggaaatatcaactgtcttatatttattaaatgaaatgaatttataattaaagccttctcacaaagaagtccaggcccagatggcctcactggttaattccaccaaacatataaggaaacaataataccaatcttaaactctttcataatacttcccaactgattttatgaggccaacataaccctgatcctaaactatgacaaagaccatgcaaaaaaaaaaaaaaaaaaaaaaaaggtatagactaatatttatcagggactgtaggtgtagaaatcctccacaaaatattaaaatattgggaaatccatcccattgacatatcaactcaatagcctattacaaccaagttgggattcaaaaccaattattgtcacttaccttattaagataaaaaaatatttattttaacagatactataaaacatttttaaatattaaacacctattcattgtaatattagtaagtcggcatgtaagaaaagttacttaaactgatagaaattatctatcaaatgcaaaactggtgaaatattgaattctttcaaggcagtgttgaataaagttggggaaagtggatacttttggaattaaaaatgagcttggcaaagtcacagctcactataaaaattcagttatatcagttatatttttatattctagtaaaaagcaattacaaaataaaaataagtgatttcacttatattagtataatgaaacaacacatacctaggaataactctaatacaagatgtgtaaacctttacacagaaaattgagaaacattttgagaaaaataaagatgaccttaaaaaaaggataaatataccatgttcatatattgggaggctcaatattacaaagatgacagttctcttccaattgatcaggtagatcaatgcaatctcaatcaaaatcccagcaggttttcttttagtgtgcatgaaagttggaaaagccagttctaaatgaagaagagcaagattatcaaatacaactttgaagaaaagaacaaggttagagtctttgactcctggatatcaagacttattttaatgttacaataagaccgttgggtattaggacaaagacagaaaaatagagcaggatagagttcataagtagatctgtacatttgtgtcttgatgcattagtaagtgacaatgcagtgctaatggggaaaagatttattttttaataaatggtcatttggataggtatacaagggtgggtgaggagacaactcttaactccctccctaccatcttacataaaaaatcaataccaggtatgtcgcaactttcatgggaaaggcaaaataatgaactttctagaaaatttagtagctttagtagcttcgtgtcattttattttgttgttgaagatttgcgtgtgatacatttatatgtcatttgttttctagtatgtaaaatgcagataataagattacatgtaaaatgtatggctcaaagcctgccacatggtaactgctttaacttaacagaattatccatcttaaacagtaaaataaagttaatcaatttgaaagaagcaagcaaactttttttaaaaaagtttatggaatagttcatgtttatgtgccctaaatttgtaattaaaatatgaatgcacgagatgggtggatcacttgaggtcaggagttcgagatcagcctggccaacatggtgaaacaccatctctactaaaaatacaaaaattagccgggtgtggtggcgggcacctgtaatcccagctatccaggaaactgagacaggagaatcgcttgaacccaggaggcggaggttacagtgagccgagatttcaccactgcattccagcctgggtgacagagtgagactccgtctcaagaaaaaaaaaaaaaaaaaaaagaatgcaaaaatagagatgtcatttgaattatctgactttcatatagtgatataatttaaaaataattacttttatattagattcttatgtcctctctgctaaatcaagttggtgtttaaataactgttgtttcttttaagggaaattttgtttttattttgaaattttgaaatgaaattgctctttttattagtgttaatatgatagatatttaatgtaatttcctgcagatattaaaatagtcattttctttaataaaatccacatatatttttaaaattccacatacttgattcaagtttttggaaaaaatgttcctttgtcttatatgttttatgggtttgtaattgcgtaaattctaaaattggttaagtttactgtgaattttatatttccttgtcttgattagctccatttgaatcattctccttttcaccgtttgcaggaatttaaatgattcttgtcaacaagaacaagagacgtgtcatgaaatcgttctgcattgcttatgcataattacaactttattgtatgttagtcagtcttttaaccctgtggaccatttgtcttgtcttgtgtgtctagctgataattcactcccagcaatgctgttgctaagcttttctttgggtatttggatattctgtttgttacattattgctcctaattcttgcgccttgaagaactgtgtcttttgtaatatagaacattaaagagctcctgttactatcattagtaactatgactcttgattataaattctttcttctgaaaaaatcccataactttatctttgcactgatgggagtgtgtgtgtgtgtgtgtgtatgcatgtgtgaatgtctgacatgcagaagtgaacctgataatggcaaaatacaatgtctttgataatcgttgatagcactaaaaatatgcactaaatatgcactaaaatagcaccaaaaatatggcatattctattttcctgataaatattaaaaggaagtcatttaatttttttagatttttttggggaagagaataaatataaaaattcgcccttttagaggtagaaaagtgcacaattgcactgtgctggacatgccttttttgcttctgtttgccccaggatctaaaggaatggattcatcactccgataagttaatgtttaaaaggagatcttcagctttatctaacaagaaaatatcttgaaaaatgtatagtgaaaatcaggcctttctgttcagtcaagtgtttttcttaaataacaacagtgtgtttgtaaaatgcaaaggaggaagtaagtttagaacagatttttctgaaaactaagtaaattacaaaagaaggcaaaatgctctgttacaagtaacctattggatttcattagggcttcataaaattctgcctgtttatttaggctcatattttaaatatcactttataacatttttgaaataatcactctgtatgttgctttttatgcatattgcttcccaaaagcttgcttgccagagcattggagattcctagctaatagcccaagatttctgcctaagtagcattagcttcttacctaattaatgagttttctaaggaaaaaaaattacaaataaactttcatacatgaagggtgtgaagcaagccacaattcccacaggacaccaattatacattctatagatgggaggtgagttaaggaaacttacctttgagattgagtatgtctctcaatgttgaaattttttattctgatttatttgcaaggaatcctagggcgttgtagagacagtctttgttgacatatggcttttttgtttgttctgtttacagtgtgggtatgattatagtcacttaagttttaaagagccacataatgattaagagactaacattcacttataaatacaactttaaaaaataatttgattcccacataacttcagaactatttgttaaggcatgcctttatattgtgaaattgtatgaaatgctagaaagattagagtaagagaaattttactttaagtgtcatgagagaaactgtagttagacactatgtctctaaattgatctttttaattaaatcagtttttataattagaggagagtagtagttcttaaatcagaaggcctattacgtttgagaattagagaaatgttcatgtttgcttttaaataaattggattatcattattttatgtacctggtgcatttccagcctaatgtctttttgagttctgattgctaaattaactgaattctttttgtttggtgagattaaatgttgttaatgaaaaacttgaatacaattttttatgctttagaattggaagtagattgtggtgcaaggaccaaattgatatcaattcatttaaatgacagtaattgaaacattgctaggtatttgtttgtttgttatttattttggctttttctttccacagcaagttgatgtggaaaaatgggtatgtgtttccatgtatttgcaaagaaattgtgatctaaaagtgcatgcttgctctcgcctctaatctttcattttgcttcctagtgtggcttgtactattagtgttcaaactaactgcttcgttgtaatgaacacatgttttacaggtctctaatgagaaccttatgtttctggttttgcttcatctgaaatggggcatattaaagtactttccatccctagaaccacatagtttttatataatttattttgtaattattatgtgcttctggccaacagaaaggtgtttattattcatactgtctgtatatcttctgcaaaaaaaaacaaaaaacaaaaaccttgactgtttaatctcaaaattccactgcttagtccttatatttctgcatgtactgtagaagaagacaattatatatatagtcatagaaagtcatagaacctttttttttttttggtatagatggagtctcactatgttgcccaggctggtcttgaactcctggactcaagtgatccttctgcctcagcctcccaaagtgctgggattacacacaggagccactatgcccagccttatataatctgaagcagtgaaggtgaatgaccatgtagaaaaacgcagttacaggattctggaggctaattcttagagcccacattgtcacaagttgtgcaaaaagttacattgcttcttttggtctcggtttccttatctgttaggaaaaaataaaggagagaggaaatacaccaaggtaccttccaatacttaacacaccaggattctgaatggaaattaaagtctcctcaagactgatattcctactccactttctcccaagagtgcaaaacagtgaggcttttcattattgaaatgtttttgtatttgctctgtgacttatatgaagaatcctttaagattgacttaactgatggctttattttatcttcattatttttctggttttaggatccaactttcttgatgcaatattttgagaattttgccatcttttcagtgccctttcagtagtgttttccaacaatttcatgttctcttgtctttttttttaaattttttttagccctttaaagacaaggaaacttgttttttaatttaccatttctgatgacctttgaaaactatgacttgtatgttatattgctgagaataatttgaagtcttcatttctctttataaccgaactactactacttttgaccaactatttgtttttgaaatttcctaccttcctctttggctatagttaaaatgctgatccaagattcacatttttcttgtcttggtaagggaagcctgcttccttctcagaacacgtatgacacctctttgtcctgcacttccctaatatcagcatcctacaacatagccctctgtcttttcccatccttgcatcccttcacttccattacactatttctgtgccatatctggattggtattgaccaaccactcaagctgcttttacttactttgtaaatagcacttgccagtaaataaaatcaccttttcaccattgtctaaaagtcttcccttcagttcctctgtggatttggttacttttgatctgcctgtgtaatttttttctttcttattcctataataatttatttttatttgtattaagtttatttgtaaatcattgcagtagagattgccttctagttctaaggaaatatctctgatattttctgagctaaaaaccttgaggcttagtttgccaagtgactggctttataatcttatgtagcctctttattggccgtaatctctttgtctgtaggactagaatctgctttactccttttttcttaagtattactatcatgtcagtgctaaaacatattgatgccaaaatacatgttcatttggaagtcatataataaaaagattctgctgggttttagaacacggatgatcactatgtgtaaatgttgcagcaaattttagattggagctctttttttctttgaagacctatccagttcatgtcttatgctttggccattagaagtttgaaattctactgttacaggtagactttgaaggccaacagaaagtaatttaaccctctacccacctaacccaggactattgagactcctctgtggggctggtacttctctgccccttgagttaaattagaaccggtcccttgacctttctcgtattccaagagtgaaataccccacagacatttcaagtcatacagatctcatttcagtaattaaaatgcccaaatctgtataataggtgaacttgaagctaattcaagttaacttgtcaggaatcgagctggagggacggatatctgggaagctgtttcttgcttgccccgccgggttcctcacgccctacttggtacctggagagtctgccactctcaggtgctgtgggaaggagacagaagagaaagcttggcaggaaaggtctgctttgatcatagtgtcatgcactgggcttgccaggtttctaatgctgactttctctgtgggcgcttggcattggtctttcggggagcttctatccccagaaaactctgacctgagcttctcttgctgcagacaaatgcgtgtccactagctggtcagtggcaattccttactcttcctgggagttcttggtggcctctgagacaatcccaagctggatctgtctagtatggcccccatttgcttgttggcagtgtggtcacttcccagttgcagccctgtaggactacacccagccttttgcctctcaatctccaggcatagtaagacaccagtctacagtgtcccagctcccagggatatcaggtatccctgaagctacccttgctaggcttgaagtgagggcaagcttgggaggcaggcaggattccaggcccacctgcacttctctccaagaaaccatttctttgctgcctggcctctaataatacactgggggtgggcagtcagctaagggcagccagtggatttgcagccaccctctttgacatccctgcttaggtggcataacaatatgttttgggacgtgatagtacaggtgctcctccagttagggtgaggttatatcctgaaaagcccttcagaagttgaaaatatcgtaagccaaaaatgcatgtaatacacctaacctacagaacattatagcttagcttagcctcccttaaacgggctgagaacacttacattagcttacagtggggcaacatcatctaacacaaagcctattttatactaaagtgttgaatatctcatgtaatttattgaatactatactgaaagtaaaaaatacaatgattgtatgggtaatcaaaatacagttcctgctgaatgcaaatcactttcacattgtcgtacagttgaaaaatcataaatagaaccattgttaagtcagggaccttcttgtaaatccccttcggagactggtcattgttttgttttgggacagtgacctgttttaacttctgttatacttgcttgtctagggtgcgtttaccaccaccagattaagacctttgggagccttacaaacttaaatatatatgaaaattaaaatggcttctgtataaatcttctgataacattattctggatagtttcatcaaaggtccatcaatcactttctctttctttctcctttctccctcccctctccatccccttttccctaattcccttcctgccttcatctccttccttctctccatcatcactgtctctttgagcagctgtgcatctgtttaatcacaagcccactgagttatcaaatgctgctctttacactttaaaagagaataaaactcctgagtactggataagaaagtaactaatggtcatttccatctactccactcctagcccttttctaacctataccattggtttccaatgtggaggcctaggaatcaggtcatgagtggggtgaagaaagcaaaaggatgaaatagactgtgagattgttgtctatgaagcattgtctatagactgagtgatgtcttacacatgtattttctcttaaaaaatatgatgatgctgttgtaattgttaaaatccataatcatttcaaatgtttctacctggagagttgtttaaaaatgcattttaacacacgactgctattatgtgagaacctgcgaaatgctttcaagctatcaaggttcattcatgtttgaaatggtttttaaaaatatatggagtcttctgtattctgacatgggcaattttttatgtgtaggtgatgatctgaatagagggcaggctttgtatgtcttcaagacatcagtatccatttgccctctgtagaaatcaatgtgttgcttttgatttagagaaattctctatcgagacaagctgggaaatgaagaaagccctagatacctcttctatttcatgttttaggcatttatgcagctctttgctttataaacctgtcacagagataaagtgtgagaacttatagtagcttatcggaatcatttatttttctttacccttctaaagaagaactacataattgtatgtacatatatatgtcaaatttattatactcgaaagagaagacattccatttaactactgtctgtacagagctgtttataggttgaaaaagaacttgctacaaatctgccgaaaaatagaatgaattctttttaaacatatctgcatctcacataactagattccagtgatggtcattaatatgagtgacacaagggcatttcaatagaatgtattattatgtgtataattgctcattcatggactggtggacaagcctctttcagatgatttctgtacctgtaatcaatatgtctgtcttttcagagcatcttggacatttttagcaggggaatcctggaaagtgaagcatttccataggatttatatagatattttttaagacagggtcttgctctgtcacccaagctggagcgtggctcaagtgatagtcccacctcagcctcctgagtagctgggactacaggcatgtgccaccatgcctggctaactttttaattttttgtagagacagtgtctcactatggtgcccaagctagtcttgcactcctgggctcaagcagatactcctgccctggcctcccaaagtgctgggattacaggcatgagccactgcacccagacacatattttcatcataagagcgatagttgaagcttttcaacctcatatgctattaggtagtatatattgatatttggaactcagaattgttgttaatttttttattctaaaaattattgggactatcattaattaactatagctacctagaaatcctagtctttggtggtgaaatcactttgttttctcaacataatgaagtttacctgatatttcctcacaaaggagaggttaccggttggagacttatggagaatcctagcatcttgatacgtggagaggaaaagatggcgaaaaggcttaaatttgatgtatattttgtgtacagagtagggtattttgcctccttaatggaaacttcacgctagaatgacttctgaggctattctgaaattgttgcatttgataatcctttttaatggcaagcctccaaatgtatggtgctttgtcactaaatccttatctatataatttttgaggagacatttcaataacagtttcttttaaaagttctaaggtaggtttttagaagcgttcctttttaaaaatcagtttttagctcatgaaactgaaataccagttttaaaaagtcaaggttgaactgaaaggcatcattataatagaggagctttgctacattacctgaattattgtttccttctttgcaccaagaacagattaaatatgcattctcttgatatccagtatttgttagcaattttcagagtaaagtattgctatttgatttgtttttctattcataatcatttgcatttgctaagagagtgccttaggtcttttagatctactacactgagtggctcatgcttacagacgaaagatgattctgcttctttttgtcatccatttgacacccagggccgtctatgtgttaaaatgtagcaatagcaatttctcttcctggcttccatgttaatgtggcatgtgcccccaggttttgcttgtatttggagctccatctgatgtgtcaattccggattaatctaaacctgggacactgagttactgacatctgcagttttagcctaaagaactaaaatttccacctttgtgtttctatgcaaattaatcatcatccaaaaaattctaagacagcacgttggaatccatgctgcgtgcctgtcctataattgcccatatagtcatcccttactctattttgtgtaatgaaattttagctcttgtctattgaacttctcattagtgaaataaatcaaatagttaatttatttgctaaacttattgtaagcacaaaaacgacattctccacacccaaagaggctgctttcttcaatatttatctttatgtgtttcttttttctactttccatcatatcaatttttaaagggtttttgttgttattctttttctgtttgttgcttttatcatacagaagcagtgcttacattgaattaaactaatatactcatcttttttgttttaatgcgctttgctttcttcttttcccttaaacgatccctttgaatgtctcctgatgctataattttggtaatatctagcacttaaaccaatttgaacaagaaatggtttgtacagaaagttattgtcaataatgccactaataccacaaatctttcatgttcttgattatcttttgaaagtgatgtttgtgtcttacatctgctcttctttctcattctgcagaaggatatttcagcatttgctatttttcagtattcattctattttgtcgtgtatgcagattgctctcctctgtgtattattcttcctacagtcagacatgacttagcaatgccgaatagcagacctcggtcacttggctgaccactcttttttttgttaatacctactacatttttaaagtggttcaacttagatacctgacaaaatcaggctgagaaaattgtctgaaggaaaatctcccaaacctagcttaattaaaaaaaaaaaaatctcatgaagaaagtatctcttcacaaaccatgtgctgtaccaaaatgttaggtttttgtgtttctttgaattaaggcttaataatgattttgcctaattctttagtgatatctctaccattagtgagtcacatgtgattggtcagtttaacatggaaagtaagtttcctgatattatgtatgattaatatcagttataaaaaggtaactaaacagcctgtattttctaagccaaggatgaaagcttctttacaatttttccttgaaattgtaatattgaaaatgaaaaaattagtctcaacagaatttccctttaataatatacatattactatgtaaatatgtttcagggaaaaattgtaatatttacaaatatatatattggaaaacttttccttgctgtttttcttacaactagtgtctctatggtatcttttctccataggacttagacatcaacctgacaacaaattcagccctaagtttggaaatatatcattgttttctttttcatactctttcatctgtgtaactctcctaggaataagtagtcaaagaaactttagaggtgtaaagaaaaatgaagttatttgtaaatttgcatatgcacacacatacgtacacattatgttttgtagaagaaaaaagagctattatataatttatgaaaggagactgtgtcattttaagagaaaaagaaatgtttttgtgatttttctgtgaaattcacctttcacaatattcagtgtctaagaaattgcttactgttattttgcatgaaacgagagccgctcattgcagcatattagtttacgatctaccttacctgttttaatctactgtttttattaaaatgagttgggttgctgtttgtttttatcactgcatttttatgcaaaagatgcaagttggttttttaaaaagcatttgcagaggatcaatttttaagatgataccttttttggtgcttaaataggttgtcaatggaatcactgaaagtagagcagcatgttttcacagaaaaaggaagaaactaacgtcaaaacatttttaaagagttttgcttgctacggcttttctctagcatgtagttgatactaagttttgttgcgataacatggtgaatgtttttttttatgtttattgtttacatagctccatttaggataacggagtctttataaataagagatatttttaaggaagtctttgagatcgtgtctatttaatgtttcctctcttttccttatgcccctacagaaattcatgatgaaggtaagacatcttaatatatatgctatgtatatatatagcagatatattactatatatggattatatatgtatgtatctgcatattagtatagctgtattatatatatgacagatatatatattactatatatcagctatatatatgtggtactttgtatgttttctgtatggttatacacatttgttttacttttgaatccatgtaacttttcttcacatgcttttaaaaggtttttaaaaatcaagctttggagcttttaaatttagataaatcacgtttagatttaacaactcaacaaacaacatttgacatttttgggtcatattgtaacattatatttaattagctaacattaagaatttctcttattaaaacaattttagtagctctccatttagaatattcactctggggattatgttgactttgcatttatgcccttttgcatgaatacaatgggaaattcttccactgggaaattaggggaggcaccaagaaactacttctacttactccaggagaagtgaaaataattcagccagccccttattcatttctcaactaaattggaaaagtgaaaatattgtaaaagtagacaaatgaaaagagtaaagcatgtggacatgtcatcgaaggaatatgtaagggacagacaggaagagtagactatggttattttaggatatataatagaaaatttttgtttcatttttgtatgcccactacctttctcctataacatttatggggtttaatttttttatcttaaaagccaagaaacaatgggtaggtagaaaaattgattgatattccattaataaaggcttaaaagaatttatgattttgaaagaaagagactgtgagaaatattaaatcaaaattccagatatagatggaaaagattgctttgaagaaaaggaagcgcgttcttgtcagtctgttgaattttgtggttaaatccatcatgtttaataaaactgaaccaggtgcattgtgggacaccctaacctggacctgttcactaccagtgcgaattcggcgttttggatgggatgacagaacagagtatttctttgaagccatctatcaaccaggacgtggaacatcttccagaatttcaaataactctagctcttatttttcagtagaaaatattatgatcacattttgaagagaggacgttaatccctaaattagacgtatcatgaaacaagagtttgggttggaaaaatatttaaaacaacagcaaaataggaatatttcctctctttgcaaatactgataacttatgatttggggtttgagaaaatttagtttttcctgctaaatctgcatttgctgtattcattttatcatctcattcttaattcaactgtacaatattgtatggacttccccttgggaagggtgaatgaaatggtcgcctgaaacagacatctgaaggtctcttgtgagaacaaatgcatataaaaaccagtgcaaatagaaagatgatgtagaattagttaaaagcaggtggtatgcctaaaataatttaattaggcccccagttcttttaacttcgaggccagaaggccaatagttattttcacacttgcaatggatgatctggaaaggttagaattggattaaggggagggcatatgcatgcaattacagtaatttaagtcacgtaaacagaaaaacatgctgaattttatctcgctttcacctttcaatcatcatgctttgctttgggtttcatacggaaaaggcattaacttcttagaaccagatggatgctttcttgttgtgggagcctatttctgctggttggtgctaaacagtgatgcattaggactgtcctaagcctgatctgttccctgaggagactttccatgaagacaccatcccaagtaagccagtccatgtcaaatggatgtcttgacaatgttaaactggcctttgcaggcacctttatcttcaactgaggccaggattctcatggattgttacagtccttcggtgaccctgttgtgtgattcactacttattttattttttaagagacagggttttgctctgttgcccaggctggagtacagtggcatgaacatagctcactgcaacctggaactcctgggctccagtgatcttctgggctcagcctcctaggtagttgggattacaagcatgaggcactttgccttgctctgggccaactgtatttaaaaaacacagagccaaaaaacaaaaaaagcaaaccagaaagaacaaaatatagagccagtaattttaatgtgtgtgtaaacctctttagtcacacacacacacacacacacacacacacacacactgtatatatatatatatgaaatgtgtaggccaagctttacggtaaaaggagcactttctggttaacttcaagaccttgtccttcacttttaaaacattttgttttgactagtgtggctgtcaagtgttattaaagttcacgtggattttatagctttggaacataaatctggtatgaaaaggtgagcttctatcaaagtaattcaaaccagacaaagtaaataaaattgttcttggccacaataaatcaaatgcattatagaaaaaaaagtgctctctaaagacagcctcattctctgaaggagtatagtttttcaaagtagatttttcccttttcttctcagttatgtgaaaaaagtgactgttttgttttgtttttgtttttttgtttgtttttgttttcgagatagaatctcgctctgttgcccaggctggagtgcagcggtgtgacctcggctcactgcaacctctgcctcccgggttcaagccattcttctgtctcagcctcctgaaagtagctgggattacaggcgcccgccaccatgcccagctaatttttgtatttttgtattttagtttcacagtgttggccaggctggtcttgaactcctgacctcacacgatccacctgtcttggtctcccaaagttctgggattacaagcgtgagccactgcgtctggccccccaaaaaaagtggtttttcagcagtttttcttattttaataccttttaatatctgtttttagaatagttctgagttttttcaaacaaaacataaagttattttgagaaactatatggaacaacaagaatgtgatatttgtttaataaaaaggttgtaataatattggatattaaagcatctttctgtacttcttaaggcacaggtcagtatcatcactcttattctgaaaatttttaaagacctccttttcctgcaaaaagaattacaaacttctcgtcataatattttgtaccttccatggtctttccctgatctaattttataattcctgtgaagtttttctgtgcaacccaacactaaaattccatgattgcttcctccttcttacacaccttgtgattatataccatgacccctttatacatactccttactcagcctgaagtgagcttccccatatccagtttttcatttgacagttgtttactgagtacttaccatggcctgacctcacgctcatagctggaggtgaaatgataatcaggacagcgtcattgtccttcaggagttttcagtctgatcaaggggaggagggttcttgtgtagagtgtaaggccaatgtacatgtgtatacctagggctgcaggaggatggggagagtgagtagctttgaggaaactggatgaggcttcatagagaaggtagtctttaatcagagttttaaaaagtagagggagaaaaaaatctgagtataaatggggctgtgcaattcaaacctgtgtcgttaaagagtcacatgtacataaaatatgtaaaagtttcattccattcttataaaaactttattaaattataacatcaatacatatttattctatacagtttggaagttacagaagaaaaatccttcaattacactaatagaaaaaaactactggaggctttcctattaaaaaggctttataaggcagggaagactagagagagggaatgttgtattccgagatggggcagcatgaaagcagtatggcatattcagggaagggaaagtgggtatgtttggagcacaggatgattgaagatgaggctagagatgagtgagacaaatgtctctctgtgcttctcaaagtagtctctggaccaacggcatcagcatcacctggaaaattattgaaatgaaacttctctgtgtctaccccagacctactgaatcaaaatcccagtggtaagggccaggaatctgtgtttttacaagctctccaatttaagaagcactcttctatttcatggaaagggattgattggactcttccctataagcaattgggaggaatgagaagtttttaagcctggaggcattatgatcaattttgtgttctaggaatactcattcgttgaatcaacgtttatttatttatttatttatttatttatttatttatttattaagatagagtcctgctctgttgcccaggctggagtgcaatggtgcaatctcagctcactgcaacctccacctcccgggttcaagcagttatcctgcctcagcctcccgagtagctgggattacaggcaggcatcaccacgcccagctaatctttgtagttttactagagatggggttttgccatgttggccaggttggtctcgaactcctgacctcaggtaatcgcccgcctcggcctcccaaagtgctgggattacaggcatgagccaccacgcctggcctgaatcaacatttatttagtgcctcttgtatgttccgcatgcaggtaggcacctggaatacaatggtgactaaggtaccatggttcccacccagtggaaaccataatataatgggaaagagattattattaagtacattatgagtaaataactataattatgataattatttactgataccaagtttatttttcaagaactagataaaatgctaatcccataatagaggttacattaactttactccaatgtatacattatttcaacagcactttgcttgtctgcaagagctcttaatacattctttcctactaacgttcctttgagagcaagagagtattttatcaacttggttaagttactcttttgtgtttttctctcttgttctccttttttctcttctctctaaagactgctcaaggtggtggtcatcgaacactcctctacggacatgccatattgctgcgccattcctatagtggcatggtgagtaggcatttgatttcatctccctgtggtcatgctgatccatttgggggtacatggtctgcaaatgctggtagcatcatttctgcaatggtattaatgagcttggatgtttgtgttctttcatatctttgtacccttgttagtttctcatgtaaaagatgaaagtcagctcagatgacttttaaggtcctttaattctatcattatatgattaccatcttcagtatcttacttttgatagagtagttttaggaggagagaggtgtaagagtcaaataagagatattttcttttctgattttgttttgaagagttcatttattagagaaataaggtatctttattgaaagatcagatttaagaaaatctacctgtgagctccaatattaattgtactcaccaacttctttttcttcttcaccaggtttctcttttaccacatctgctcctcctttcacccagttattcactaggcttctcttgggcacagttttcttattctttgcctcatgtatatatgcacatatatatgtgtatatatgtaaatgttttaaatatatattttataaatactttaatgtattcttagctattacatatacagctgacccttgaacaacacaggagttaggggtgccaatctccttcacagtaggaagtcacatataacttttgattccctcaaaagataactattaatatccccctgttgaccagaagccttaccaataccagtcaacacatattttttgtatgtattatatactgtattataataaagtaagctagagaaaaaatattaagaatatcgaaagaaaaaaatattttctacacataaagtggaaatggatcatcataaagattttcattctcattgtcttcgtgtcaaataggctaaggaggaggaagaggaggaactggttttgctgtctcaggaatggtagagggggaagaacatcttagtaagtgggcccgtgcagttgaaacctgtgttgttcaagggtcaactgtatataaaatatgttaaaaatatgcaaaagtttcattccatttttttttttttttttgagacggagtctggttctgttgcccaggctggagtgcagtggcgcgatctcggctcactgcaagctccgcctcccaggttcacgccattctcctgcctcagcctcctgagtagctgggactacaggtgcccgccaccacacccagctaattttttgtatttttaatagagacagggtttcaccgtgttagccaggatggtctcgatctcctgacctggtgatccgcctgcctcggccttccggagtgctgggattacaggcatgagccaccgcgcccggcctcattccattcttataagagctttattaaattataaaagcaatacatattctatacgatttggaagttgcagaagaaaaattctgatcacactaataggaaaaaactgttggaggcttttaaaaaaagttttaatctcttctgtccttaaggctttttttttttaaacataattgagatgttactacgttaccaaatttatatcattttgttttttgagatagggtcttgctgtcacccaggctgaggtgcagtggtatgatcatggctaactatagccttgaactccgggactcaagtgattctcttgcttcaacctcctgtgtagctaggactacaggtgtgtgctaccacgcctggctaatttttaaatttattgtagagatgggagtctcaccatctttcctaagctggtcttgagctcccaggctgaaacgatcctctcgccttggcctcccaaagtcctgggattacaggcatgagccaccatgcccggcatgattttcttttccttttcttgtaacataagcattttccatgttgtttatattgtcaacataattttagtggcaacatgatagttcaatatctagaatattatacaatatctgtaataatatacttgatcattccttttaaaaagtagatgattcctgtattatgtaaattgttctaaagcagaagactacgtatcaataacactatccaactggattaagaaaatgtggcacatatacgccatggaatactatgcagccatgaaaaaggatgagtttatgtcctttgtagggacatggatgaagctggaaaccatcattctcagcaaactatcgcaaggacaaaaaaccaaacactgcatgttctcactcataggtgggaattgaacagtgagaacacttggacacaggaaggggaacatcacacaccggggcctgtcgtggggtggggagagatgggagggatagcattaggagatatacctaatgtgaatgacaagttaatgggtgcagcacaccaacatggcacatggcacatgtatacgtatgtaacaaacctgcacattgggcacatgtaccctagaacttaaagtataataaaaaataaaaataaaaaataccactatccaacaagggcacacaaattttcaatctcaatcatggatatttatgtgataatttgattttaattgtctatttaatgaaattcaaaagtataggatgagaagtataggaaatacatggacgtgattttaatgatgatttaataatatcatttcttttaatgtgttacatcacatgaataggtcagataagaaaacttgtgatcatgttagcaagtgctggaaaaggtttttaataaaattcaatgctcattcttaatgaaaactaaacattgattaattcctcagtgataaagattatcagtgtcagatcaatagtgaatattgtaattgtgaaatgctgaagccattttttaaatcaaattaactaaaataagaatatgttttatctaccattgctaactaacattgttctggaaattttggctgacatgtcaagatataaaacaacataaaacagtttcataaagtggttggatgtaagaaaaatatgtaaaaacaatttgtatagagcaatcacatattaaaatttaatgaaaacaattccacattctacagcaatcaaaacacatgaactgcatgagctaataaatgtgagggtttcttttaagacaactactctctatacataatagttgggttaagagcctcaacttggttgttagatttggattcagtctgtttgccacatgctggacagcctgggatattttgcataatcaagcctgtaattacacctgaaatttttatacattcattaaataaatattatttggcatctactatgtgctaggtactgttttaggtcctggatatagtagtgaataagaccaagttcttgctctctttaattaacacttagtagaataatcatagtatctacctcagagttactagaaacattaaggagaaagcatatgttaatagttataggtacagtgcctaatactgtacttgttattgaaaaaattacaaaagactttaataggaatcacttcatgtttgtctgggaagtctgattattgcaaagttgttacctttttaaaaaataaaggcagatgttaagcacaatttatatttaaagtctataaacataggggattatcgtgggctacctgtcttgaggtcagactgacatttctgctgtggctaaaaacaagtttagggaccctgggagcctcttggctataaccttgggagccatttctttgtagttaagagtcagaatcagaatctgcaggtcaatttgatttcacatccccatggcactgaattccacctaacataccagcatatctgccaccgattggttcatctgccttctcacactcacagacacacacctagctggatgggccctgtaccataataagacatttctagcctttgcattatttttccagtgattctaaagggggcttgctggcagtgcacttgcttcgtgatggtagtgtacttcgagttcctaccacattcgtctttgtatctctgttcttacaacacattcatctttgtgtctctgttcttacaacactttgtggcatgggggttggggagcagtaggcttgaaaaatgatcctaaactttatgtccaagaatatacagttaggaacacgtaagggtgggaagaataaggagatgatggtgttgcaagagtgattactcctgtggaaatgcacgtgtatgtagacacacaataaacctcattttagtgcagtgacatgctgtgcaccaaaataaattctaggtggatttcaaagagttaaacatttttaaatggaaacaaaactagaagataaaagagaatagtcttcaaatttgtttgggagaaagatttctaactgtcagactacattgtacttttgcagatgatcatgaatatcacatgaagtgagagatgtacaaatacatccccagttacttgtcttcctgtactgacagagaacatttcctttgtcttttataagggaagaaaagactacaattcctttaggatattgcccctaatgcatgctgttctgcctcacagacatttaaaaatctgggctttgtgcagaagcatccagattttcaggaaaacagtgagaacagtagggatagatggatgccaaattacaggtcagaataagactctgctggtacaactataaaccttaacgatggctggtcactgtggctcatgcctataatcccggcaccttgggaagtggaggtgggagattgcttgagtttaggagtttgagatcaccttgggcaacatagggagatctcatctctatggaaaaaaaaaaaaaattaaccaggtgtagtggtgcacacctgtggtcccagctacttgggaacctgaggtaggaggatcacttgagtctaggagttcaaggccagcctgggcaacatggtgaaaccatatctctacaaaaaagaaaataattagccaggcatggtggcatgtgcctgtagtcccagctgctcaggaggctgaggtgggatgactgcttgagcccaggaggttgaggctgcagtgagctgtgatcacgccactgcacttccagcctgagctacagagcaaccttgtctcaaacacaaacaacagacgaacaaaacctctacttacaactactgattttgtactttgtagtatctgtgctgcctgtccacctcccggtcttcaactgataagctggcttttgatgttggcttgcaagaggacaccacaggtaagcatcttgtgctgcgggaagccaggttcagagagaaccctgcaggggttggattggaagaagccgggaaatacgatacatgggatgaatgttcttatggatggagtcaggaaagaatgttctaatgaaagtttttcctagaaggggaaagtgtatatcattcctcttggttattcccacatcattagttggatgttcaaactaggcttcaaaccttattcttcttgtaggtttggatagaaaattaatatttactacatgatttactgggtgttagccatattaatgtacactaattagtttgtgaagtaattctacatgtctctctcaaaaatgtttttaagtctgaaaatataacatacttgatgccaacattcaaataaaaagataaaaaatgaaagtctccttaatttctctgcccacagggcattattctacatacctgtccaagcagacatgcattttcagatttgtgaaacaaaaatgtatatattaacacttttttttggagaatcaaaataggagaacacaaacttgatgttcttctcaatactctgaggactttgcattgactttatatatccctataaaattggactgttttgtcttttacaatgagcatgcatcactttgtaattaaaaataaagaccaagtagaaaaaagaatggaaggaaatagttcaacttttattaagttgttcccttcaagagtgagatcaagctatcctctcactccactccccctcttaaaagtatttacccatatttactaaatcttttacaaacaacaaaaaggtgaaaacaaagctatgtttaccagcctcataaactttttaatagaccaatgcatcgtcttataaaagaaattccaagaacccctggcaccagaaagataaataaatatattattctgattttgttttgtacaggctctatcattcctctgtatttttgctagttttttagttttcttattctagttaatgtatttcagcacacagttaaatgagaaagttgtcagttctctcttcaaaagaagtaaaagacgcagtctagaatttgttttcatacattgagaagattatgtaatagtcaaaacaaaacaagtcagtgttttctccctgcgtcctgatttccttatgctactctgttttttcccgtagttccctacctcttctgaattcctcaattatttattgtatttattatttgttgtctgcctgccttcatcagaattaaactcacaaggcagataattttttcttccttcttttttgatgtatcccagctactaaagcaatggttagccaatagtgggtacactataaatgtttgaatggatgaaaagctacctgcaactgtaaaaatgtgaattggatgaatgaagataaagaattctgccaggtgacattcaggttagattatggtttgtgtaagaaaagcaagttagactatggtttatgtaagaaaaaacacagattacatgttgactgtaagaatacttacaaaatattgcttggtaattcacttattcactcatgcaaaatgaatttgtggtgagggcctataataggctagcaggagctggagaaacctcagtaaacaaaacataccaagtcccactgttagggacttacattctggcattgaggaattaggaaaaaaaagagttatggaaacaccataaagttgagtgaaggtaaagaatggtaaatgatgacggatatcatgaaaacactcctctgattttgggatagaagttgcatttaggttttcaaaggtattatgaacagaatgaagaatggcatgctgaagcttctatgttaggtattgggaagaaagagtgaagaagagacatgtggctcatgaggcttatgcttgacttgtgctagaagaaattgtttggttgatgtaaaccaagatcttttataattcatttttctttagaaggattctcttatatgttacctttagattaatagaaaacaccacattttaaaataataaagtagaaaggggacaggatagtacaatctttagatgataatactttgcatccttttttgagtcagcatccaaaaataactactgagaacattttcaaaaaattgttacaattgtcacgtcacaaaaccccaagtccttatgaaaattgacaaaaaacaagatgattttatagaaaggaattggacagtataatgacatgtgagtgtgtaaagaatgaaatcagatcagtgtgagtggtgaatttagccttagatgagtataaataaacatcgctttaaagcaattcttagtggaagaaaaagacatcaaccttccctaagtgtcacacccagtttctaggagaagaatcttattttatcctaagctaaggcttaattctttctcttttcatggtgtaagagattaatttgcattaattccggatttctgaaagttgtgtgttgggaatcattggcaaagaaaatagattttaattaagaggaactttttcatgtttcacatatccgtatatctgcaggggaggcttgttggtggaccatacaccctgcctctaagcagcgatcagaaggagaaaaagtacgagttggagatgacctcatcttagttagcgtgtcctctgaaaggtacttggtaagtgtggaaagtaggatcatgtatctgctgatatgctaaatgacaagtcaataaaatgatctctttaaggtttatattgtaaattatctatgaaaattgcttataaccattcctctatctctattagattaattataaataacttcctaaacggaagaataatgtgatgtgggtgcaaatatagcttatcaggttgttcaggcaggcttccctcataaccttgatatgcatgttcatgatattgatagtaccttttaataaattactttattgatagaatgtaaatgcagtctaatcaggaattaaaaattctatggtctttattttgcacctgatgaaaaggctatattaatgaggttgtgattacctattctgatatttatgaaagcaaattattatgtgaggaacacatgccatgttaagaagggagaaatagacaaaagaagaaatagtttgaagtctatcattgacactgcattgtttcaaagagtaggggctggaaatgggagaatgaaggaagaagtttgtgtttaatcatgaaatgctgtcttagtctgttttcatgctgatgataaagacacacccaaaactgggcaatttacaaaagaaagaggtttgttggacttacagtcatggtggaaggtgaaagacacgtctcatgtggcagcagacaagagacaagagcttgtgcaggggaactcctctttttaaaaccattagatctcatgagacttattcactatcatgagaacatgggaaagacttgacccccattatttaattacctcccaccgggtccctcccacaacatgtgggaattcaagatgagattcgggtggggacacagccgaaccatatcaaatgcattttgaacttttgtggtaaggtcaatatgtatttaatttaacttatttagtaagttgtagttttgccagagagtagtccaatacagaagtttacagtaaattgaaatgaagtaagttgaaatgaagatgtgaaggatgctagagcaaaatattcattttaaggttgaaaggtgactaaataaatataaaatggggcattgtaaactttatatgaatattcacatgaaaaatcccaggcatcacagtgtgtgatgattgaaacaaaaatctgaaatagggcatgtggcaatttagcagataccgggttatagaaagtattttaccactaccataaatcaaaatgtagttcatgtgttactggtttaggattaagtaagtagttgataccccctttgttctataaacatgaaatagggtaagtttggggatgttgtaagtcagttttggtttaccaatacatttaattccagatttgaaacatttctaggaagattggttttgttttgtttcacttgccttgtagaagaggtaatgatgaagacaaggaaatggtataacagtgtctcgtgtaactgacagaaactattaaattaaatggagtgtctgatgttgcgtagctatagggagacctggagcatttttctacttttgtcccttaaccaatgtaggtagaaatagtcaccatgcgaatttctaggacaatacaggtgtgcagattgtaaaataagcattaattaagctcttgctatatgcatgtgctatgtatgttaagatgatgtattttgatcagatatgcattttgaattgtagttgtacctggaaaccaatagcagtagaaataattcatgcacacttttaatatataaattatacacatactttatttagattttgacataactatgaattttttcttgttgttgttgttgttttacaatttgtacttccgctacgtatcagagtttatttgacaggatggcatcattatgcactgaaaaatggaaaattcagacctcacagggccaggacttctaacatctattctacaactaactacctgagaaagtcatctaattctctgaactctggctttctcatctgtaaaaaatgaggttgatgctgataatcatgcatagtgccaaggttattgtgaggaagcaatgagataatggatttaaatatgggcagaattaaaaagcactacacaagtgaaagcaataataatgatgataagtgaggtttacctcctatagaaggaaataaacctcatgattaattaaaatttacaagtgatttccaaactacattttattgttttttttattttattttatttattttttgagacaggatcttgccctgtggcccaggctggagtactgtggccatcatagctcacagaagcctcaacctcctattctccccagtcagcctcccgagtggctgggactacaggcatgagccacaccttgcccagcctgtgctacatagccaattatttatgttctctttcctggtaatcttttatatggagctataagagagcagccaaccaggttgttaaaatttcactttcatttgataatgaagtcgttgcttttattgttgatctctatggacctagcatatagcagaaacaacaggaaaggccaaggacacatcactcatgctttctaacctcaaataattagtggagaaaacaaatcaaacacatacagagctgtatgaggatattgtaagacagtaaatacgcattacagtatagcttagagatgctgaaggacattcctatgggtatagagatggtgaattattattttacattcccaccatggtggatagtagcgggtatatgaagtactatggtgtggattcaaagacttatttggaggactcagtgaaaaggatctagagaaactgaaagatcaagaagtgagttcgtgaaaggactttgggataggcagagggagttgaaataatctatagaataaaccctgaataactaaagttgggctgtgtgtatatatatgcacacttgccttgtagaatacacaaatatatatatatatatatatatatatatatatatatatatatatatatatatatatatatatagtaaatacgaagtctggtgagtatgaacctgggctaatcatgtaacctttagaaaccctcagttccttcatctggagtctggggaataataaagaacttaactcataggggtgttacgggattaaatgctggaatccaacaaggctcgtagttctgtgaatggcacataaaaattatttagtaagttactgtcactatttacttgggagatttgtgcctgttaagaatggttaaagaagttaggcatggtagcttatgcctgtaatcccagcactttgggaggccaaggcgggaggatcactttaggccaggagtttaagaccagcatagccaaaaagcaagaccctgtctctactaaaaaatacaaaaattaggccaggcgcggtggctcatgcctgtaatcccaacactctggaaggccgaggcgggtggattacctgaggtcaggaattcaggaccagcctggccaacatggtgaagccccgtctctactaaaaatacaaaaattagccaggcgtggtggcaggtgccagtaatcccagctacttgggaggctgagacaggagaattgcttcaacccaggaggcagatgttgcagtgagctgagatcgcaccattgcattccagcctgggcgacaagagtgaaattccatctcaaaagaaaaaaaagaaatgatctgggcttggtggtgcacacctgtaatcccagctactaaggaggctgaggcaggaaaatcgcttgaactggggaggcggaggttgcaatgagccgatattgtgcctcatgccactgcactccagcctaggtgacagaacgagactccgtctcaaaaaaaaaaaaaaaaaaaaaaaaagaatgcttaaagaaacagcagatatttaaccagaagaagagatagttgggaaagaaacagtgaaaggaacattataggtgatattaactaaagatctatcatgtgaaagcaaggttcatcttctgaagagatgctggtgttgttaaaaataagtaagtttaacaatgtgtctgataacaaattagttaaaactaacttctaaaaataaacatttccagtcattgattttacaactccttggtgatcagtgtctattgaccgatgagcgatttttctttcactaacagcgatggttaagctaagattaaactaatagtgcatggggtacactaatacaactattacaatgctaaattgatgaaagctggttgagagggttggttttcaccctgtcctctgagaacatgccttgtggacagaagaggatactgtggacagcacctgggattgctgcaccgttgtctgctttatatgttgaacattggggctcaattctgaggtataaagggtcttaagctctaaaaatggttgtaaacgcctcacccagataatgtcttttctcatttttgctgttttatgttctgaggtaaaaggatatgttaatcttcttttcaaaaatatccaaaaggaaagaattttttttgctcattgaaaatcttattttcttttaaagaaggccttagcaaagcaccttaagagaaatatacaatttaaaatagaaaaaacatggccaagtagatattactgactgaatttatttcaaactaaacaaaatgaatcttacaaaacaatttttttctgtgtgttaggtgtaaaaatcactccagtaagcccaaatgttttcaatctgtggattggattgtttgcactggaaatgtagatttccaactgattttctactgatcaggttacttaatgaaacaggccaagtttttcggatctgtgaaaacattgccaaataaacaactgattgaaaatatattaggaaaagcagaatgcttatctaaagggtgatggaaaatgcttaagagaaagctattctacagttcaaaaaatttctttctttcttacccaactctaaatttctttttttattttttattgttattttttattatactttaagttctagggtacatgtgcacaacgtgcaggattgttacatatgtatacatgtgccatgttggtgtgctgcacccattaacttgtcatttacattacgtatatctcctaatgttatccctcccccctccccccaccccacaacaggccccggtgtgtgatgttccccttcctgtgtctaagtgttctcattattcaattcccacctatgagtgagaacattcggtgtttcgttttctatcgttgcgatagtttgctgagaatgatggttttaaatttctaataaaaaatatagataattattgattgcataataaattgctgaactgcctcaagttgtgtgaaaataatgataaaagagtgatcataaatattttcaagtgatttattatatgaaccaattcatttttgattaatttgctgtgagcctttctttcctctgtggctcaggtaatggaaccataaaatattacatttggaaagaacatctatttctctgcccctcatttgtttttgttttttttttttcagaagaaaaaactgatgcctgaggagtaatgtgacttgtttacttgtgtttcctgtccttaaatgacaatttgttcagaatgttgcatcaccagggccgaagtacctgaaagtttaataaaaaatgaataaatgaatgaataattgcatcagataagggttcaattgagagattcttggtacgaagtttttgtaccatggacttccattgcaaattgataaaacttattgacctcatcataaaaatggtgaagtgcataaaataaatacgtaggataacaaaggaaactaaaggtattgaagtatagtctgtgtactccagctaaagaactcctggaaggtgatttatcgtgtcccttccatttctgagatgttgcacttctatcgtgtaatgtcttgttactcttggatcagcagtcttgattgacaacccctgcaactactctgcattccaatctagatttttttacattttcttttcttttttcttgttttttttttttttttttttttttttttttgagacagagtcttgctctgtcgcctaggctggagtacaggggcacgatctcggctcgctgcaagctccacctcccgggttcacgccattctcctgcctcagcctcctgagtagctgggactgtaggtgcctgccaccacacccggataattttttatatttttagtagagacggggcttcaccgtgttggccaggatggtctcgatctcctgacctcgtgatctgcccgccttggcctcccaaagtgctgggattacaggcgtgagccaccgcgcctggcccttcaatctacatgtttaaatacaatatcctctgaagattcatgtgcctattagagcttgaaaatcactagtcctgggatcaaagtgagacccgggtgcccagagattggtgcccaaagcccttgtactgctgctggtggactggtgctactatatttttgtgtaaatcctgcagtggttacatatttcagcctaaggccgacttggctttcatcctctgccagtgtctgtttttgctttaaggataattcatctcagtttcagtaactgaaactgttgttgctttctgaatattgcataccacaagcctgacgtgatgtagtttttacccagacttccctttgctgtttaagcagcaaaattggaagcattcaaattagaatattttcttcagaagagtagaccttatttagagaactttatatgactgtaatatgatcttaaggacatatttgggaccttttcccacagactgaaattttcatatgcttatggttctctcatatttattatttatcttcaggcatagatatgatttggaaattgcctttttaactccgtcacctattttattactgctgtaaactccttattacctaaaatcaaggtcgttggtttggcgccagcctttgtctgtggacctatcagtcattccacctcttagcatgtgctgtcagccccaaagacaaagctctcggctgtaatgtatgtccccgtatctccacctttgtgctcacgctcttgtcttcaacacattccccttatcacacattccccttctcagaacttcttagagggccagggggcccagcccacttctgatagcaaggtttctggtatgttaaaaataaaaatccccaaatggtttacaaaaatttttggtatgttttaaatatttgcacatagcgcattcacattactaatctacatactcaaatccaatgtatgtagacacttgtttggggacagcaaatatataaatgtgagacacaggccaagtgatcctactggctccctcaaagcccccaacccatgagaaactctgctctcattttgttgtctgcagtgttctctccttacaattcctgtagcacgttgattatgatttacacagcatttttaaaggctttttcctaccttccatatccatttatttatttattattttatttttttttgagaagtagtctcgctcttttcgcccaggctgcagtgcagtggcgtgatctcggctcactgcaagctctgcctcccgggttcacaccattttcctgcctcagcctcctgagtaactgggattacaagtgcctgccaccatgcctggctaattttttgtatttttagtagagacagggtttcaccatgttagccaggatggtctcaatctcctgacctcgtgatccacctgcctcagtctcccatagtgctgtgattacaggcgtgagccaccatgcccggccgtatttattttttaatttaattggtacataatttattttattggtacaaaatatcacatgtagcccataaatatgtatatattttacatatgcatatacatacacaaaatacacaaaatgctgtacctcagtatataaaaagtgttgtgtgtaatgtttgaggtgatagatatctcaattaccctgatatgatcactgcacattgtatgcatgtatcaaaatatcacatgtgatatgtttatatactgaggtacagcattttgtgtatgtattttactctatgagattacaagcacccttggggtggagaatgtgtactattaatatacatagtacattcagtgaacccatgatgaattaacaaatgatggtaatctacttatcataatattacatgagctttcacttggacacagatatgagcacgggtattttgaattattttcagagtttggttaaaatcggtgtcattcacatggatttgtatgtgtgtgtgcctgtgcacgtgcttttttttacactaggttattgaaatacgagtatttatggaacagcttaaaatgtgtgtttttatgtttatgatactttgattttatgatttttgttagcttctccacatacgtgtttactggataacattgccagatgctaggaacacagctgtgaacctgtgtcaggtagcttctaaaagggaaaaagaaaataagcccaagaatttcactgtgtgataattgctttgaagggaaatatattctgcttgtttgttaaagcagatgggatatgatttatttgtaaacaattaaacagttttaacatactggagaagaaattgagtcaataaaggaatcttagctgggattacagctaagactgtaagaatgacagattgaagtaaagaagaaattgtacaaaagcaggcagctagttgaggttgaggagaggaataagagcaaattattgccaagtcttatgtatcaactggtaaactttcaatcttattcattggaaaaatgactgataaacactgtgtacatatcacaatgtttaaagtttctttggttttatttttaagagaaagagagtgaacgacctcttcttgatggtgacttgagaatagtatctttatgttaaagagacccgtaggatgtttaaaaggcctgtggagtacacctaaggtgactactttaggcgtgactgatcatctaaataagatggtcaagatttctgggaaatttctggtctgattaaagtctgtgaaaacttaggctgtcatcagcattggcaaagcattgcagaaacattgcagggatattggcgatgtttactgagaagactccacgaaaacaggtggttgctctatgtatgtttgaaattctagaggcagccaagttatgatgagtaaaataagcaagtaattttgtttttcttagttaacatttgataattcagtcttatggctctaaaagatattaagtatgttttattttaatgtgtttctatttttaggaaggaaaatctgaaatgtgctagtatctgaatttcggaagaaatgtagcttggttttagatagctgttaggaaatatcgccatctaatggcttttgcatcaaattgcagataacagttcctgaaggactccataaaagaccccataagacgcctaaggacttcataaaatgaagactccataaacttggtccaatagatttcacttacttcatcatcaaaaagctgtcagagtgtgatatgtagaaaacctaattataattttaagtgctcattttgttcatcaaccatcgttaaaacaaaaatagtatcttgttacaaataaacttatttagtgtattcatttatgcatattttgattattgacttaagtcagtaactgttagaatgaagtttaaaaatccgtaaattcagagaggaacttcttttcttctgactagttttttgattcttgaatgacaggttgaaacagatgttctctatgaacataaccaaatcagcaacgttaagtttgcattcctagaagcacttacatgttacagcttaccagagcctgaagtgatgcctccttttgcctcttgatacagcacttgtcttatggcaacggcagcttacacgtggatgccgctttccagcagactctctggagcgtggccccaatcagctcaggaagtgaggcagcccaaggtaaaaactccacttcaattagagggcctgtccttgctgcaaagttgacagtcatctttggaattgtgataatgagctgattgttaattagagctttttgtctgtgtctaaatattctgtaatgcagatacctgacatttgaggatcttgtttaaactgctattttaacagtgaagcttgggtgaagattaatcttcccttatttttatgctactgtcagctttagtttatttgtgtatgctttatgtgatagcttcctatggattgttttcttcaattttttgacctcagagtattgcctggttggactaatgtcaagatttcttattttctgaggtcatgccttatagctggaatacgaattttacaaaggagcagggtttcctagggaaatatctgtatatgttctggttattccaacttacataggttcacatttgattctaaatgtgtttgtatgtttaacagaggattttatgtgtctgaggtcatgcttttagtgggaatatccctaactgtgggactcgggcacccaggactcagagggaacagcaggcactgtctatctctgtgaccttggccaggtccttaagactcactagacttcagtttctttacgaaagtagaagattggaccagatgatctgtctggctatcagcacctgacactgacagtccagacctgaatgattttttatccttacagggtatctcattggtggtgatgtcctcaggttgctgcatggacacatggacgagtgtctcactgtcccttcaggagaacatggtgaagagcagcggaggttagtacctgagctcattgcattgagacttgcactcttttgccttgatgtaatgttttaaaaactagggatctattcattcaggccagtagcatcatacaagatgggctactgacattcattgattcactgaagtgatccatttgttgccccctcttagctttttctcatgttatatttctattacctaccaacagaagaactgaaaatttttgtataattaaaacatattaagaaacactgaacaaaattaacgaagtgagaagagtgaccacattgcattaaactacttagaacttcattaaatgctcattagttttgattaattttctttttagaatgtttaatctcaaactcagttttgaagtcagagttctcaaattgcgtacaattttaggaccctttgctatgacctctcatttattgatacagatgatagaattgatcactttctctcatatttaatctgatataatacctctctcatgttaatttatttggcactgggacaagattacaatagtatgaatctactgagaaaagtgcacaaatattacaaaaccataaaaatatttagaatagtttgctactgctctaccttacaaattaatcaatgaatgtagtaagatgaatatgtaaataagagattgcagtgagagaaggtactgtgtggatggtttgttatgtatctttaaatcttttagtggacatttttcatattaacatggacacttaggtaactattagttaataattatttatttttataatttaataaaaatacatagggaccatttagaaaattaagagtcatttaaccagctgcataatctcaggaaaagtccctctgagacctgggtactgggtcttaacctctgttcccaggcagacctagataatggtcaagagtgacataagtcccctggaaacattccgtaagctaaaactgcctctttcagtaggtttaggaagaagatgtcgatggtgtcagtagggtttgtataaaagataatggagattttaagacacttggataaggaattagtttcaaacagaaatataaacttaagaactagagagatgtcaagcatattctgggaatagcaattattccagagtgattagggggaaaatggaggaaaaggtggaaagtagacaagagaaagatccttagtgccattcccgtgggctggcttctattctgaggttgttaggaagggatgtggggatcagagtggaatagttagttctcttttaaaataataactctgttaggcaaggagaacttagattagaggtggggagaatctgagtcacggaaatgaaatgcagtaattcgtgtgacaaaatccaagaacttagcccagataatgccatcagaatggagaggtttacttgcatcatagacatttagataaaagtgatgggtttaggggagaactagacacaggctgtgagagaaggtatctaatccagcgccatctttttttctgcctcaggggaagacagctggagctaaggattgcaggagatggtacatgtttgctatgaaagatggagttaaactttggttacagatgagtacagtctatgagacgtccagtaggaaattgggatgtctgagtctttaacttaacaaaacttgggatgggtgcaaattctaagtgtaagggggatatttaaaggaatggggtctatcatatgttcatcagatggagagggaagagctgggattagatgtgtttgtcgattgggcatggccttatgaaggctgtaaagacctggaatagcctaatcaggcagggggctgaggatggattcctacagaatgctgatgtttaggatgtgggcagagaaataagagtcagcaagagagtcagagtgatagtttagtagggaaccagggaagttagtcattgaagtcaaaggattgggttgtggatatgttaaatgctatggtgtgtttatttggagttagagcttataagagaccatgccagagtctttggatcctcagtccctgatttgttaaatggaagacagactaagtgtttcttagagctttttcggctgtatctacagacactgtagagcttcgtggttaaggtaatggactctagaaccagacagatctgggattggggttctgctctgccacttaccagttgtgtgactcatgtaggtgacatagtttctttaaacaatggtttcccctctttgtaaaatgcagcttaaatattatctcctgctttatggggctattgaaaagactaaataagaaaatacacgtaaaatacttgatgcatattgagaaatcaacacatttattgttattatttagtctgttgctattatttagtctgaagaggcagcatttagccagatatgattgaaaagtttgagggactctgggcatatggatgacagaatggcagagcatagactttgtaggaagagaggccagactggatccaagaggatcctttcgatggctagttatgattgcagagaaatctaggggacatttcaaagatattttaatcatgttctggacccactctccctttgcatatatgttgaagcctgcccctcctttccaaatagtcttcttgatttcatgttgataatttcagttcaacttattcttagtatgtaattagaccagcctatcaggactcttggtaggtagtgatggtggtaagaacgcgtttgtttgtgtccctttttatagcatatttacatgggtgaaattagattaaaatggatgtcagattatgactcgagggagaaaatgagtcagcagtaggcagcatggagctgaagggatgttgcttaagaaaaaactatttgtgttggttatactgggattgagcaattatttgaatagaatgataaaaataattccttgaatttcacaattatatagcacttcattatttctaaatcttgttaataccattgtttagaaagttttcaacctccctctgttatttccctaggtcattgtaaggaacttgggggaggcaaaggatagctcaccccggaagcagcctttatttatttgttatcagtctgtactgggggagacatgcataatgatcatctaaaaatatacttttttcattcattaaacaaagaagtaaaagtaatttgatttttgcacagtgacatgaaagctagagaaggtcctgggaaatatgtaaaaaaaattttttaccttataattctttcctgtaattatgatctggctatactcattaattgtatgctgttgttaacgttaaataactaaagtccaatttactttgttaggagacatagtggaaactattaaggagatggccagaaaagatgtttacttctgagtgatttaggaatagtctggtcataaatgctgtgtttctacatggatttgtgcacctgttcctgctttgttctattgacagttatttaatatacataactgtaattgtagctattgaaaatccacctcaataatgggttttatgattctggatatcagtagagttacctttaccttcctcttcacatttagatatgtatgtgtatgtggttacctattcattctcctaaagaatgttaataaagctcttagaatgaagagcatatagagctattcagttaagaacaactgaattggagatgatgcctatcagagttaaactaaatatttatctttttctcatgcttcctgcccattttgcttttatggattgaatcctgacgtgttcatgaaatacagcatcattattgttttaagttacttgagatttttttccgaaagacaaatcgctctaaaatgactagtagacaacttgtctaaacaacaacaaaaatagtaaaaatataacctatagtagttgtgagcagtcaggtataagggagagagctcattagtattaactatagtgtcgtaactttttagttcttattaaactcttcaattagtgagatagaatgagttaaagagaagcaagtctggtagttgggaagggatgtgtcagtatcccttgtcaatcatgttttaattattgctttaaaaataggcttttgcacaacagggtaactatagccaacaataaatttattgtacattaaaaaataactaaaagagtgtaactggattgtttgtaacacaaaggatcagtgcctgaagtgatggatccctcatttaccctgaagtgattattatgcatagtatgcctgaatcaaggcatctcatgtaccccataaatatatatacctactacatacccacaaacattaaaaataaaaacttaaataggctttcattctggaggcttgacatttgactactaaattttatttcaagcctgacatattttatgtggagagtattttctgttctagattttgtttctagattgcatctcattatttccatccaaaattttatgtgaatataataaaatatcaacaaaggcatttcctttatgtgcacatagacttatttatggatttgatatgcactatgtgaataaactgtgcatacttttatattgatacattttaaaatggatgcattggggaagattatttggggcctttagtttggaaatctattaaggaaacattgtttgaaaagcattatttatgttaaaaacaggtttgcaatgtcgaaactttttattgattcaataagaatgtgtagaatgactatgattttctgggtgctggggctatagtagtatacacaaagttacaaagtttattttctcaagaagtttacattctagtgggcatatgcggcaataaatacgtttatttctaaatgtatacacttacccacatatacagagatgaaatgcattaggtgatgataagagctaaggagaaaaataatgcatggaaggggatggagagtgttcatgtgtgtggtatgttttgtggggtggtatgacggagaggtggggagagaaggagagaaagcttgttcttcttccaccttatctggcattgctcttggcatatgcttgctgtgtcttgttactttcaaatgcaggccaattaagtcatagtttctgacagtatctggaaataaatgctacatttgcttcccaaaatgtgactcagcaggaaaaagctatgccatgtgtatgcatgacaagatttttacctccatgcccccttttaatattatgatgatttaatgagctttagttgtaaataattgataaggcatgagatggattggatgtaatgaattaaatgcctctccatctggcttagaaagagatgcatagtttatatctgtgtacacaactggatgactgatatccttgtgaggatatttgtatgcctttggccaccacctaggaggaagctcttaaagctattctgttgttctccaaaatggtcaaggataaagtttaacctatgagggtttttcttctttttctctgtcttcaggtcctgcatatatcttttcagcctggaactgagagttagatgagttagctaaacagtcttgatggaatagtcagtacataaaggagagctactttctgctctttgcctcttctcctttgggagagattcgctttttaccccaaacttaaactccttgctgattgcagagagtgcagtagctgctgtagtttgtcatgtgttctggaagcctgacttggtctagagccgcactctcaaggcaaggactgggtaaaatgactgcttcaaaaacgtgggcttctaacacaagattaaaaacattcataggaatttgagctgttggatcttggcaaaaatgaaaaacaatgagacatttgatgcatttagagtatatgaatagaaaaacagacaatagattaaaatcaacattatacaaaaaaatctctcgatgattttctcaattaaaatttaagaacatgacttgtctacactgggtttattaacttaatctatatgtaagcaatatctttcagaagaaaaaaagaaagagaagcatcttcttttgtaaatttccagatgcctttatggttgtattgtgttctgcaaagcaatggtaacaacatgtattttgttgtttttctgctctagtcctacctacatgattctttcaatggtgattcaaagtgtaagctattgttgtttcaaatctgtgctgattcatttacattttatgcagaggtgtcatctcaaaacatacctattttcccttgtgcagcaacttgaatagagctattgtggcaaactgagctcctgaataaacaagtaatgcttcttgggatgctggttaggcaagtacttcttgatttgttactaggaagagactcctgacagctgctttagcacctgcctgcggctcagctgctcagccacatgctcccaaaggtaccagcagcagaaattctcctatgaaaatgtgtcaactgaaacgcttataatttcactctgaaataaccttttaagactggatctgcttttcaatcacctcaactcaattcttttaatatttattgagggacttgtatagcccagacatctttggcatgtgctgggtatgaaaacatgtctaaggccctgccactatctttctggaactcaccgtctctattagtctgttctcacactgctataaagaaatacctgaaactgggtaatttataaagacaagagtcttaactggctcacacttctgcaggctctataggctggggaggcctcaggaaacttacaatcatggcagaaggcgaatgggaaggaggcatgttttacgtggctggaggaggagcaagagagcaaaggggaagtgctacacagttttaacaaccagatctcgtgagaactcactatcacaaggatagcaaggggaaaatctgcccccatgatccagtcacctcctatcagtcccctcctccaacactggggattacgattcaatgtgaggtttgggcggggacacaaatccaaaccatatcaccatcttttaagatctcaacaacactatattcaggatgaagtgaatgttaatctgggagaagccatttataattttggtaaaacttagatggtagaaaacatattttaccattcaaccatgtgagaaagatcagccaagtctttgttgacctttgattttgaaggatatttttgtcagcctataaaaagttaacaaaaaagctttgcttttctctaattagtttgaacctgctattcaatatcaactctaaatgggaattgcaggtgagtaattgtgggtgactgtaactatttttcagacgattcctacatgcattttaaatacgagggtctagtcatacacgaacacaaccaaacttgattgaggacacgtccgctagtaggactgtctttttttttttttttttttttttttttttttgagacagagtctcgctttgttccccaggctggagtgcagtggcgcgatctctgctcactgcaagctctgcctcccgggttcatgccattctcctgcctcatcctcccaagtagctgggactacaggcacccgccaccacgcctggctaattttttgtatttttagtagagatggggtttcaccgtgttagccaggatggtcttgatctcctgaactcgtgatgcgccctcctcgatgtcccaaagtgctgggattacaggcatgagccaccacgcccagccaggactatctttaacttccccacactttcacttcccgcatcccatagtgccactgatcacacgtgttggtctgcatattcatctcttccattcagttttcagccagggctgtgccattcatttcttgcataccttttgcatagtgaggtatatatgggaatctgcatacaaatgctattgtttcgtatttgtgaaagaaagaaacggagaaaaaataactcttgcactttaatgtaagtttggttaaggatggctgtatagagaatcacccttggttgtgaggtcccccatttatataattttgacagttcctgaaggattgttatctgccagcaattaggggcggggaaagaaagccatcttaataaatcagcataacaacctgagtgagtagaaaacattttgaggactatgaatgactccagtatgcttggctaagtcatctatattgagaataccttgatttcaagtgagtaactctacatacgggaagagtctctggaccaatagaataggaatctgaacgttgataacagtgatttaaaacaaaagcatttttggggttgtggatatctttgagaatctaatatatgctacagattcttccatagagaatttgcatacttgccaacatgcacaatttttgtgatgttaaattatgttttctcccactattttctcttatttcttcccatttaagcagccagcagtccctgtgtttctttgcctgaggggaggtttgagacttggcagaaagctcaagttttctgcaaggcatctctcttcctgactctcagtccccaaagactaaatctaaggcatttgttatgcttaatgtcttgaacagaaaggaaagagggattcttcagacagaaaaaggagacgttttccccagacttaaaagacattcacatggatcaactggacttccaaacatacacaaaagagaacctgggcctaaacttcacattttatatcaaatctaattccaaatagatcacagacttaaatatgaagcacatacttttaggaaaacaaacataaaagttttaagggaaaaaaaatcagaaaaaaatctttgggatcatagagttcttaaacttgacaccaaaagtatgtctataaaagaaaaaattaggctggacgcagtggctcacacctgtaatcccatcactttgagagactgagacaggtggatcacttgaggtcaggagttcaagaccagcctggccaacatggcaaaaccctgtctccattaaaaaatacacaaattagccagctgcttgggtggctgagacaggagaatcgcttgaacgcaggaggtggagattgcagtgagctgaggtcatgccactgcactctggcctgcctgacagagcgagactgtttcaaaaaaaaaaaagaaagaaaagaaaaaatgataaattgtgttaacagagaagacaaaaatctatgaaatattttacagaggttaattctaagccgatatgagtgactgaagcccagggaaaaacacaaactcaagaagccttgagtaaatggtcccgaggccgttatgtcacgactatgttttatacagtctagggaagtagaagttacaggccaagtcataagtgaatacatggaggtgatatacatcagccttgcctaaaaaggtgggatatcttaaagtggcagcttacaggtcataagtgggttcaaagattatttaatctgcaacttgttaaaggagcaatgctttgcctaaaaatttggagtcagcagaaagtaatgtttaaggaagtctgttaaccagtaccctgggtctgagtgacctgtaggggtaggggacttaacacttgtatggcctggccttacaccctgtttataatttggtatctttttttttttttttgagacagagtcttgctctgtcacccaggctggagtgcagtggcgccatctcggctcactgtaagctccgcctcccaggttcacgccattctcctgcctcagcctcccgagtagctgggactacaggcacccaccaccacatctggctaattttttgtatttttagtagagacagggtttcaccatgttagccaggatggcctcaatctcctgacctcgtgatccacccgcctcggcctcccaaagtgctgggattacaggcatgagccactgcacctggtctataatttggtatcttgttgtcatgaagagtctgttctgtcagtcttctgagatctattttaacatgaatgccggccagtcattgtgtctagactccaaaaggaagggagataatgaaatgtgtctaacctcttgtctcatcatggccagaactcagtttttcaggtttctctggggtcctctcagccaagagaggaactgctcagtcagttggggggcttggtatcttatttttattttacaattgaatctcatcaacaggagaaagtgtgttttgctctgtaaaaatccacgtggagagggtaaaaagacaagctacagactgagagaaaagatttgcaaaccatatctgataaaggactagtatctaaaatacataaagaatcaacagtaaaatacaaacaattcaattagaaaataggcaaaaaccatgacagctatttgtcaaagatgacatacagattgtaaataagcacatagaaatatgttcagcattatgacccattatagaaatgcaaattaagaccacaatgagataacactgtatgcttatcagaatgactcaaacaaaaatattgacagccacgtgctggtgagaatgcagagaaactgtcatatattgcttgtaaaatggtacagccactctggaaaacattttggcagtttcttaaaaaactgaacctgcatgaccatgtggcttagcaatagtactcctgggcatttattctaaagaatgaaaactgtgttcacacaaaaacttgtacacaaatacttggtgtagagcaactttatttgtaataatcgaaacatggaatcagctgtggtatgtccatagcgtgggatactactcagcagtgaaatggaatggtctattgaaacgcacaaccacctggctgtacatggtggttcacacctgtaatcccagcattttgggaggccaaagtcggtgaatcacttgaggtcaggagttcaagaccagcccaaccaacatggtaaaaccctgtctctattaaaaatgcaaaaaattagctgggcatggtggcacatgcctgtaatcccagttacacaggagcctgaggcagtagaatcacttgaactcaggagttggaggttgcagtgagctgagatcatgccacttcactccggcctgggcaacagagtgagtctctgtctcaaaaaaaacataaaaaataaaaattgaacacacagcaacctcaatgaatctccaggcaattatgctgaatggaaaatatcaatccccaaaggttgcatactgtgtgattccattttcataacatttttaaatgataaaattttaggaatggaggacagattataggccatcagatgttagggaaacaggggagggaaatgagagggaggtggatgtggatataaaagggcaacttgaaggaactttgtggcgtaggatcttgcctgtgatggtgaacccagtgttggatataaaatactccaggaataaatgctgagtgccatgaagtaaaaccagtactcaggaaaaagtttaatgctctcagcaaggcaatctacttctgcagaagggtgtcactcacatcaatcaagttcgcaagtgcacacagaacaaaggagaccagggggtttttatccttaacgcagcccctatctctgtgtcactcccccatgggctagggttggaccgcacaatctgagctgactccattggctacttgtacatattttcctaaatatagtgggggaggggaggggaggtacagaagtggagtgtgtgagacgtgcagtttcgggggaacaatgggtataggtaaccaagtgaacaaatgtgagttattgattagagctgatgggaagggggtagggtgtttacggtaactaggggcaaggaagaacaaaaaagttgagtttgagaacaaaggataaagaagttaacaggctaaaccctttgaagagaaactcagaaagatttcttgtgtcttacaccaggatcttacacaaatgataaaatggtttagaacttacacacacacacacacacacacacaaatgaatacaagtaaaattggaaaaatctagtaagtttgggagattgtatcaaaatcaaaatctttgttgaaaaactgtagttgtcaaactcttactatagaggaaactagacaaaatgttcaagggatttttattatttgttacaactgcacatgaccagagtgatctcaattttttaaggcattcatagagactggacaaagagcaaagatttctggggtcccctttcgggataccaagcactcagctcccgacagccttctcctccgcattccatcctggcctctaaggaggtggcaagaggtcagaagggaatgactgtggagatttttactttagcacaatgtcctgtgtctcccaggtggataaaaagcagtggccctcagactggaagggggcatgtaaagagagaccctgaatataggagatctagcaagcaaattggtcctgcccaatatctgatattaaggtactgctttaccaagaatgattagggcttgatttcctcactatcctgatgggagggagactcaaagttggaaatagttatattttaaagataatttttaaatgttatattcataataatagtagacattatttataataattgttgacattatttcacaccaacctccccactcccactgagaaaaactaataaaggtagacactctcctttcccccgaaagtagagagtgaacaaagcagtgaagatgtagtattgggtcatagtcccaaaaaggaaggagatcagggaaatgaatttagtgtttggagcagcctcttctctctaggcagttgcaatgtctgaagggcttagaagtgaagcacaactgttagaagaatcataggatggaaatggatcaaaaattgtacaaatctccctaaagaagaggcgtgtttggtgggacctcaaagaactgtatccctaaaataattgtgatccagaaatagaccagaccttacaagtattgagacccagcatcaaataatattaattgccatttgggatttgccataagacaatatgagattactatggccctcgtctgtcaattctgcaagaagcaaaagtaaacctttagggagaaaattacatataaaactcaaattgcctatataattttatatatacaatgtctgataatcaaaattaaacaggctattttgtttcagcaccaactagcatactgcggtatatttctgacactaaccacctggagttagcacagactgcacaagttatgggctcagttttctccaaaactgcctctatctcagataccaatcacaaatgggatccccagaccacttgcggttctgaccaactggctatacatttagaggttcccataatccctttagattcaataactcactagaatgactcacagaacacagatgttatacttatgcttgcagttttattataaaggctacacatcagaccagctaaatgaagagatccataggatgaggtctgggagggtcctgaatgcagagcttctcgttccctgtggaattaggatattttaccctcttagcacataaatgtgttcactatccaggatgcttccttgagcttcagtgcccagaatgtttgagtgcagttttattatgtaagaatgatgcattcgatcataggctacatgatggaattcaatctctagcatccttcctatccctagatgttgtgctggatcaaacctctacccctttaatcgtgtggtttatctttccagcatggccagctcccatcttgaagctatttaggggcccaccatgaaccacatcattagcataaactgaggtgtgatgtaatgggctcatgaataacaaagccacttctattcacttggaaaattccaagggtgtactgtcttccaggaatgaaggacaaagatcagcctacttacttattatcaaacatgggcacagaagatgataggacttgactaaagatcaagagcatatacatagtactgaaaaaggcacatagatattagacacacagataatggagtttaattaaaaatatttatgattatctggtggggtacagtgtttctataatctcaacactttgggaagccaaggcaagaagatcacttgggcccaggagttcgagacctgcctgggcaacataaagaggccttgtctctacaaaaaaaaaaaagttttttaattagctgggtatggcaagtggagagctgagtatagcaagtatggaggagagcttgagcccaggaattcaaagctgcagtgagatatgattgtgtcactgcactccagtctgggtggcagagcaagaccctatctcttaaaaaaaaaagaaaaaaaaatatatatatgtatgattattatgttctaagaattaaaagatgcaacaatttagtagagaactggaaactataaaaaatgatcatatagacattctaaaactaaaaaataaataacttagaaacaatggatagatttaatatcagcttagaactagctgaaaagagaattggtgaactggaaatcagatcagaagactattcagactaaaacactgacagtcaaaagattgggaaacaggctgggcttggtgtcacacacctgtcatcccagcactttgggaggataccttgaactcaggagtttgataccagcctggacaacatagtgagatttcatccctacaaaaaaattgaaaagccagatgtggtggtgcatgcctatagtccctgagactcagagtcttactctattgggcaggctggagtacagcggtgaaatcatggctcactgcagcctcgatgtcctggcctcaaaccatccccctgcttcagcctcctgtctccaccctccttccccccaaaaaagattgggaaatatagaaaagaacaaaaaagatggtaaatgatattatagatggtctatcctacatgcatgtaattggagtcccaaaatgaaaggacaagggtgggagagaggaagcagccaaggagagaggaaagatggatggagggagacaaagagaactcacaggtgcgtggagtaaaggaagtatttaatacaattgcttgaaagttctccaaaattgactaactatattaagctactgattcaagaaaaactatgacccctaaataagacaaatcagatcacaggtatgcacatcagaggaaaactgctgaaaagtaaacacaaaatgaaactcgaaaagcaaaaagatatagtacctttaaaggggcaagagtaagatttgcagttgatttcaactcagaaacaatgggagacatgggatgtaagcttaaaagtgcttaaagaaaatatctggcaatctaaaattttatatccggtaacacagtgatactttatttaatttactttgggacagggccttgctccggctagagtgcagtggtgtgatcatggttcactgcagcctcaaccccctggcctcaagcaatccttgattctcccaccttggtctcctgagtagctaggactatatgcgtgtgccaccatgcctggctaatgtttaaattttttgtaaagacagtatcccactatgttgcccagggtggtcttgaatttctgatcttaaccagtcccccctccttggcctcccaaagtgctgggattgcaggcatgagctactgcacccagacctagtaatacttttagacaaagttgagggaattcatcaacaccagattcacattaaggaaataccaaaaagagtttctttgagtagaagaaaactatctcatatgtaactttggaggtatagaaacggaaaaaaagccacagaaagataaatacgagagttaaatcagaggatactgagtgaataaaataatgataatgatgattataaaaacagcaaaaacatcttggattttaaaaccatagagaacaggctgtggtggcccacatctgtaaacccagcagtttgggagactcaggtgggtggattgctccagtctaggagttcaagaccagcctgggaaacatggcgaaaccccatctctacaaaaaatacaaaaatcagccaggcctggtggcatgcacctgtagttctacataatcgggaggctgaggtgggaggattgctggagcctgggaggttgaggctgtagtgagctgtgattgcaacactgctactgcactccagctgtggtgacagagggagaccctgtctcaaaacaaaaaattatagagaacaactcattacaacactggcacatgagtcaaggggaaagtaacttgaattaaatggtggttcttgcatggtctggaaagtggtaaagttactaattagatcctgttataataagccaagaatacatattgtaatctgtaatcactgcaaacatagtaaaagaatgtaaaattaaaggagaaaccataaaaatataatagtaatacttaatccacaagaaagcaggaaatgagaataagaaacctggagtaggacaaatattaagaagaccaaattctgatgtggcctcgagattctcaccccagctatacacatcctgtatataattcctccctttttgtgtgatgggactgggtatatgacggacttcattcccatgactagattacattatttgacaaagctgaaagaatgttgcaaatgtaattatggcccctaatcagttgactttacgttaattgaaagggagattctcccagggtagtcctgaagtcttagcttcaaggtgtgtgagattcttctgccatgattgatgaagtgagctgctgtgttttgagagggactgtttaggagactgtattgcaaagttgctgagagccctctccagctgtcagagcgcaatgaaataaggccttcagtcataaaactgcaaggcactgaattctgggaaccactggtgagctcctataagggcctgagctccaggtgggaacccagccccaaccaacactttgatttcagcctatgagaccctgagcagggaacccagctacatcatgcctagacttccaacctacggaatggtagaataagaaatggtggtgtttctcagccatgaagtcaggggtaactgattacacaggaatagactaccaaaacattctgtgtgacatcaccttgggaatgaggacatatagtaaaggactgaccctaaattgtagagatgaggagcatctagcaaaggatgcaactgccagtgatgtaggaggaaaacctggaaagagtggtatcctggagtcaaagcataagattgccaagggcagtggggtgatcaactatgtcaaatgcagttctcccctcaaatatatccacaaatggaatgcccttgaaacaaaatgttttcattcttttctttcttatagcctcaacgatgaactttgtgaattactgtcaagtctaatccacagactcattctcctgaacttctatcctaaatgttcaagttcttattgcgtatgtctgcgtgaatttcacttgagacagcaattcaaatatatcaaccttaatttaattccatcagagatgttttccttcttacagcccataacttggttatgtataccagtctactatgctcaaaactttgccttgacttttcttttaccttttatgaaacaagagaaagaaggattttaggtcctattgattttattgctaaattttttctctattagacttgtttctcttgctgatgtcaattttaagggtgcaccttcctgtttactgtgatttgagggttctgttgtgctgttgctttcagattaatatccaaagtctttatctttaactcctttttatccttgtggatttgtgaccaccattcagaaaagtaggtgaaaaaactttcttaactttatctcttcatcccaccatcaaccactgaggtattcttgcactttgaatatggcagcattctacttcatgattctgcagcctttctactctcactgccacgctctcattcctcatatcctcattcttttctttgcatgctgaattcttactcagctccaggagtgaacccaaatatctccctcatgaaaactttgcagagctcttcttgacaatttatgtcctttcatcccctcccctccccttcccttcccttcccttccctcccctcccctccccttcccttccctcccctcccttcccctcccctcccctcccctctcccatctctttatacgtagtttccccatactactacctaggctagtttttggtgttcgtgtctttcttaccatgtcaaactgtacattcgtggatacaggaactttggtgttttatatttctttttcctaaaatatatacctatgtgtctagaatatgaatggtaaacaattagtgtttgtttttggctaaatacaattatatttctatatactgttgtttttacgaaagaatagaaagataatagttcttcatattatttacttttgcaacatttacacatacacatttgtagctctccatccttctcttttaaagagaataatccaagtttatttgagatagcctggtgttattttgtatattctggagaaaaaatgccctaaaaactacctccttttttccctgtaatatattcctaatatatttgtattactatattagtatttgttgagctagaatacctaatgatttttaaaaaattaatagactttattatacacttttaggtttacaggaaaattgagcagaaagcacagagaattctgcctcaccagttttcttgttattaacatcttgtattagtatggtactcttgttataaatgataaagtaatacggacacattattcttaattctctaaattaggcttactcagtgttgtacattctatagactttgactaataacatgtatccacaattgcagtatcacacacaataatttcactgctctcaaaattccctgttccccatttattccttcttccctcccctgaactcctgaaaaaatatttattttactgtctccatagttctgctttactcagaatgttaaatagttggaatcatatagttatgattccaaactggcttctttcacttagcaatctgcatatatggcccctctatatcttttcatgacttgatagctgatttctttacatcactgaaaaacattccaatggatgtgttacagtttattcacattttggctgcttccaagttgtggtaattaaaagctactattaatatttacatgcaagttttgtatagacctaatttatttgggtaaatatcaagaagcacaattggtgaatcctatggtaagagtatgtttagctttttaagaaactgcaaaactgtcttccaaagtggctgtatcattttgtattctcaccagcaatgaatgggaatcctctccagcatttaatgttgcagtattccaggttttggccattgtaacatatgaatagtgatacctcaagttgcaaatgttgacatatgacattgagcatctttttatatgcttatttgtcatctgtatatctttgatgagatgtcttagatcttctggtgatttttaaattgtggttgttttttttttttttttttttaaattgagacggagtctggctctgttgctcaggctggagtgcagtggcatgatctcggcttactggaagctcaatctcctgggttcacgccattctcctgcctcagcctccagagtagctatgactacaggtgcccaccaccatgcccggctaattttttgtgtttttagtagagatggggtttcaccgtgttagccaggatggtcttgatctcctgacctcgtgatccacctgcctcggcctcccaaagtgctgggattacaggcgtgagccactgcgcctggccaaattgttgttgaattttaagagttctttacatatttcggatgccagtcctttcccagatatgcgattgcaaatattgtctttcagtctctggcttgtctttttattctcttaatagtgttttcttgcagatcagaggtttttaattttaatgaagcccaacttaccaattttttatttcatgaattgtgctcttgatatctaaaacatcattgtcaaatgcaagaacatctagattttctcttatggtattttccagcagttttatagttctctgtgttacatttaggcctatggttcattttgacctaaatttagtggaaggtgtcaggtgtgttctagattagtttttctacacatgtgtataaagttgttccagcactgtttgttgaaaagactatattttctccattgtattaggtctgtgatccattttgagttaatttttatgaagggcgtggtctgtgtctagattctttatatatatatataaatggatatccagtcttttcagtactatttggggagaatgtccattgacttactgattctttgttagagatcaatgtgctatatttgtgtgggtctatttctaggctctctattctgttccactgacctgtttgtctgttctttcaccaataccacactgtgttgaatactgtagctttatagtaagtcctgaaatcagatagtgtcagtctcccaacttcgttcttctccttcaatattgtgttggctcttctatgtctttcacttctcatataaactttagaatcagtttgttaatatctacaaaataacttgctgggattttgactgtgattgctttgaaactatagatcaaattgggaagaactgatgtcttgaaatattgagtcttcctatccatgaacatggaatagctctcaatttatttagattttgtttgactttttaaatcagaattttgtagttgtctttatttagattttgtacatattttgttagatttgtatttcagcatttaattttttggtattaagataaataatatttttactttaaatacgtgttgttcattgctggtatagaagaaattgatttttgtgtattaatgtcctgaaactttcctataattgtctattagtttcaggagatttttgttgttattcttgattctttgagattggggtaaataatcatgtcatctatgaagaaaaagttttatttcttccttctcagtctgtatacatttaatttccttttcttatgttattgcattatctagaacttctgttacagtcttgagtagtagtggtgaagagaacattcttgatttggtcctgatatagaagcaacaagtttcttatgattgagtatggtgttggctgtaggcattttttgtagatgttctttatcaacttgaggaagttcccttctattcctcattggctgagaatttgtattattaatagacactggattttgtcaaatactttttcttcatttattgatatgatcaatgatttttttctttagcatgttgatatgatggattatactatggttcagtgatatcttaattaccttatgtatacaaaaggagaaaatattcatttttgctatcatacttgtattcaaacagcacattccttttgaaataaaaaacagtgatttctagaaatacctgttatgacatttataatatattttgtttagattatgaaataactactgatttttgaagggagaattgaattctgtggtatatcacagaaattctatggtatattcattgaaagttgagtttggataaatgaagtagtattttattacttccctgcattgcagtaactaaaatacattgatatggcttcttctttgtccctattatattctacagaaacatgtaattataatatgaattggcaaggaaatcttcagagcctggtaaactgttttctctacttttaacatatgtaatggattcatgatcaaaatttgatgtgactgattgaattgtcttttattattatttacctcttctggtgttcagtatttgttatatactctaccctttttcttgacaaaaaatgaaaccagaatgttatgtattcagaaaataggactctgaatagttctgtatcatttccccattgctctaaagtcatggtaaatgtaaaaaagagaaaaataaagttcacttagagcccctctcaaagtgtccgtgatactgtagtaataatagactatgtaagctattcagcattactgcactaaccttgtcagggctttgttatgttgaagaaacaaaagtagattgaaaaatgccccagctgttctttcatgtggcttttttggataagccaagtgctctgaagcgctgtgaatttgtctatatttctcttaagggcaaaaaagatctgtcacaatgtagatatgaattctagatttagaaatgttattcaagatagataaggtaagacatttccttcaatttatgaaagaccctagaccctggattttatccagctagctttctctgagattaaaatgaccaataatatgggtagaatattctagatctaaggtcaaccaatcaaggcagtaggtcaaatccagcccactgcctttttttgcaaataaaattttattgttacacagccatcctatttttaaaaacatattgtctatgtttgcttttgtatgataataacagaattaaataatgagacagagaccatatggctcgcaaaaccgaaaatatttactaactggccctttacagaaaaagtaggtctgctcctgttttaaaccaccctttcatggtggcaatgaaagtcatagtggtgggtgtcaagtccaacagttctcgagacagtggatccctgtgctggagctacagtaagggtgacaaagcaggtgacttcagaagaggatttaaataagagagaaggtaggaaaagaagtattcttttaatctatataatgtatgcattcttttcagagcttgaattttttatagtgtcattttacaaatgtattgcgatgcatacacaatagaatattatacaacctttaaaaagaaggcaatcctgtcatttgcaacaacatggatgaacctggaagacattatgctaagtgaaataagccaggcacagaaagacaaatactgcatgattttactcatgtgtggaattcaaattcatggaaggagagagtagaatggtggtagctagaggtcacctccagtgactacagccctagctaacaacttgactgcaacctcacaagagactccaaggcagacaccaagcaagaagcacctagttaagatacactgtattcctgacccatagaaacagtataaaataatgtgtttattatttttttaaaaaaagaatgctgagatcctgccattgaattgcaggaggaggctagcactgaagtgactgatttatgatgaagctattaataggtaggcttcatttcctagttacgttgtcccgagcgattttataatttagggactttgaatatcaacaagtgtataatatgattgatttagcaacaatccattcaattcaggcaaaatattattgaatcttaactccctatatggaaggattgaatataaattatgaccacaatcatggtcatgatcatcaccatcaccatctgcatcctcagagctgacatttgttgtgcaaggacttttccaagtggtctacgtgggttatattactcattcattcttcacagtaacccagtaaaaattattcccattttacatatgaagaaaatgagacagagaggtcaacagcttgcacaagttcacacaaagaagtgacatcttaagaaagttaataacaatcaaatgtgaaagtgagtcatcaacttttagttgccctgcagaacaaacaagagagtaactgtgatgtcattggttgacagagccctgtggcagcactcacaatgaaaggaagtggtttccttgcaggttggaggtgtcgcttacaatgtgcaatctttcattaataatgtattttatgattctgtactaaagtccactaattagaattgtgtgccctataaaattttattgtaaatatatgcccaactgtcaagctatgaagaactcgtaaggatttgtgcttttattaatatgctaatgctagtcttttctgggccttagattctaaagatgagctatcctagctgtcaaagtgcctgctttttaccgagaaacaagtggcttgacaactgagataagactcaaattgtgttttatagccaaaaatacaaaaataactaattttatatcagtggacaatattataatacttatgagcagcggaattgatggtttactgggaagaatttgtacttagaataaccttaaagggcctcttcaggcagttttatgcgatcagcctgaaatatgagttcctaaatgaaatgtattatattgtgggataatgtgttatgtaggcataacttacagccttaagtctggaatttttcaaagtactgttgaacaagctcatactgctggttattatatgtgcatatttttaacattcctattcagtgaaattacagtgactttgactttgtctggtttatgagattaaagtttttaaacaaaattctgttcaaaataataacaatgtccagttcttttagcacatactctttttctcagtagctgtaacactgttttagtacattgcaaaaatagtctccagttaacaaagagctgcatgagctcttttgtattttcatatccgtcgaccttcctgaattctggcatccttcctgccatttgcattaaaatcccttgtgatgattacctcaaaaggtgctgttgctatcagtctgtgtaatttcttagagaatctttctcccttttcagtcatccagctggaaagggcatttgctctgagtataatcgtttatttgtatgagttcaaagttggtaataccatttggcaaacttgttggtctttagaacaattgtcctcctagactctgatttgatacttgaaatgcattgcagggaaaagggacaatcccttaatggagcaggtgtattcctctaggtgggctgatttctaaataagtttgagtgtccttaaagtcctttatgaaggactgaaattcctatttatttaagatcttgatattgtggtgccaattttcagtctgaaacagcccatgaagacttgattagacaaccattgacgctctgcacatgccgtgtaatttacgtagggaactatgtaatagcaaagattccccgcctggcaataaataatcaaaagaagtcatcagattctctatacctgccaatgaaacttttaaaaaaatatgaagaggaacaattcagggcacaagaaccttcaagatagagctaaaaatatttcaggtaggaaggaggattcaactttccttttgactttatatttgtcatgtaaaattttaataaaaataccattagatttttataaaagatcattgttaaattcaaaaggtaaagttgtcaaagtaaaccatttgcgtgataattcttcactttattgtataaatccatataactttacaaagatatattattcatgctatttgtatcttagagaccttttaaaaatgttttgaacttaatttctgtataccttattaccttatgtaattgttcctctaacgtaattaatgctaatagtttgatgttcattatttgacaactttctccatgctcatacagatatatgttcacatatgtacatatatgatagatttttagtgataacttgcacagaaaatgtacataatttacactcttgcatcttattgaacagtatatcattgagtttcttcctctattttctgttggtttattttgttctctatatgtcttcaggcaattctttatttacatgttttatttaataattaaaggattgcagattaaaagtgttcaaagtttacctgtgaatcatagacttgttaagaagtgcttttctcttcattatattctagatagagtataattttgtttccctctttgacccatgaattatttagaagtttcttcattttccaagttgtcaatttcttttcttttcagtatttgtttctaatttttttgtttatgatcagaaaatacgatgagtaaaagtctttaaaaatctgataacattttctttgtggtcaagtaaaagacccttattaaaggtcaaatgtatttaaaaagctgtgtctttgtgtgagtgtgtctatttatatatgtgtgtatacacacacagacgtgcacaatgtctatattttgtcattcagtcttacttaatcagtctgagtgttatctgtacattggactttttaaagctttccaggtgattctaatatacaaccaaggttaagtatgttgccaaaatgaaataatgggtctagtcaagtggttctcaaaatatggaccatcaacatcacctgggaatttgttggaactgcagattcttgggcctcaccctaagatgtggtcacttagaaactctggggatgggtccagcaatctctttttaaaaaattattttaattagcacataattgtacatattatggggtagaatacgatatatggcacaaaattatttttaattggcacataattgtacatatttatggggtacaatatgatatttcaatacatacacacagtatagaatgatcaaatcagccgttggcatgtatatcaatgcaaacatttataatttctttatgttgggaacattcaaaatcctctcttctagctatttgaaaatatatgctaagttgttaactatggtcatgctatagtgctatcaaatactagaacctatctctccaatctacttgtaatttttaaatgacattctgtcattcttagcaacatggttgagcctagaggacgtatgttaagtgagataagcaatctgggtcttaacaaaccctcaaagggagaggattctacctcaccgaagacttgagagccgcttacctatgtcagtggctctacactgagggtgattttgtccccaaagggacatctgacaatgttggagaactcttagaactcttttggttgtcacagctggtgggaggctactggtggcatttagttggtagagggcagggttgtaaacatcctgccatgcacaggacagcccaaaagagaatcacgcagccccaaacatcaacagtgctgctgtggagtaacttacttagactgtactttccaaggcttggcttcccattgcaaccagcgagagagttttttaaagtcctgactccagatctgtttaatgtcattggtgagggtgcacataaggatttctaaaaactatccatgtgagtactttatgcagcgacagttgaaaatcactgctgtggacactggttattgatggcaaaaactgcaataacttttgcaccaacttactacctaaaactcttaggtcctaatggatggattagggtgatcccaaactaactgattaaattttatctaaagaaatagacaattatgtacccctgttgtgttataatgggaagtagaaacaccaatttgtgaaatgttcttgccaaaaattcaaacttggacaagcttctagatttctagatctcactaccaatttagaggtatgtgttaaaaaacaccataggaaggctgttggccaaatctagaatgtagaaagtcctccaggacatatggtacagactgattatcaccaaataaatggcaagaagggaagacaagagaggaatggggactattctagaataaaagaaacttaagacccctaactgataagtgtatctcttttggaactggatttgaaaaagcaacaggggaaaattaaaaacatctgtgaggcaatttgggaagttcaaacacagactagatatttcataatatcaaataattattttcagagttgcatgtggaggggtaagtagaggttacaggtaaaacgcggttgtccctatgttgatcattgttgatgtcttctgctaggtgtatgcggatttattttaatattctctttacgtatatttgaaacattccacaataaagatagaatgagaaggattatctaaacaggtagggaacggcaggtgagaatggtgttagaaaaactttcaagacaataggagtttccacagtgttaaaaagaaagtaagtctattggatttggtaacatgaaggtcacttgatgactttagcaaagtctgtttcagtggagaaatgggtctggaagcaagattggagcccactggaaactgacaggagtagacatggtattactgctgtctgtgaggcaggataggctttcatgtgtttacataagacagaccctatagagaggaagacagttaacactcaggaaagaaagagggcatgtgcatcagctttggtttccaaaataatctcaaggcgttggtgcagtcatgaatttggatacttacagcaattacttagcattatgtatggcatattaacacattattttgagggttttggaatttgggtgcatgtgatatgcatccaaagaaattccttttttgtgactttttggatattcatattttgatataaattgcagattgctgtgttaaaatattaagaattgtgttcttacatttctttaaaatgctttaaataatctaaaacagaatttggaagtgcaaatatttatatacatatgttgaaataatgatatattaaactatacctaaacttatcacagagtactttcatggacctaagttagatgagtaaggtgaaatctattcactgggagggagggatgggaagaaacacacacacacacagagagagagagagagagagaatgaatgagattagagggagaaaatggcaagagagaatatgtttaaatcattgtttattcagggaaaacttaggttgatcactgttactgttattttggttatttttatttccagctatactgtctcctgccaaaaaagtataactttaactgtttactcacaggccatttgcttttctctcctaattagcttcaaaaaattagagtccaaagaatgaaacatgtttaactcacatttgggcttttgtttgtttgttgaaacagaactgttcattatgaaggtggcgctgtgtctgttcatgcacgttccctttggagactagagacgctaagagttgcgtaagtagaacttctaaacacagcctaatgcaccaagtgtaccaaatagctcagcgttgtgcttctgtgtcagcctgtgatgctgaaaactacagcaagcaagcgaacaaaggaaacaccgagaaagtggtggacagtttctcttttgtctatttccttccacctacctttatcattccttagcctcagttcaccagctagcaaacctgagaaataagcaataattttgtacagtctgcttttgtctttagcctcatttgtttttctaacatcatctcatcccagaccatgcatctcttggcagaaatggctactaggacagagtgatgtaagatttggagacacgacaagttctttgcaagcctgtcgcacatctcagatctgacagactgtggatttaaccttctaaaagtacatttaaaacaggaaacttgaacatgagcgtaggacagagtcattactggaagtcactatatttacttaaaaatcacttgatagctaagtacaaatctgcattgcaataaaagtcactgtgtattcattatagtaatgagagtttttatatattaatatttatgaaacataaatgtataaagtatttttttctgatgacttaactgtctgaatatttccttttagttcctgtaaatgaatacaatatgatgataaaggtgtcattttgaactattttaagtagaattaaaatttttaaaaataattcgaagctttagtcctttgcctaaaagcagtaaattttcaatgtgtttacttcctagtatattgggttttaaagactttattgatttaggatgataattgatttgtattgggctttaaagacattattgatttaggataacagactctatgggtgggaatgagggctatcttactctagtataactatatttaattaattaatttatttatttattttgagatggagtcttgctctgtcactcaggctggagtgcagtggcgcgatctcggttcactgcaagctccacctcccgggttcacaccattctcctgcctcagcctcccgagtagctgggactacaggcacctgccaccacgcccagctaatttgttgtatttttagtagagacagggtttaaccgtgttagccaggatggtctcgatctcctgacctcctgatccaccagcctcggcctcccaaagtgctgggatcacaggtgtgagccaccacgctcggcctagtataactacctttatagacattttattttgagattattgcctgtctaatggtgatgagaatagtttagaggccttcagtcgtttctgctcctgtgtcccatgcaatgattttgaaaaactttgtccattcttgaacactgtgaggttgacatagaaatcctttcattatcagtttagatgcatagaatataacttccagtgtattttaaatagtgatactttaaaataaaatggttacatcacccttttcaaagtatccaattgactgtaagtaatgctgtggtttaatacctttgtttattgaaaatggtcttctttaacaataaaaatatatattattcagtctttccttttcactacatcctactcctctgcaacaaaaatatttatataaatttatttcttatatttcttatgttagtctgtaactttaaaaagctcttctatattgtcattaataactaattgaaaacattaaatgtctttgatataaatgcacaattgatcaaatctacctaaatattaaaacttttggtaactaccaaacttaaaagaaaatttttattggaaatgcatatcataatgagatggaaaaagaagagacagacttctaaggcaaacaaaggaaaactcatagcttttatatattttgtgattattcagataatttaaggaaagggattttaagtattactcatatttttttacattgtgtattataaaaatgaaagagtaaagaagtgtttatacaaattaattgtatacataattactaattatatatgtaattaaattgtcactataagtgcagtttcgagaggttgtattgaccttgtaaaacagattgaatatgtgttttcaaaatttagagacatacctatacttcatgattgagtgcttaaagaaatatttatcttttttgtagagagagaccctacatctgtcttatttttggttaaaaaaaaaacatgaaagcttctgaaaacctgataggactttgtttttattgttatcgatactattgatgagctgtgactacataaatctagattattcttcaaacttctgaattaagtagtcttgatcctgtctctctactgttgcttatgtttgtattttgaaatagaagtttggagtttattttcactttgattacagataatcaatatatagaaaggagatgatcttatggtcagccactggggaaagggaatgctacttgcttctcatagtccagatgtcactgaggggaataccacagagaaggcagagcaggtagtttttcaaccatttagcagcttaaagagagatgttttgttcttctctctgacccttgattaaatttcaccttcctgtctagcagtaggaaagtaggagattcatatgtacggaatatcattattttaagaagtttttcagattatactgactctttaaactactttggctttattgtagatatgtaaattaagctacattcagtttaggagcttttatttttttaattaaatccctttcattctaggaagtttacatgtcttatatgcaatggccacataattactaattttgcattatatttagcaatttatagtgaagatcctgcttttgtttgtgatagaactatattgcctaatgccaatgtttatattcaatatttgggatactcggtcttctcttttctccagtgagatcctatactatatatttgttgtagttgatgtggcccattcattatatattttatactgcatactcttacacatgaaactattgtcaaaagtttttcagtatcatggcctttttaataaatggttttaatgtagggagttaaattgaatagaaaatgctctcctatattttactccaggcaaaattatagggatattgtaagtgagatatgtgttagttcctgtaataggaatactcatggaaataaaaactatgaattacatagagttcaagttctattttttatgttgcaaataaacaaaattaaagggtgacatatcataaagaagtactcactattccccaattccctttgaggtaattttgagtaaatatcgataatacgtagggcacagttttttgatgttaccataggaaattgctttataaaactccattactattgccaattttagtttttactacatatgattttcttgccttgccctctcatttgggaggaggtgggggtctgggcatgtgagaccaggctagtttgagtggctggaaatgaaagcaaatgtgcttagacttagactatgcagtggttttgccaaaaactggccacattcattccatttctaccagaatcctcttagagacttcaaaggagcactggtacatatgagttctattgaatagaactgagcccagaacatcttccagatacgctagcaaatagtatatatctggttaaaattttgtgctgttttgaaaatgaaggtgtgttccatgatgattaagatgaattgttattcagaagtgattcattatttacaaatatttcattgtttttccaaataatggaaacaaatattaaacatatttccaaatatttcattgtttttcaaataatggaaacaaatattaaacataattgtgaccgggcacagggtggctcacgcctgtaatcccatcactttgggaggctgaggcgggcagatcacaaggtcaggagatcgagaccatcctggctaacatgatgaaaccccgtctctactgaaaatacaaaagttagccgggcgcggtggctggcgcctatagtcctggctactcgggaggctggggctagagaatcgcttgaacccgggaggcggagtttacagtgagccaagatcgcgccactgtactccagcctgggtgacagagcgagactccgtctcaaaataaaaataatagtaataataataataatgataattgtggttttcatagtatttgcaaacaatacacttaattttataagaggaggattttaaaaagcttgtttatttccaaaatagaaatactttaatgtgctattattggtaacaaactttaatttcatcttaagacaataccgtgttatctggttttattagtatacggttattaacttaattggggggcttcccaaattaattgtctttataaacaaattcatgtgaaaatgaacttgttataacattctactgctaattttctatgctaacatctcaagtcaaaaatccaggttaggaaaacaacattaaattgatttataatttactaaaagattgctagctttgaaccaagtactctcaatttgtagaacacaaacatttttaataagtctgtatgaacccaagtttattaaataataagattatattgaaaatctccatatatttactttttctttgactcattgtattttgacaaaatcatccagtgtaaactgtcttttaaaaaattatccttatgtttcattttctgcttgttgttgacatatgaagctttacaacattcattatttttagagtatacactttttcttcataacatatctggctgtataccttttgtgctttttggccttgaattggaattatctaatatcaaatttgtcatttccttttgaggtttatttgcttgttgaatcttttctactcattcgtttttagttttcttgcgtgctttgatcttaagcttgtgtcttatcaatgatatatatggcctgtcctcactttgcatggtacggtgttaagggaaagtcatgcacgatagaactgtgccatcactctgcaccttagcatggttaaagctcctaaatacacaaccttcagttaacaaggtaatgtgcaaagcaagaacagcttgtattttgatttttctattttatcctacctgaaagtcatttatttatttttaatatacaagtgataatcgtacatacttatggggtacatagtgatgttttgatacaggtaatgtatagtgatcagatcaattagcatatccatcatctcaaacgtttatcatttctgcgcattaacaacattcagtatccttcaaagcaaatttttaatgatcataacttatcattttactgaaacattctatattttctgtttattacattttttcctgacttttttagaattttcattttcttggcttatcttttttgttcatcgcgttctaataatataattgttccacaatattaaaatgtaaagtataagaatacatttcttttgtcaggtaaatatagtctaactatagacttcagtttatatatatgagttccaattaatcatacttagacgttgaccacaatactactgtttttcaagtctgtgcaaatacagcaacagtttttaactagtaaatgctaaaatattacttggagttatacttcctgcattatttgcattagagcttgactaatctgtattagagggtgacttggagcacaagttctttgttatctttgcatagaatagggcgctgtgtggatggtacggcatttaagtcagaacaccttgagttacatttaacttcttcttactataagctttgcgactttgtgtattacttatcattctgaatagccattttgttatttgtgaaatgaaattaatatcactaatatcctaagttttttgagaacattaagacaatatatatgactgttcattgtccgacatatgttttaatagctactccttctgtgattgtgggtgctattggatcaagtcctaactgttttcattaggtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggtgagacagaaaatattttgggtttcctataaatgttacccggtcatatttcctttgatgttagaaaggagaaaagaaatgagaaaataaatgatgtaagtatgtcttatgtgtatttctaaattcccagtttctcttccatacattcctctctggtaaaactgacttttctaaaccattaaaacctgcctatagaaacaatctaaatgtacaataaagggtaatgattacataaagggtaatgattgcataaatcatactgtatacatacatattgggatagtatgaagctgtcaaaaatataaaacatgaaaatacctattatacgtcatcaaatgaaaggtgtttcatgtcgtttacagttcttaaaacacatccatccagctccttcctgttttcttaagcattgacagtatacagtgaccacagatattgggatgtttttgggttacagtgtgaggataaagcacactggaatctgtgtctcaaagatacatttatacatccattcttatatgcggaccttcatccttaaccctattgaatcatttttatgataattgctatattcgtccattttcacagtgctataaagaaatacctgagactgggtgatttataatgaaaaggagtttaattgacttatacttccgcatggctgggaaggcctcaggaaacttacaatcatgacagaaggggaagcaggcaggtcttacatggaggcaggtgagagagagagcaggagagtgagtgtgaaggagaaagcgtcaaacacttaaaaaaaccatcaggtctcacgagaactcactcactgtcaggggaacagcatgggggaaactcgccccatgatccagtcacgtctttccctcgagacgtggagattacaaattgagatgagatttgggtggggacacagagccaaaccatatcaattgcatatttctgttcataatttaatgaagattgtgaaacttgggaaagatgattggaacaatattaaactactaactagctttcatcttagaaaggcaaaactttgttcttttaaatagataaagatttgactttgtatttctgcaattactacatactcatctaggtataggcatcttcacagtgttattcagggctcattgaaaagaaaaaaacgtattactttgttttttcactgctaggaaattcttagtattcaatcgcctttcccatattttgtatgctggcccaattcaagttggatttttgataacaatgttattagatgaggaaaagatgttaagtaccatgtataatatattcaaaacaaggtcatgatttggcttagtagaactacaatacatgcactacaatgctttttcaatactggattaggtttaaatttttactttgcccctctctagagatctatatgttaggtaaaatcttctaaatattttacaagcattaacaaatgattatttcctatttaggtaaagcgtttaccctaaaagaccaattttctgtatgcttaataaattccattttattaatcttataatggtgtcctgtcacagcataggattggcagcataaacataaatatttattgaactttgaaggtgtcccacagaacttctatttgcagttgtcactggaggccactgaccactttatttctacagtaggtctatggcctggattgctccagtgagtgcaggaaatagagaacattaattttgctaattatgaaaataaactatttcactatactcttaataatgtatttcatataaataatgtctaacaagaaaacatattcattatttagagtgataattgtaacaaaattaaaagtagttatttacaactacttaaaagttttttagtgctttaatcatatttcatttcttctgattttgaaagcagtacatgttggtctttgaaagtttagaaaatacaaaaaaaagtaggagtaagaactacctaattatgcagaatatcaacgttttgatgaatttccttcctaatcatttttcttttgctgtgtaaacgcacacaaccttgcaacatggggatatagggatcaccaacacccctcccccatgcaattgaaatctacattttgactctccaaaaacttaactactataaagaaggctgggtgtggtggcttacacctgtaatcccagcactttgggaggccgaggcaggtgaatctgaccaacatggtgaaacctcgtctctactaaaaatacaaaaattagtcgggcgtggtgacatgtgcctgcagtcccagctactcgggaagctgaggcaggagaatcgcttgaactcgggaggcagaggatgcagttagctgagatcgtgccactgcagtccagcctgggcgatagagcaagactctgtctcaaaaaaaaaaagctataaggaagataaaatatattttctatgccttaggtggaagtggaccatcaacaaaattggtccttgttttcatgttgtgtaggctgaggaggaggaggaggaagaagaggggctggtcttgttgtcttaggggtggcagagatgaaggaaaatgcatgtataagtggacctgcacagtccaaatacatgtcgttcaagaatcaactgtacattacaaaatatgactatagtttggtgttctgctttcatttgaggatgtatagtaggtatttttatattttatatttttgacagattcatactatcccaatatgtatgtatacactctgatttatgcgatcattattctttatgtaatcattaccctttattgtacatttaggttgtttctatagttatatacatatattcatatatatatattattataaataaaactcaaaccaaaataaggtgtggggagaccagaagtaattctgaaaagacagtatcctgaatgaacattcccaatgcctttctctttcaactcctgttctgggttataccgaatggtagcagatgcctctgattctatgagttaactggagagctccaggaaagacagtcagggtaggtctttattctccattgtgaaaatagagaggcacagctggtaaaacctcattatccttgcaaagcatctgtatctatatatttgctctgtggactcttagagggcctctacagtgggccagaattgctccttgtctctgtaactggaaagcacaattaatcccattatggggacatgggcttctttcttaaatctagctagcagaggggtgggaatttgctagtttatctactgatagcacctccgtccagaaagaaaaaagttcaacccactaaagaagaaccaattatttgatggtagaaacccttttcaagtaaagaaggtggtacctattaaaatggcattcagcttattgacaataaattagaaaaactagaagaaattgatatccttccagcaaaatataacatacccaaataaaatctcgaagaagtagaaaaacatgaaccggtacatcacagtggaagacattggaatgatttgccaaatttgagtattttaaaaagctgggagtctgtggtgggaggatctcttgagctcaggaatttgtggctgcaatgagctatgatcatgcccactgcattccagcctgggcaacacagtgagaccaagactttatagaaaaactaaaaataaaaaaattaacaggcaaaatacatctaacgaaaattggaggaaaaagaggaagagtgaaaggtacggtaggtgctccagttgccttctatgaaacaaacatcaaagatcttcttaagattgaaaactcaagtaatggaagcataaatacttaacagccaaaaaggaaacactcaaatataataccatttactaaaacaagatgatggaagagagaaaagttggtgagagaaagaggaacacgctaccttcttcatcatgcgtaatccagcctaataaaaagaagtaaagtgttactaaagagtcagagacataaacacagatgcaggcatgcagacaatgaggaaaatgagaccacagagcgaatggctctaaaaaaaggtatgaaaacagaaaacctaaaatatgacacagtgaaaacctaaaatatggcccactctatttgcttatcaatatatataaatggactgtatcacaatttaaaattaaaataatttcatatttgggcatgcagcataaattatgctgacattaagaggcacatctaaaacaactttatttggaaagattggaaataaaaagatggctagtggaataccaagaaaatacaaacaggccaggtgcggtggctcactcccagcactttgggagaccaaggcaggtggatcacttgaggtcaagagttcgagaccaacctggccaacacagtgaaaccctgtctctactaaaaatacaaaaattagctaggcgtggtggcatgcacctgtaatcccagctgcttgggaggctgagggaggagaattgcctgaacctgggaggcagaggttgcagtgagcctaaattgtgccactgcactccagcctgggcaacagagcaagactctgcctcaaaaaaaaaaaaaaaaaaaaaaaaaaaaaagatatctgttcttaatatcagatgaggtggaattcaggcaaactaaagcattgcaggagacaaaaaaggatattgcatggtattgaagagtgcaagatagtattcgtaaaacaataaaaagtgggcaaggaatatgaacagacacttttcaaaagaagatatttatgtggccaagaaacatgaaaaaaagctcaacatcactgatcattagataaatgcaaatcaaaaccacaatgagataccaactcataccagtcaaaatggtgattattaaaaagtcaagaaacaacagatgctggtgaggctgtggagaaacaggaacgcttttacattgttgttgggaatataaattagctcaaccattgtggacgacagtgtggtgattcctcaaggatctagaaccagaaatacaatttgacccagcgatcccattactgggtatatacccaaaggaatataaatcagtctattataaagatatacatatacctgtttattgcagcactattcacaatagcaaagacatggaataaacccaaatgcccatcaatgatagaccagataaagaaaatgtggtacatacaccatggaacactatgcagccacaaaaaggaatgagataatgtcctttgaagtgacatggatgaagctggaaaccatcatcctcagcaaactaacacaggaacagaaaaccaagtgctacatgttctcactcataagtgggagttgaacagtgagaacacatggacacaggaaggggaacatcacacaccagggcctctcggtggggcgggggtgcaaggggagggagagcatcaggactaatagctaatgcatgtggggcgtaaaacctagatgatgggttgataggtgccgcaaaccaccatggcacacttatacctatgtaacaaacttgcacattctgcacatgtatcctggaacattaaaaaaaaaaaaatacaagtcactgaagttgtaagttgttaaatttacataacaaataaatatagggtagtactagtatttataaaacaaaatctccaggagctacgaggagaaacaaacagaaaatcttagtattaggagatatcaagtcaccttttctcagttcatgatacgcacacacaccacacacctcacaccactgagggctttatggtgtgtggagagctgccgcagaagccctacccttaattggacattcattttgttcactcaggaatattgcagggctgacttgagcgggactgggaactgggaacatgccaacagttagtgccctcagagcttgggagggtgttcaggaagcagggaccctgtcctcccacactccttggctttttaaataaaagaattgctgccattctgtgattccttgtaagtcagccaacagagctgagcattctctctagttgatctcactgagtatcaggacccccattttacagatggggaaaaccaacgcagggaggatgagtcacttgaccaagtggccgggctaggaacacagaagaatcggtggacacagggttatctctgcaccaaaacaactggccagggtggggtggttacatataactgggctgtagctttccaggctggctggttcactcattcagttcaccccaggctgtaaggactgccatgggagcctgaggcagatgcttgtcctgtcagggcctcacccagctaaagtgtcaccccacccctccacagactgctgcctgaccctgtgtctaactgtgatctctcaaaatcctccctttcctgcagaaagctgaatagagtccatctttctcatttgattctttctctagtaatcctaatcctcctggaggttgatgaatgcctgtgacaaagcaggtgattcacatggaaatggaaatgcaaaaagggaaaagtatattaacatacttcaaaaatattcttacttatatagcctttcatctgttgatctatgtatttttaagttgtggttgggggtgggagggtactgtcttagaaaaataaagtgaaaacttgtaggtaaaaatatacgtgcaagttaatttcatctttctttgtcatgccaaaaaaatggaaaagtcacacatttgcaataaagattattctatatctataatattaaatggtattagctgtcaaaatatattaatctggaaagatattcttgtaaatattgttgaataaaacaacattttattggaagtatttttcatggctatctttccagatcaatatatatcaatatattgttatatatatttccagatcaatatatattgttaggtatataacatatataacattcatatatataacatatatgacatctatataacatataacatatatagtcatatgttttatatgttatatccataacatatgttatatgcataacaatatatgttgaatatgttatatacataatatatattgatctggagatatgtataacaatatattgatctggaaaaatatccatgaaaatattgttcagtaaaatattgttttactcaacattttgagttgtaaattgtaatataggtattgcaaatcttatgatagattttaatgtaatctattgttgtaatattaaaggtattacaaatatttttgtaattaaaaagaaatcttcatacttgtgtttgtatatgattttatggtagttgtggaaggatatacactaatcatttaactcacagtattttagaaagatcaaaatggaagctgtatgagaatatgaagacagagagaaattttttctttaacttaaaaaatgtatctctggattattttggctattacaatagtcatatttattttacaatgaaatcagttaaagataaaaaccattgcactgacattctgggacataagttctgtgcacatttttgatttgtttatttaggatggattcctacaaatggaaatagtgacttaaaagctgtgaatatttttgaatgttcttgatagagattgcccaaagcaatagcttttgaaacctttttctctgaatatccctcctaatattctctccatgttagaatagggctcatatttgaggacttttgactctccagatccttctgtgatttctgctcagggattctgtttctggaatttggcaattgtgtaatgtcacaggttgcatggaggtagagaggccgaagagcccaactcaactcttctttaactgagcaatttagtttctctgaagctactttcctgcctggtgttcatggaaccactcgagtgtacaggttaataacgcttccatgcttccagccacttcattcatacaggtaatttcatatgatgaagtggttgaaggcagtgaaagtgaaggtgagatttcaagagaaatattttttaatcacagtatatttttaattttagtatcactggaagattagataataaattttttcccatgaactagagacactaactcttccaattatttcttttaaaatgacttcttctattatatatttaatgcatagtcattacagaaaaatgtaaaggtagtacaaagatggagaaaggagaaaagtaaatccatcactcagaaacaacctcttgtgtgtatttgagttgtaagcaaatattacatattttgatgatgaacagtgttaattatatatgattttgggcctaatttttatttaataacatatactactatattctttaatagaatttggcaataattcaacatcttattacatagatttatcataattcatgcagctactttattatatttgaatatttagcttattttcaatttttcacttttaagctgaatatttttatctctgaatatttctatatattgctgactacttcttttttggaagttgtactatttggtctaaaaatgtgaagatttcaagtgtttggtactggaggctctcagagggcagaacagtatctgttttgttcaccatggatagtgcagtgcctgacacttagtggggattgctaaatgtccctagtgagtgaatgcacctggccaaagtactcttcagaactttgcaccagtatttattctaagcagcagggtatgaaactttacatttctgtgcgactcatcaacagatgattttaaaatctgataattttgatagatgaaaaatcagttatatcttattttatattctgtgagtaagttaacctctttaactgtaaagctcctatcattttagaagcaaattataatgatttagtattcccatgaatgaaacaaatgccacagtaagcaatttttagcaaatggtcttttttttttattcatttcttggaacgcatgtggcttttacaagcagatgaatttgaattttccttcccttcattccatgtatcccagagcaatgactttaggctttttttaaaaaaaaatgccttttacagtttaatctcgagtgtacttcagattattcaaggcatttaatatatcttaaatatatatgcatctcctaatatttcaaatgagctccgaatcataacttgtagggacagaaacagaatcaataacaacaatatgttttcaattgggaacttctgaatgtactagcaaagctactctaagactgggcataaatatattcagttgggaatggaaagaaaattcttattatctggtgagtcgaagtggtatagggggatttgattctcctgactcagtcttctctgggaagggaagggatggacattttttatgcccacttccaaattcttcgaaattctgctcatgtcctaacttgagctttctgtaatcatggttagtgtctttccaattagggctgtctctggatattacaaatttggaatttaaaaaatgacttttgtttacaacaatgcctgacatccaagactatagtctggagctggtgattcaaattcctatttcgttggttaaaagtagagcagtggtgtctttttcttacatctgtttttctgtcatcactatcattatcatcagcatcattttcttaaagcaaattaatgcttctggataacttacttcctttagaatgcacaatactctttttgttgtttttttttttttaccactgtattttaaattttctaattcttagatccctgattttcagaagtttgtagataccaataactttataagaggagagctataatttaaataaatttaattaaaactatctgctaattaaaatgtttaggtgactgtgtgtgggggggggtatcttaaagaaaagaacaaattagtgtgtgattcttgtgtaatattttacccaattttgattggtagaaaattggttttaaaatagaaggcatttctgatactagaaaagtagttaaaatccagctacaaggtacagaaaaaagggctgtggaactaacataatttgatagtttagtttcatttaaaataagttacaaagcacaaataggtatctcaggaaaaaataaatggcacagaaacacatatctaaaactacactcacatatacagacgtgaaaaattagagtaattgatagtgctgattatatttataatagaatcttgttttgattggaagcccaatgacataaaaatccattcatgctgaaaagtattttctgcaattatataataaagcagcattgaacttataattattgaaacacaataaaaagagaccttgattaaagatgaaaatatatatatttttaagatattgtttcacattgtcaacatttcagagaaaatagaatagctcaacagattcacttaatccctttgttagtcatcacatttgatcatggtctctgttctttaaaatacatattggattcacttaaaggtatatttgatactttttccccacctcagtgttactggtaggttgaaaattcttgccctctctttacatacttctgccacatttcccatgaagaagagttatactgtggaaggcaaacactttttaaaaaatgacgtaacatatatcttagaccttagatcttagacatgtatcttctaccatatttcccatgaagagtacttacattatgaaaggcaaacacttaaaaaaaatgatgtaacatatatcttagacctgaggtatactttgagtatgcaatagtgaactgactgctggttgacataattactgtgttgcaaatcaagatttattactgatggaaaatcaaacttttctaggtcagttgcaaatctcagctttcatctgggtttaggagttttggttttgaaattctgaaaagaaaatcaattcttgtgaacccttgcatttacctgagcagtcccttacccctaactgtgtgagacggtattgaaagtataagtacatttggaagattttataaatcattaagatcattttaactttagattttaaaggtgagactggctttaaaattccatgttgctagttgacataaggagcatttcctcaattgtcattggggtgtctttgacagtaatgtgaacattcaccagccagtctcaaatacaggatttgagggaagaatcaacaattgctggcaaccctatatattcagaaaaaaactgaataaaataggaaatcatttataatgtaacctactttggttttcttttaaggaaaatatcttacataacgaagaatgctatttgataaatgtagattttcttagaaatattcttcactttctctattcctagaagttgtaaccattgttttcaagtgtgttgaaatgtttgttttaatcataaggcaggtcttgccaatcatatgtgtatccaatccccaaccctccagataaaattttttagcttaaaatgccactgaaacatttctctgtaggcgatttcctctggtttttcctccctgtgtacaatgaatagaagtcttttgctatggaaatgatggaataacagtttcaaataagactgtcaatgagattacaagaattgtggaacaaatgtaaaatataaaactttttttttgagacagagtctctcgctctgtcactcagactggagtgcagtggcaagatcttggctcactgcaacctccacctcccaggttcaagcaattctcccacctcagcctcccaagtagctgggactataggcatgcaccatcacacccagcaaatttttgtagttttagtagagacggggtttcgccatgttgcccaggctggtcttgaactcctgagctcaagtgatctgcctgcctcggcctcccaaaatgctggggttacccaggcatgtgctacgatgccagactaaaacattttaaagacatttttactatattatttttatctggattttttatttttcattcagaatatgtttcagatgttttaaaatgtacactttcacacagtgaaaataaaggtagaggtgaataacttactatgtgtcaaacaatgtgctgagcacctttcatgcattatcttatttaatcctaacacaactgtatggagttaagatgctgtttttttatctttattatgcagttgaggaaactgaggcttagacaagttatgtggcagaaccaaacttaactacatagtaagactaaaaccctctttagtaagaaaactaaagattttataaagaacttgtaattttttttcttatcaaaacagttatacaaagttacccatggagatgaattttgcatttacttgggattaaattcaaaagaaatttttgcagtagtcttttctcaaggggcattgatacactgataaaatagtgccaattatggttttacagaagatagagaaattcagttatagttgtatgctggtcttttttaacgactgtaagaacgagaatgaacccattgaagccttctgtgattaacatatcataatttgatagtttagttttatttaaactaagttacaaaacacaagtggttgtctcaggaaaaaatagatgacacagaaatacatatctaaagctacattctcatatatggaaacattgtgacgaattagagtaatcaatcagggttcagccagagatgcagaaccagtggagatatgtatatattaaggcatttattatataggtttgcttaatgagattgtgagggctgggtaagtaagcctgacacctgccgtgcaagtggtctggccaggatgattatgatcaggctggaatccttaggcatgggctgatgctgttggccacaggtggtaaggaagagagaaccaagagcagggtagagtcccatggaaactagctgtagtttatgtgctcagggaaagcctgaaccctttgaaagagctcacctggttaagtatcatccaccttggataatctctcgtttgatttactcatagtcaattgataaggaaccttaattacctctacaagatcccttgacctttgccatctaaggtaacctcattgcaggagtgatatcctgttctattcattggtcccacgcacactctaggggagggtattgtacggggtgttagagggctgttatttaggcactgtgaccttaagctttgtggctacggctgtggaagcccctcatagaccccttcagcatgagaaactttaaaaatcctttctttccacaaactcacttaccagagtaacttctcctgagaagccgagggataatgtgtgattttccttttttttttttttttttttttttgcatttctgtcctggaagggctaactaagcctggcctggcctgtcagtaccagtcgtttctcttaccacgtaacatttttagactttcttttcacagtgaccaactattctgggctgcagtgcggcaccataaaggagcaaataaaaaaattcttttgactttttaatttttttctaactttaatcattatttgtcttaaagagacctggctattaagaaatcaataaaaactccatcatctgaggatctattagttacctgatagagtaatttggatagacatacggatgattttaactatgctagaagaattcctctgaaccgcatgctctgtattataagaaataattctataggactagttttagtcttttactgagtctagttttatatatctagtatgtatatatcacttagtatatctatgtgtataaggccacagttcttcagaaataggtatggcttcattatgagtcaggttggtatacccaatgccaaatattacttaatacttttcagaccaatcgtttttacatctgggtctattttatttatttattttttatttttattttatttttttgagatggactctggctctgttgcccaggctggagtgcactggcgcaatctcggctcactgcaagctctgcctcctgggttcacgccattctcctgcctcagcctcccaagtagctgggactacaggcacccgccaccacgctcagctaattttttattttattttatttttagtagagatggggtttcaccgtgttagccaggatggtcttgatctcctgacctcatgatccgcccacctcggcctcctaaagtgctgggattacaggcgtgagccaccgcgcccagccacatctgggtctattttaatattcatttgaaaattagatgttccaagcacttacgaatgggattatttgaatgctcataatgggagtagtttgtcagcacagtttttatgggaaatctgaagggatttccagaaattcatcaaggatctgacatttgcaggctgttctggtcctgaggttatgtggggtcaggctggaggaatcagacatatgattcctgctgtcaaaaaggtgaatgatagtcaagtggaaagaagacaattgaggaacagttttaacaaagtgccaacatttccctgatagtgaaagtacaacatgctatgagagtacatgaatgaaaagagaaaatatccatacgcacctcttagactgaaaaagcagtgcttgcaataattctagactgtgctgaaaagagtcattttatctttgagtatttttatagctcttaaggtctcaagattattcttgcaggatagaagactataaaagttaaaaatttacaggttttaatgaataagataatgcttataagataatgctaagattaggaggatcttgacattttcttgattaaatgtaggaggcataggaattaaattttatatagtcttttgaaggaggtttccatttaatagcaaaatacttaagctagagtgttttaatggcaatctgatctacagattgaaaaatttctactgattaacttttaatttcattaactcttttttatacaattccaatctgatgctaagctgacccagttaattttgtatttaaattattttcatttttctatttcatttatttttgtgatgtataatttagctctattcattatgtatgtgttttcctttatatttttgaacatattttatatttataatagttgctgtaaagtcctcgtctgctagttgtaggatctgggccatctttgcattgatttgtattgcctatactcttgttgtttttgtttttccaaaaaatatagctcacatttctagtttctttgtatctgcttatttttgacagtatattggatattgggaatgatatgtagtagaggctctgaatttcaagtttttttctgaagagtgattttggttttgcaggcagttaaccttgttgggttgaaacttcagttttctctcttttacatgaggagttgcttatatttttactcaaatctttcagcttccatctgttgccattatactggactttcctccagcatacatagtcagcagaatttggataatttttttacaaagattttgtagataactttgtgtccaggatttagcccatctaattattttgttgcttgtggtccctgaagcatatcctctgatacctcaagcccataaagcagcagattgctgctgccagagtagcagacagattgggcactgcatgccccaaggcaaaaggcagccacctaccaatcacgcaaggtgctatttgtcttttgagagatctacttttcaatttcttcctgcttttggtccaagtgcctttaagtcaattcttaaaaggattttttccaaattttataatagtttctataggagaattcactccagtgaattacttcatcattttccaaagtagaacaactcaaaagaaaaataaaatttaaaagctgatgccaaaattaaggccattaatatagatatggtacagctaatacagagttttagtaagattattacttgcctaatctgagcactttatttccagtaatacaggctactattctgttggatgcttttactagatgtcacatttgttgttcatgctgtacttcagcttacggtcattcaaaggatctagattattttcatctgaatttctcctaagcctgagctacagaaaatgacaggagataaagaaggaaagaacatggatggcctttggtctttcattcagcaagtgttctcacttattttttctaatgtaacttcagcattttttacctcactcaagggtcatagtaattattaaaacagtcatcggccgggagcggtggctcacacctgtaatccctgccctttgggaggccgaggtgggtggatcacctgagttcaggcgtttaagactagcctcaccaacatggtgcaatctgtctctactaaaaatacaaaaattagcagggtgtggtggtgggcgcctgtcgtcccagctactcgggaggctgagacagcagaattgcttggaaccaggaggctgaggttacagtgagctgagactgtgccactgcattccagcctgggtgacagagaaagactccatctcaaaaaaaaaaaaatcatcatcacgatatttcacaattaaatcttctaatccagagacggatgtgaaatacatcaataaaatacaaagaaagcataatttcacaattaatgtttacgtgacttcttaatatataatccatgcacccataaatagtctagacacaaaccaatttgcttgaagaaaagaccaaaaaaaaaaaatgttagaggctcactgttctattctgaagagataattacagtgttctatttttatcacagaatttaatttttctattgacagggttggtaaaagtagattagtagtttatctaggttgatagaatgaaattggaatggttttattgtctgttttattacagatacttagaatagtgtttcaggttatttgcataatgattgaatcaacttaattgataattatatattttcttagttgaccttgacattttgtgttaaaaatttcaactcattttaattttaattttcaattgtttatggagtgttcataatcattttcaggtcattaattattaatacattatgcaaatgacatgaaaaatctgttaaaccttggggttattttaaaattgttcgtttttgtttagcagacatacattttactctgactgaatcttcaaaacattcgtttaactataattctaaataaaagtcataagaccaaagacatagaagacacgtaaagtaaattaacaaggaaggttagaccaaggaagaaaaaagaataagagactaaagaaaggaggtacctttggctttttcattgctgctttagggactgtacaggactttaagacatagtgagttcctgaagatcacagctatgcatgggaggaaaaatggaaagagtatgttggaggaggaagtgctgacataaacagagatttgaaaaaaacatttggctggtgtcagaggatggattgctacttcctaggagaggaagcttggcatagtagtcctttaagagtgaatacctctgtagtctgagttggaaattgcagtagtagaaactgaattttagctttgattagttcaaaataaataatcattttaataggttcattaacaatcgttgtcaccgttattattgtcaaagttgtcaaaaaattttgaagtgtttatcccggggacactattctgaaatctacatgcattatcttaatttttttttgatcctatggagaggtaccttattagctttatttatggatgagaaaactgaggcttaaaaggtttaattaacttgctaacatcttagaggtaatgagtggcagaggctggactcaaaattaaatctctctgtcccccaaatctatgctcttaatcactaataatgaaaaaaaaaaatccacaaaaacccaggaagtatgtttagcttaactactgattttaagatctctggtttggagttggccattatgcaacataaaatttaaaaattttacattatggcaaaaatagtgttttaccaatgtgaataattcaagcataagttagaggtcgaactgttagagtaaaatatttggccattatttcaggggacttcagagggctgaatttttcaaggaacatatttgcaataaggcaaaattctattgccatacactagtatttttgaaatgtttactgacctttttttcctcctctccccttaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggtaaggtgatagaaaaaaacataatttatagaagtaattttttatgaatacacaagcacaagtcaaaaataattggctgatctttttagtcacctgcaaaagttcataattttgcaagtgaaagggcagattccactgtaatagactctttagctttgtaaagtgaacagagttggatgttacatcactcatatataggattatgggatgcgtgcatttaaatatgaagtgaagaaatatacagtgccgtcttctggattctagtttagtaccgttcactttgtcctccatgctgtgacaaagtccgttactgacatccccttgcttacaggaagaggcccactttttgaggtccccagaagccaacaagccagaaattaaactaaacacaatctaaggagggggcggggtcagaaaggaaaggaagagttaaaggtgtgtaattgtgacttattctgtcttcattactagactctgagattggaaccaagtctttgatttatgtatattcagcatctagcagagtgctgaaaccatagtaggtgctcaataaatgtttcttgaatgaaaacatgtattttcaaggatgtggagttataattgagttggtgagattgcccatgcacctgctaacttggtcttcaactgcattagctttgcagaattatgagccagggtgagctgggttagcattctcaaggtgaacacctaatgttgtcgaaattgtggcagaagaggttgatttggctttaaagcaaatttttcttttgataatgacgtttggtcatggttcttctactagatttagcagatgttatctttttctttttttcttaatattttacttataaaaatttcaactataaaaaagttaaaagactaaaccaataaccatccacatacccttgaattagagtcaacaattattatagttagccagatttgctttcctttcctcctgtctttcttttctctgtgtgtgtgtatgcagtcagacatccacagtacagttacatagcattaaggtaattctattacatcattgactatcctgtttgtattcatatttattctgttatctcaataatatcttttctagttgattaaaatcaggatgcaatcaaaattcatgcacttatttatttttatgcctttcagtctcttttaatgtagaacaaattctcagcttatttttttcctgtagcatcgagtttttaaaaaatccatgccagttatagaatgcctcatgttctggatgtgtctgactttttttccccattgcctatgctcttggtaattcccatgaacttgcagctaggtataaggctgtgctgtccaaatcagtaactgctagacacatgtggcaatttggtatttgtatataactcgaactagatgaacacaatttttagttttgtttaactttaattaaattttaaaaacgcacacttaaattgttggaaaacttttatgtatgtttggaacaagttgggtatgtgaatctacttttccaaccatgtctttggttcctgttttcgtgccattttagtctgctggtttctttctcaggaacatggctgtctttcctcacagtgttctccctgaccttttctctacacttcgcttctcaagtgtgtcttccaaagtactcatttttttctttggtgctgttctgttcgtaagccctttctgtacctttaaaattttagttttcatgctttttttttcttgtctttatctcacccagctcacctttttatctcagcttgctgttctttcatctggtctgctggtttattatctcagcatattttcccattgtgaatttccactcctattttatcgaagtcgtaacttgcatcctgaggacagttgaaattgtttttatgtttaagtagcctcctgctatttcaattttacttagctttttaaaaatagcaatgattactgaattttattaataaagaagataaaaatcatgtgttgtgtcttttaacttgttgataaaataactaagttaccagacctccaattattaaagagttcttaaattcacagagtaaaccctacttgaccatagtgtatgattcttttgaaattctactagatttaattaattaatatgttattcagaattattacatgtatatttacgggggaagttaatttctctttatggacattgaattttgaatttcatacaatctttgtgtttattaatttttatgtgtcacaaaacaccattctactctggtctttttttcaaccatttaaaaatgtaaacaccattcttagctcatgggctatacggaaacaggtgatgtgctgtagtttgccaatccttggtctagactagtctgccatgaaaggtagctgttctttgaaactttatcacagctcacctgtgaaaccagctggtcctaggtcttttaaatattgtatattaaattatcttttcaatccttttctaaagaaactggtcaaatagagttggattccttttgattagtcttatttggctaaaaatctattctattcccctggaatacccagttttgtttggttggttgatttttggttttgccatggagttgcacacagtattgtattattgtaatttcccattctttgtgtttttactttctgttttatctttagcctggtttgtgagagctttgttttatttatcatcacaaggaatcaaattttgagtttataaatcttttctagtactttatttgacttctagtttagtaatttcacttaatcttcattagttccacttttcaactctctttgctgttctatttttaggacatgaaaaccgcaagttctttcattttagtcattcttttctttattaatcagggcacttaaggctataatattttgcctttgaatatagatatatctgtgtctcactcattttttatataaggagtttcctctttacattgctttctagataatttatagttccagttcctagatttagttcagtacacctgggtaggtgtattaaattatcttgctataaatgttgaatgaagataagcacagatgggaacaaacggttctacttatatatagtacacaactgatctgtgctgtcaaaagtctgcaaggtggtgaaccttgtgaaggatagggataggaagagagcactaaggaggattttgagataccgtaatgttttctttcttgagctgggtgttggtcatgcaggaatgttcacttgtgaaaatcatggaactgttttcttaagatttttgcatttctctttcctaacattatagtttcatagaaagttcaaaaacaaaaaactatcaaaagaaaagaaatatatgtatacatttttatcatttagatgatttataagcattgttcagtgcttattattgaccagtctatgttcagaactactgtatgactggtgtgccagtgcaacgttagctttgctgctttgtaccaagtttgcttaggctgaggatcagtcgttcaatgtagatatgtgaaaaggctctgctgtttgttttactcgactcattgcattttttgagtagttctttaaaatgataactgagatgggcaaggtgatgggggcttgtaattctagctattcaggaggcagagggagaaggatcactgaagcccaggagttcaagaccagcctgggcaacatagcaagaccccatctcaaaaaaatgaagtaataactaaatgaataaatggaatggctaatttgtatagggagctgtgcatatgattttatctgaacgtaacagcttcacagtcccctgtacctgccttttgattctatctgttgttatggctcagctgtttgagtacacatctccctaactctagtttggaaaagagacgttgggagtaatggccttatttttgctttcttacaggctattatgcatcatgaaggccacatggatgatggcataagtttgtcgagatcccagcatgaagaatcacgcacagcccgagttatccggagcacagtcttccttttcaatagatttataaggtactttttcttttgtaggcgtagttgtttgatacttcattttcatttctttattggatatgcaaatagacaatttaaaagtatgctatgatggtaataaatctcatactgtttggtaagtcagcagaaacgttaggaagtgttaatgagatgatttaatgtctttcttttaaataaacttttaaaaagaatatggttttggaaattggatgtgtaatttgtaattgataggtatagattaggatgatttaatgactacttttccttgtactgaacctatttagttcctttttcttttccttttttctttttgagacagagtctcacactgtcatccaggctggagtgcagtggtgcagtctcggctcactgcatcctctgcctcctgggttcaagcgattctcctccctcagcctcccgagtagctaggattacaggtgctcaccaccatgcctagctaatttttgtatttttagtagagatagggtttcaccatcttggccaggatgaactcgatctcttgacctcatgatccgctctccttggcctcccaaagtgctgggattacaggtgtgagccaccgtgcccagcctagttcctttttcaatgagggcagtgaagcctatatagctgcggagttttgatatgtatttttttaaagtaattctcataagaactgttcttccacctaataattgcatatctatagactaaattaaacttgtgaccaacatgttttctggtaacattataccaacatatgctctgacttgcgagagattgcatttgtctctttaaactttgctaatttgatgggggaaactttttgttgaccatctttcttcatttattttttcttttgtgtttaatcctattatttgttaatatttctgttaagttgttctgagcttttgttatgtttagagatattcatttcctgtcatcataagttgcaaacctttttaccagtttattggtttgggaaagaatttgaaaggatttttgtagtagttgaattggtaaattttttttttggctttacagcataaaacaaatctcccctactcaagattatattattttctacttcttttataaaccatctcttttataaaccatacacactgtgtgtatatgtgtgtgtgcctgtatgtaaccaaaaaatgtgcacagcatttggccacacatcctaagtgtttagtccatttttctgcctcgtctcaactccaagcctcatcagatgcagtaaagcttaaatcgaatggggtatgcaccacatttttgtattttttattacttgtattacttttcagtattatttgtattcttgtagtttaatatagtatttatttcttacagtaaaaatttattacattttaatgcattataaaactagtcaagaagttctacttggaaattataacttattttggaaacaaacttagccttttcatatcttgttcttcccactagtttttctttactagagctgatcaatcctatgatagggattgagcaaattaatcataaatctttgaaattgtcgattttatatttagtcaacactgacttcttcaaatatgagggactttttaaaattcaatttgactgctgtagagtattcagtggcactgcagagataccatttggtaggttaatttaatactagaccaaaaactggttatttgttttgaaaactattttgtgggaaagctactatctcagtgttatagacataatgtagtgctagtataccataagtgacatttttttatgctggctgaaataccaaaattcatcttgaatgtgatttactttagcacatctgctctttggaagaataattttaaaatttaactattacttttctgattagatagagtaccaagtatgagaaatttggattctgtgataaaaaatgttgaattatacactttctgctttattaaatcttgaaaattattttttgtctgggctatttgagtgaaattcatttgttatacctgtcatgataaaataggatggttacattaacccctattaactatgaaaagattttctgattcccagtctcattttttctattttctttcttcttgccttgctctcttttttctaactttataagatgaatgctgatattattgagacctttgttgacataaacatttagtgttatacatttctgtttttagtggtacctcacaccttttgattttcctttcttctttctttcttttctttccgtctgtctctctctcctccctcctttccttccctccttccttccttccatcctttcctccctccctccctctttcccctccctccctccctcttttcttttttctttccttttcttttctttctttctgtcttttcttctttcccctcccctttcctccctcccctctccccattctgctcttcactctcattctgtcgcccagactagagtgcaatggccctatctctgctcactgcaacctgcctcccaggtttaagcaatttctactgtgtcagcttcccaagtggctaggattacaggtgtgcatcaccactcctggctaatttttttatttttagtagagacgtggtttcaccatgttgcccaggctggtctcgaacacctgatctcaagtgatccacccacctcggcctcacagagtgctgggattacaggcgtgaggcaccacacccggcattgatatgttttctttcagtttcccctttgatgacttctttgaccaatagattttttcagtttccaaatattcggggatttcctgagtatttttctgttactaatttctaatttaatgccattatggtcagagaatatactttgtgagactgatcgctttgaaatttattaagacttgttttatggcttagaataaactttattttggtaaatgtttcatgtgaatttgaaaagaatgtgcattctcctcttgttgggtcgtgttcaaaagtgtcaatttagtattatttagatctttaatttccttacgtttttcagtctctttgttctactaattactgagagaaaggtactgaaaagtgtctgactgtaattgtggatatctctgtttctccttgctgcttgtcaccttttcttggtgcattttgaagctccgttattaagtgcatacctgtttaggattttgttcttttgatgaactgacccctttatcattatgaaattaccttccttaactctggtaatattcttttctatgacatgtactttgtataatatgaacatagcccctctagtttccccccaccccacctttggtattagcatcctatgacctttaacctctttgtatctttacatttaaagtgcatttcttttaagcaataagtagttgggtcttgcatttttgtcccatttgataatccctgttttaaattgtattgtttaatccatttacattaatatgattattgatatagtaggcttaagtctgtcttcttcctatttgttttatattcgtcccacctagtaataggataaagaggagatacacacacacacgccaccaccatcaccacccttacacgggagcgtgagagcatatgggttacaaaaaataaaccacctaagaacactttgtcattgtcccatttcctcctttttcttccttcttttggattagctgagtattttctattatttcatcttacctcctttttattggtttattagctgtaatattttgtttgtattttagtggttacttacggattaaagctgtaatactttatttgtattttagtggttacttacggtttatagcatgtatctttaatttgccacagtctacctttaattgatattttgtcactctatgaatagtataagaacattataatagtatacttccctcccagttttcgcactttgtcattcattttacatttatagatgttattaattccacactatatttttatttaaaatcaattagtttttaaagagatttaaataacaaaaacatctatatttgcacatgtagttatcatttctagtgctctttttgtgtgtgtgtgtggatctgtattttcttcaggtattgttttcttctgcatgaaggactttctttaacatttcttatcatgcaagtctgctggagatagactcttttggcttttgtacaactgaaaatgtgttttttgccttcattttaagtgatatttttgctgtgtacagcattctagattgacaagttttttttttctttgggttgactaattttactccctattgatgattgtattttatagttctttatatgcctggttatttttgtttagttaccagacattgtgaatttgttaggtgctggctatttttatattcctgtaaatattcttgagctttttcctgggatgctgttaagttacctaggaagagtttgatttgtttggatcttgcctttagaattttctgggtgggaagagcagtgtttactctggggcaagtgattccccactattgagacaagaccctctgaatactctatccagtgtcccatgaattgtagagttttccagtctggctgctggggacaggcgctgttttaggttctgtgtgagggccagttgctgttccctctaatcctttcaggtgattctgttccctgccttgagtagttttctcatgacattctcatcagtgttctgctgaatatttgagggggaccttctgtaggtctccagggttccctcttgtgagccctctcctctctgtgtcctgtgaattctagcaaccttggtctcctggatgctcagcaatatctcttcaactcatggagactgtcaggccacacctgggttcccttcctgctccatggcctggaaattctcctaggcagtaaactgaggcagctgtaggactcacctgatttgtttccattcctcaggaattcctgtcctttattcattgctctccagtgtcttgaaagttttcgtgtttgtttggtccctgccccgccactccccattatactttgtttttttgggttgtttcagagggaagggaaatcctgccctgtcactttgtcttggccaaatgtaactcacatctagttgacatgtgcaatgcttatttccagatgagattccttgttccccttgggaaatgtagcctagaacgtctttgctaattctgcattgatatttttagctatcctcctcattacaaacccatcacaaatttgccatatttttctgagttatctaacatctgcttttaacaatgtctctcccttgtgatcacctgagaagtgccatggataaacacaattaacctttctttctcttgtgcttaactgaccttaatcatgtattagctttttcaaaaactaaattttaattaagctttcgtttattctccttgtttcttttctatatttatcctttagttgtattatttaactccagtaatcatgtttatattgcatatatatttatattgcatatatatatatccagtaatcatgtttctattgcatatatatataaacttgcaagtttcacttaaatgcacaggagtattacctattataagtcccaaatttaggctgggcacggtagtgactcgcacctataatcccagcactttgggaggccaaggtgggtggatcacttgaggccaggagtttatcaacagagagtaaactatattgtattctacgttctatacaacagaatgctacgcaaccagtaaaataataagacttacaaagtagcaaattgggctgagtgtggtggctcacacctgtaatcgtagcacttttgggaggctgaagccggcacatcacttgaggtcaggaatttgaaagcagcctggccaacagggatgaaaccccatccctactaaaaatataaaaattagctggatgtggtgggcatgagcctgtaatctcagctgttctggaggctaaggctcgagaatcacttaaaccctgaactcaggaggcagaggttgcagtgagccaagatcataccactgcactccagcctgggtgacagagtgaaactctgtctcaaaaaaaaaaaaaaaaaattgaagtcctgaatttatataattttttaatatatttagaagctttgaaaagttttacatgattactgagcattttaaagagcatatgcttttcagtaaaatattttattcattttatcacattcatgaaagcaccgtctttaaaatctcagtatttttacaatattttcacccatgtatttttcagttatttttttactattaattttattaatgccaatttacttattacatattaagagactaatttaaaaatttttaccttttggaaagaaagtcaagatagttaatcatttgtgtttttcttatgtggtttatgttctgtgatccttctgttctctctctcccaggtcacggtggttgtggtagtactgtgtgtgtatgtgtgtttgtgtgtgtgtttgtgtgtgtgtttgtgttgtcttcagggaagggagctctattcttttggcctggggtggggaatatatataaaattttgtgtgtgtgtgtgtgtgtgtgtgtgtgtatgtgtgtgtatacttctaatagtaatactcatgagcatttaagtaatatataatgtgtgtgtatacgtggaagtgtttaaacatacatattatatataattatatgttataatggatatattatgtagtatattataatgtatagtatagtatatgttatatatactatacaatagcatatataattaatggcatatattagtatatgtattatatgctatactacataatagtataattaacaattgtatatattacattatatatgtaaagtatatattatacattatataatatagtataaactatatactatagagtatattatacattaataatatactatatcagcatatactattagtatatactaatatatactatatataatgtataacaaatatataatatataataaatatatataatatataacaacatatatcatatattttatatacactatatatgttttcatttttcttctggatatattaataaatatattcttgaagtagatgagagaggggaggaacctgtatttgttaggtaataatatagtttaatctttaaattacaaaatgtagccacaaggttaatagctttcatttttactctagcatagtgtgattctactatctttggatttctggatgattttttttctccttgattcttgattatattttttgttcttcataaattaagatgatatacatctttgtattagaggaaagccctgaaacataacataattaataattttagaagtttggacaacatttcttctgacaagagacttctcttacaaagtaattgaatagttacattcctcatggtagatatgtttatttcaatgtaataacctaaaaactgacatttactgttgttttcacttatatttgaaaatgtggatactgaatcgtttttgaattttattcacttattaacagttgagtttgaatttgttatacatttatttatgtttaattggagttaatggggtaaaatgtttagaaaaatacttcactgcatgtgaattaaatgggaaaaataattttctactgaaaagtcactcttgcattttgggcacagaaaaacttatagaggcgataaaacttgggggtaggtaggtgaattctgttcatatataattggtatagaatttcaggcaaaaactttaaaatagttgtacagttttactgtttctactgtttgataaagctgaaatcaaatattccaaaatcattagcaatctttgtggaagtgatgacatattttaaataattttttaaaactataaagttcaaagctaattctcattaatgagtattttattgttttgtaatgtaagttccagcatagtcagaaaattagtcagaaacatttgcttgaaataaaatgttaccatacagttttgctaatacagagagcaggaatggaagtgtaatatttctatgcattaacaacttgtcatggctatagaatattacaatatcaactacagtagagatgttgtcccattcttttattgtatgcattgttttaaaaaatatttttattttgaaatacttttgatctgtagacatgttataaagttcttttcagatacattcaaagctatgagtttaaaaactgagaatctcagtaagctcaacaaatgaacacatttacatgccagtaatatatctttcttccaaggctagaaaatacttcatgatatttttgttagtataacttttaaatgcatttctttcagataatagaaaagcattttaatatatatttaccgtttcataagcagattttctaaattaacatcattagaatatatttttgaactcacaggaattaaacagaatggcaagctagggtccatgaaaacttaggaattcctttttgaagacaaaccacaaggaaatgtcagaattatgaatctgggaagatgaagcctgaagccttaaagtgtgtagtgctttccaatgaaaatcaactggtttctgaacattcctactattggttttgtagacactgttcctgtagcctatgaggttattctctgggtgagtggccgtggatactgctttttataacataacattgcacagtttctgacttgaatcagaatccatgatcactgcttttggagcaggaggacctttctgacatgtcccttttacagtgatgtagggagagagattaatgcctgaaatcatctataaatggaaaaatgataaaattgtgaatcactgacaatagagaaatgtttatggtttattttaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagaggtccgtttctatcaacactcatttctcttctgttattctcttgtaaaaacagcttcttggttgggaaaattttccatctattttgaccatctttgcgttttgcaatatagaggagaaagtatactactgaacaggagaaacaggccttagagaaatctcgacatgatttttatttatttatactatccatgagtattaatttaaaaacatgaatcttttcattctcctggcaagagacatttactgtctgctcagccctcaccctggtcttttgcaagcactatagttctcttcatgtgggttatatcaattaagaatctcaaagtgtctgtacgaatacaggctttagaaagcatcagggttttcaaactattcagcaggtgctccttggaaatggcccaggatctataggaagcttcgtgttggggatggaagctgtcaggagagggctaccggagtaggctgagctccaggaaccctacttggacagagcaaccctacccttctcctttgcatctattacatttccatgtatgattgtattgccccaaaagtttcactgctaaaaagaactcaagtgtcatattttacaaacaataaaagaaggaccaaatgatatatctcatgttctaatatagtcaggagcttcgttggagactacgagggttgatgggataaatcaggcttgttcagctggattcccattcttttcaatgcatcttgtatgcagaataatgatttttttctgaataaatacttagctttgtaaaagtaacaaaaaaggttattcattgagtacacatggacacaaagaggggaacaataaataccagggcctacttgagggtggagggtgggaggagggcaagggtcgagaaactacctatcaggtattctgctcactatctgggtgatgaaatcatttatacttcaaaccccagtgacacgcaatatacccacataacaaacctgcacatgtaacccccaaagcctaaaataaaagttgtgacacagagaaataaaactaaacaaacaaaaccagaaagggttattactaggttctcataatccctgtctacttttaaagctgtgttctaatatctcatcagaaacgcttgaaactgacataactttttgaggacgttcccactgggtattcaaaagagatgacctatctagagacctcaacggcacgaaagcaaaaaagtatcaacataaaccaataataacgtggactagtttcctgggagctttcacatatgccaaattgttaggctcttttacaatgctgcatttatttaatatctggaagaagtaacattaaatattggggtgtaaaaattaaaatagtaatttagtttttttcccaacttctcatataagacaatctggatggggacttggaaatgttcttaggtccatggtatctcttaaattctgtgtgaaataagttaattggtttagatagtggtttatatagctctttatgtggttagatagctctttatgtggtttgccacgctttttacaaccttgatctaccaataataataaaaataaagcataatttcaaactcaggctgtatcttacaaagttcacgataatgcaaaaatgcattacagcatttttgatttgctttaaaaatatcttttcatgagctttacctgatatactatatctttaagaataataataatgcctatctaagaataaggatctgctcttatggtcacttaacaatagaaggccataagtatgaagtacatatttttaggttattcttccactgctatttgatgatggcatacagaatttaaaatctgcttgaactatctgaagaacatttcatttcacatgcaaatgtgtgtcttcctgtcctttgaatgatcacagttttctttatgattagtagatgaaccttcagtcagacttctatttttaaatcaacttagcatttttagtctgtaagcagaatgacagttttggatgtctgattgtgattttttttttttttaacgttccagggaatgatcaacctcgtgcttgagtgcatagaccgtttgcacgtctacagcagtgcagcacactttgctgatgttgctgggcgagaagcaggagagtcttggaaatccattctgaattctctgtatgagttgctgggtaagaagcatgattgggttcatagcaacagagttatctatttaaaatgtccataaatggactaggtgtgatggctcatgcctgtaattccagcaatttgggaggctgaggtgggaggatcatttgaggccaggaatttgagaccagcctggacaacatagcaagaccccatctctacaaaaaataaaataaaaatcaaacacaaaagcaaaaaaaatcacataatagctacagcaattttataacatgcctcctaattgagacttaatttttaatttactgtgccaaatcaaatggtgcttagtattaaaatccatctctgagtgagaaaggtagctagagaagtagatttgcctttggttaaaggaggagaaagtcattcagggtgcagtctttgcagatgaggggcctttatatggatgtgtgttaaatatttcctttttgcttttggagttagttccgcaagggtccctcttaattccttacattcccatctaatcaatgatctgctccagtcttctctctattctttatatgatctctgtttggcaacttctaagtacacctgacattgattaagcgacagttgctgtggtttaccctgcattcctgtgggctctctgcaaacacagctcctcattatttttgacctcctgtagcttctacttgtctcttgtcaaaaactaaagggtctgagatttttaccctatttgcaagctagtaagttagcctgcagttagggtaaagagggacagtttagtagtcaaagaaatagctgtagagattggctgtagtgccaattctctgagccccagttctcaaaggacaatgtgaaggggacagatgacacctgcacatgcagctagttgagttacagaaaaggaatcctgagctcagggagtgtgagttagttacactggacagaaagcctgcctggcctttgctgtggatggagacatctctctcttgcatggcctcttgctgcaaacatcttggaaaagatttcctgaaacaaagccttccaatgacaaatttgcaagatgtgcaaaaacagagaccacggggaatggtctctttctctaccctaaccctcgcctccaaaatctcagattcatcctgtatgtcacaactgttacatcacttccctgtttagacattgttcacatttctatatcattctagaagataaagttcaccttgttgtcccggtatatgaggccccagttaacccttccagccttctattttcccagttcccttatccctacccccttacttgagccacatcacagtttcctgaactttccatacacatcacacctctgggacgttgtctcaccttttccagaattgttgtatatccttcaagacccagttcacatgtcactgtcttttaaagttactcttgataaccgggcacagtggctgacacctgtaattccagcactttgggaggctgaggcagccagattacctgaggtcaggatttcgagaccagcctgaccaacatagtgaaaccctgtctctactaaaaatacaaaaaattagccgagcgtggtggcgggagcctgtaaccccagctactcaggaggctgaggcaggagaaccatttgaacccgggaagcagaggttgcagtgagccaagattgcgccactgcactccagcctaggtgacagaatgagactccatctcaaaacaaaaacaaaaataaagttattcttgatgtttctcccaactcttaagtataattgaaccttccttctctggtttcttgccactaagtttcacctgtattttatagcacttgtcacatttcttatttagttataagtgtgattgatttctaaggcaagaatagcaccattctggtttttgtatctgctatttaactgaatgtctggcacataggagatactcaataaatgtgtattcattacgtgactaagttctgataaaataggaaagcatacctaagtatagaaaggagataatgcaaaaaaagttaaaaaaaaaaagaaaaaagaatgcatttttaatgggaagaatttagtcaaaatatttgaaaattctttacaatctaattaaatgtcattaaaatttatagagtcataatacaacctagcaaataaaactcttgtgcctattagaattgttaatatgttttcattaggtgggctatttgatatttattaaaattaaacacttgcagtttggaactttcagactaaaaggtgacatgcggctgccatttctgagaacaggaccagggatattgaggctttataggaatttggattcatcattttacccacagtaacgattgagataaagattttgtgttgccaaaattctaatgactgcatttctttgcaaatgcagaagttatagcactaaatttcataatatagcagagactaaagtgtggtgatgtttttaacactacatcctaccttcttcacttggtataagatgaatttcttggataaactcgatgcttaagtaaagagttgcatcacctagcctggacagcagaggaaaaccctgtctctaaataataataaaaactggctggatgcattggctcatgtgtgtagtcccagctgcgtggggggctgaactggtaggattgcttgaggctggaagtttgaggccagcctgggcaaccacctctaaattttaaaaaagaagaatttcatgtatgaatgtttgagggtagaaagtgttacgtgcagaaagaacattgttttttaggtaaatctagaaaatatgcatcttttattttcatatcaactctttttatagtctctgttcattggtcccttcaacaggtattgtatccatgagtagcaaaaatgaatagaaggaattataattttttatataatcatagaaaaggcccattgcagcaaagttagcacttcagctttatccttctgagctacttatttctcaagccaatcctccctttacctccacagagttatttggggattaaatttgattattttagaacctacaaaagtaacattaatagactttacaaaatgttggggacttggtgggtatgaacacggttcctgctcctaattagttttgaggttggcttttactggaacatggctagaagtgtgattttaaaatggcttacctatttaaatagaacgagaaaggagctcttgaaggtggagcaatgtttctattgggatgtgttcagttggaaataacagaatacccaaacccaaactggcttcaaaaacagaggggattttggggcttgcacagctcgccgtctaccagtgggtttgacacaatggctccatcttatctccagaaccagctgctttatgtctccactctgccttccatggagtcatcttcctctagtgcggccttttcttgatggtctcagctgtctgctgtcagctcctagtactgcatactttctttctgacatgggaaaagtgaaagagggcttgttccagaagttatcccttgtgaaagagtgtgctatttcctaaaatccccaaatacaacgcttctcgcatctcattagcccaaattgtgtctggccattcctgaaccagtcgttctggcaagagtagggaaattttaccaacattggtcttgactgatcagggatccactgttgaaactgggtcaactccttggactgcctatctgtcatatagggaatgaatgttatagaggatggtggccaagaagctgaagtgtccatcccaaatgttgactcatctacttcctcaaagggttttatgaactgaattctaatcagaatgcttttattcactacctagcactatgcttgaatagagtaggcagtcaataaatatttgcttgaattatttaataaatacgttacagagatttccattgacttttctgtagcagggtgcatttggctatcaaattagtgtattaaaaaccagtggaactcttactcctctttcattaggttcctttcttgaaaaataagcacctgaactttcattcaggcatatagcaagtggcatctattgttactataaatattacctgtaaaatggcaatagtcattcccctcataaggttgttgggtggcttaaatgttataatatatagaaaatgctcagcatcgcatattgttgttcttcttatcattattcccatttcttttggatgtttgttatcatcctttcccttgttaacatagtaaaacttttgtctccaacctcttgcttcattcttattattgttgttttgcttttcaaagatgtcctagaaaagaaactttacttagatttgttggatatagcaaagaatgttatggattagccaatagagcacatagaatcataattattgtaggtgtatactggttcttgttttcctcatcggaaaatggcaggaacaaagtttgctttatcactatccccagactgcaaattttatattctattattctacccatttttgaacacagtatcgcacatctgcatctttaccatctggtatacagctaaatacttcagatctcaatgacattcatatatggtaaaatttgtggttaatctctttacctccactccttctcttctccagtctttactcagacctcagggagctctcacacacttcttatgaactttcatagactctgtgaccttgtttacacccctcttttaagaagaagggcctggtctgtctcttcctttcaccagcaaccagatgttgctggtctgtctctaaactctctgtattgcgttcttttaattcttggtccggtctgtcccttcttttcacctctgatgtcgctgattctgtctagttagcgggctacaacttgggagagagatcttgatattatatttttcattattctgaatctattaacatgcattacttttataattgaaaaaagtagttaacatatatctctaatgccagataattgatagcaaaagtaaaaactgaatgtactaattacagttgagtaaaaaaaaaaaaaacatttatatattagtgcaaatgaagagaatctcttcccataatctacaaggtaattttagtgggagatggggtgtttccactggatagaattatgagagtttttttaatgtttttgagttcttatgattttctttttgtgttatagtgagcatcaatttcatgaccagaaaagggtaacaaatacaactttatattgaattttgacatgcaaaatacttcagaaccatatgctgccaatattttttattgaattcattgtaatcataagatagccacatatacctaaatatatacttcagtttgtctggaaaagtctcagatctgcagcaataattggagtcctgtaagacatgtgtatctacctttccttctttatttggctgtcaaaacctttggttcaaatattaactccaaatttgttaagcctccttcccgttattcgaaataggtagaccatagattctctcctggggttatatgtgaaataagccactgtctttgtattttttcttcagtgtgtctattttgcacagagagaaaaccaagaaggtgggaataagaatctataacaattttgcattcgacatggatatatttcatgtgttttaggtggagaatgacaaaggtagatttgtgagcctactgtttggaatacctcaggatcttagaaacagcgatactcatagttggaaaagcatcactgtggcatgctttcatacatcttttctgacatccacacgattaatctgtgggatgcttacaagacagaatgattttctaaagatgtctgagaaatggccgctgggcaaactttcctatgaatactcattttctgaagattcaaagtatgaaaccaacaaggatagattgctgctctttgagtatggccaaaatgaatgtttgaagacttggaaagaatacagccattagccattatttctgcacattcaaaccaatttcccagtgtctcaaggaggcagatctccctaaatgccataaaacattgagaaaaggcagtcaagaggtgaagaagaaggaaatgggctttagacatgcacagatcggtgttattctagtgtttgtgcatctagatagttcgatcttgttcttcaggaagtctcagaaacgtatcgtataaacaagacacatcctttaaaatttcagcttggtgatagtctcattgtcccttactcttgcaagttcccaggtaggagtcctcagactccagtttacaagatccccaaacacagggacagctctccaagctctccaagaagtttcaatgcattatcttcttagattcttcagtacattctgaagtgttttgttttgtttgctcgtttgtttgtttaatgggttttatttttttcaggcttaggagcatctacttgttaatctcaatattttgaaaaatgtttctagattttagtccaattagcccctcatttttctgtgctgcgtagggcctgttcacttagtgtttccaggctttgaatgtaaattccaagagggatgttgtttcatttcctctgtacctccagcacctagaacaatgcttgacacaaagcagggaatcagtatttgttgcataaatttttaaagtgaaggtaatttcttggaatttcttttaatctaaatttttctgtaagtctcagatttttttagtcttttgtgaaattttgagtccaagaattcaaagacattgaagcatgaagcctccggggataggatgatactaataaaacagatgaatattgcatgattccacttataagaagtatctagaatgattaaattcatagaattaaagaatggggccaggcaaagtgactcatttctataatctcataactttgggaggccaaggcagtgggatcacttgaggaagggagttggagaccatcctaggcaacataaagagaccctgtctctacaaaaagataaaagatcttaacttagtctttaattaggcagcaattaaagagtattgtaaagttttagggagggacatttgtcttttgtttttgtaccttgacgcaccataccaagttgccattgcacttcgaagatgacagtggtgctctgagacatctcataatgaaagccactacagatactgatggcatggttttccgttttatttttggaaaggcattaactttattgtactatttggtattaaaattaatacattttagataaggaaagaaataagaaaaattaagaaggcagaaactactcttaaacttaaccacacattttgatctataacctttacaaatgttcctttaaatatttatcacgtaatacatgcagaaaacattttgcacacctgcatgcgtgcttgcagaataacacgtgtgtacatatctgcacatctttgcagcaagacatcacctattccctcctctccttgaagatttgctcatcttgctccaaattccaggttcatggactaagatagtcaaaaggctttcctttgatgttggtacattttaggggcttatttggttacatttttttggacttccgtgcttttttattgtcgtctattttttctctaagagtgaaagtgtagccacagaacatctcttcacatcctaacttcacatcctaacttccattctcttcacatcctaacttccattcttattgagcatttgtgatttttttttttgacagaatttattgctggttcaaagggtcactgtgaaagatcatattacaggacatggcccttttttttcctctcctgggtccattcttcttccaccttattttggaataagaaaatgtacctttttgacctggggaagcagtcccactaatatcaatcttcctcaagctctctgtttctatctcagtcccttatcaagatatttcccccccaaatatcagcaatcattctctaagaaatttctaaaaaacacagttttctccatgctatacatgtacttatattcagtgtatacatttactttacaaaaatggaatcatgctatcaatgttcttttatagcagatgttttcaattaattctacattgtgggcctctatccttggtagtaactataaaccttcatcagactttagcagatgtacacttctgtgctgaggtaatgtcaccatttacttatttaggcacatttaggctattccagtattttgctgttataaagagtgctgtgatgagcttccttgtatttctctgcatactttttcattactttagaaactcacataactgatatcttcttaactgactggatgaattataataattcacagactccatttatctgtaaaatgtattggtacccatgacatgcgcctacatacacacacatgcacacacacacacacacacacacgcatgcatgcacgatgttcaggaggtactctattttactgagttaatttttttcattagaaatgtatatattttcgtagtatattgagattgtttgatcttttactcattaacagatttcctgatatatttttgtctctttggaggaatgaatctccacttggatgaaatgttgctaatgtattgctaaatttgatttataaatactaaatttatattgctaaatttgatttattaatttcattaatatataaacttatataatatttttggatttataagagttcctcttgttttgtgatgtgtgctttgatatcaatgtcactgatactgcttttgtaaaatcagggaagtttccttagttttttggctttggaatacggtcatgtgtcacttactcatgggaacagttctaaggaatacatcttgcaaacatcatggaacttacacaaacctccgtgttatagcctattgcacagctacgctataggggatagcctactgcacggctatgctatacgggatggcctactgcatggctatgctatacgggatggcctactgcgcggctacgctatactggatggcctactgcgcgtctacgctatacgggatggcctactgctcctgggctacataacctatggctgtacatttgtacagcaatatgtacagcaaattaccatactgaatactgtaagcaattgtagcacagtggtatttacgtacataagcatagaaaaggtacagtaaaaatatagtcttatggtcttaagggatgatcattttatctgattcattgttgaccaaatcattgttatgcagcatatgaagtagtgtagaaattacttatttattgaatatgtgcgaaaaagcttttggtctttgacatttcaatattactcatgatttattattctgtttagatgttttcccttctattgcatcagttttagtgaaaaaatacatatctatatatctatgtatctatatcttgagaccattttacccagatgttcaaaattacagtataaagatgtataaaattgttgtgtttataattccttttttgagatagggtctcactccatcacccagggtggagtgtagtggtgatatcatggctcatggtagccttgaccttccaggctcaagcaatcttccctcctcagcctctgaagtagctgggaccacaggcatgtaccatcaaacctggaaaaattttttaaaaattttgcacagactgggtcatgctatgttgcccaggctggtcataaactcctgggctcaagtgatcctcccaccttggctcccaaagtactgggattataggtatgagccactacgcctggtgtaatgcccttttcttaattttgtccttttttccttttctttttgattaaagtagtagttggtagttagcttatatttaaaaaatagtccttgaatgtattcttgatcaatcttactattatataaattatttttatttctaatgtattaatttctacttttattgcgatttatttttttctgttttactgatgtttatttgatgttcttttcctctatttcaaaagacgtatttaccatttttcacccaattgcttagcaattaaagtgtttatttaattttgccttgagtacacttttggccatttaccattggttgtgttaggtagtattctaatttttgatatttattagatattttatattatgatattgattccatcattgacccaagagttattaaggagagagtttaaatttttatatgctttggttttattttcattcctgcttttcttactaaattctgacacggttctgtcagagaacatggtttataccatgtctgtttgcagtaaatttaatgaacttttctttgtggcttactttataattttcttaaatgccccatggcttattaaaagagttcattcttacactattaatttctttcaagaatcacttatgttatatatatcatatatataattttagatagataatatgataatgatatatgttttcattttagatggataatatgataatgatatatattatatatatacctatataattttagataatacaatagtttatatataattttagatagctatatataattatatattatatataaaattagttttacaaaatcagaaataaactgaaaagcatgagttaagttttaaacaaaagggactcttaaaattcaaaaactttatcatgtcctttttcccagttgctattgttctaaattgggaacagatattcttacagaataaaattagttctgcttagaacttagtacttctcattcctctgctatattccacccctatcttttgtcccctgtactctgcagtctgtgagtatatctcgatggctggctcttaagggaggctgctggacccagagccagaggagagcctgagtaatgagtgtattagctcttaatctctgtacaaatgtcacagaggcgctatacacaaaaaagctcttctcatgaagttggcgtcttttctgtgtgtttcttttcttactctcaggtcagataataactttatttctttatttttggaaagaggaaacatgaaggacatctttaagtttaattgtacactgtaactgtagggtctcttccctcctgctcttaacagggaggttaacaggcggtagcctcaaacttcactacttcaaacgcttgcatcagctaccagattttctctgcttttttttttttttttttgaaacggagtctcacactgtctctcagactggagtgcggtggcacgatcttggctcactgcaacatctgcctcccgggttcaagcgattctcttaactcagcctcctgagtagctgggattacaggcgcccaccaccatgcctggctaattttttgcatttttattagagatggggtttcactgtgttggtcaggctggtcttaaattcctgacctcatgatccgcccacctcagcctcccaaagcgctgggattacaggtgtgagccaccacccctggcctaccagattttcaatagtgattattcttatagagacatctttctctctttaaatatcatattgtctaaacatcttgccatcctcttgtaagcaattatactgtttctgaataaacttaggggtataaaagtagaaaatatttaccatgcttgctttgaaagaatttaatgattttgaaaaattaaaagtttaaaagtgagtgtataaactaggctgaaagaaaccagaaaagtcacataggagttttatttaaaatgggttgttcaatcaaagaagtgtagaaaacagtagtctaagccaagctagaatcagtttctttactgcagaatttcaggtctttaatatacattgtgaatctctaaatccacggaaatgatataagaaaataaaagggtttcaaagttagtggctattggtcttctcatccattatttaatgtaacatttagttatatctctctgtatacctgttagagttataattactagttatatctcctagtattttgtggttcattttcagaaaaactgatttgctctttttattctataggtaagaaaattgggcttgagagagaagaataatttaatctcatggctaattaaaagcaaaggggattagaacccaagtgagggaactcccaggagactgtttttccattaccctttactattacctcccaatgtgaaattcactttccgaaattacattccttctaatgagcagtggtttgcttcagtctcaattaataattattaatttgtctttaatgtctcagtgttgtatatgtacgtgtatgtatgtttgcataagtttttagatgtaacagaggatattttgttcttgatccaatattttagggctgcatattagcttatctcaattttcgagctagaaaatcacataaaggtgaaatctatttcttcttttgcagcggctctaattagaggaaatcgtaaaaactgtgctcaattttctggctccctcgactggttgatcagcagattggaaagactggaagcttcttcaggtatgttttctagttttttccttgttgtgatagatcactcctatttttctttgcttcgtatcctttaagacaaaaaaaaaaaaaaaaaaaaacaactttgagtgaggtgtggtggtgtgtactgagtcccagatactcaggaggctgaggtaggaggatcacttgaggctaggagtttgaggctgtagtgcactatggtcactgcactccaacatggacaatatattgagaccccatctttaaaaaacaaaaagaaaaaactctgatgtttggtgtaatataagtgttttccttttaaattatgttaagtatttttatttcttgaaaaatcattagtattttcattagtcatttctgaatagtcatctaacaatatcatgtccatttatatcttaaaaaacctatttataaagccctgaaaaccactaaagagccagaattctcattctttttcaaattgattactgctagtctattctataaataagaagatcagtttggagttctcattgttttccttgtattcaaaagattatttggatagattggggagacagttcattttccaaatcctagagtgtaatattttatttaaaggaaatttagtaaatactaacaaatggtctgtataatagtaaaatatttataggcagtcaacccgatacacacatctctaataagatgttagttttatttcagtattgtggagacttatcaatgactgtgaagacttatcagtgattttggacttaccagtattaaatcagttatttgaacttgttagagctctctagctcacacataattgacctctctagtgccatagattgcctcagtgacacccaaatgaatctactgctcttccatctgtttgcacagtatttcattatttgcctttctttatcactaatgccctcttatgttacttatttttcctctcagtttccttcattagtaatgaacttcttgaagataggggcatggtttcattcatctttgttctttccggatctaccataccatctggcacctataggtgtctagtattgtttgttgaatgaatggatggatgaacattaaaattcactcaaaaaataccactgtccatacaaaatagttctgagacttttgcatgataaagacccactcagggacaggtttgttggaattgaatagagacagagaaacaaccatgatcagagagagtaattttaagtcacagagaaaaatttgtagagtttagatagtggaggacaaaaatgtgtagagtttagatagtggaggacaaaaatttgagtcatagtgagttcttgggcactgctagatcgttgggcagcagaagtaagatagaaatggagattgttgtaataaaaacaaaaataattatgagatgagggtgttaagagtatcataacatgaatgtagtgactgtgcattaattgcagaatatattaaggaaaaacctgtaacttctagcataaagaagtgaccaaataagtggtactgaagcaaagtcattgtctggggtaaatacctgagattcattgtcttgcaccaagaaaattaaggacatggacacacacacaaggagtgagtttaggagcagaggtttaataagcaaaagaaagagaaaggagaacagctgtctcaaagagagagagggagagatagggaaagagagaggaagagataggggcagagaggagagacagagagagaggaaagagagagagagagagacagagagagatcacgattgagaaatctggcctgcaccagagtgcaccagattttataggcaggcttgaggaagcagtgtctgatttgcatagggcccaaagattggttggactcggtatgacatttgcataggaaggctggccaggaaggctggctgctccaccctaatcttatgcaaacaggctttccacttggcaggtgccatgttgcctgctccttactgtacacgtggctggcaaggagacgggaacatggagccgccattttgaacatgcctagtcccaggtggtcttttcctattggcacaactgctggcattcacccgtggaagcttccaacttgcttctctatgtctgcagctcgattttgcaggctgctctttgttagaaaagaacatgattttgggactgctcttcattaaaaggtaaaccttaccaaggactcctgtaccctcactatctgcctaaataatttctccttaactcctgtatcagtaacaagatggtggcatagattacaaaaatggataaatgtttagggccaagtgtccagaatcactggaaagctacagaagacatttaaaaaatgctcatgtcttctgctggacccagtggtatctgtaaagagataggtgcagggcagcctcagagcagagtgttaacactggctgaatcaactgcacagcgaaatgcttaactggaaaacagagagagaaaagacatgaacagagccaagcatcctttaaggtcaaccaagtacagtccagtgttttcagagtcttcagttttgtcagttacaggcacagtttcatcagatacaaattattatttgctgttgtctttttccagtcaatctgttgattgcaggcattcctaatgaaaagggaagccctgtgctcagagataacataatgaaagtcaagggaaagaaggacccttagagtatatttaatctaacattcttactttagaggaaaagaaactgaggcaaagaacatttaaatgactgactcaaaatcttagaaaaattattgttactgccaaggttaaaactcagctccctagcatcagacttgcaatatgaccatgatactttgtagctcttgttttttaagtatctaaaatatattttgctgaacaattttttctactgtagttaacatttatgcttttaatgaactgttttttctccagaggaagtggtgttgcttagtttttagaggcagtaacaatgatgagatgcacatgtgtatgtatataacttatttcaattgtgctttgctctttacaaagtgcatacatatgcatcatttttttcctctctgtaataagtctgacgttgctgaacacacactctcctcatctcgttagtgccctagctgcagattcaaactgaagaattcttgagtagaaaagggatcaaaagtagggttaattgtcttcctgggatctagaccattctagtctttactgccttggcaggtccccagtgccttggttgttttggttgatggctggcctgaaacacctcgtttaccattgccagatgcagaacaatgcctaggattgccttaaaaaacaacattggaaatgaagtgatgaatcataggtgaatagttaaattatattacaacaacattttcagctatattataggtattgcaaagaattgtttagatgtatatcctgaaatagatttagaatatatttttaagtgaaaattcatttttagaatgtgtgataggatatatttttgtaaaaaaaaaaaagtgaagatgaaagtagaaagaaataaatgaaaagaggaaagaaggggcaaaaaccctgtgtaatatgtatatatgtctttgcacgcataggctgtagaaatatgtacaccgctgtttactttggtgaccaaggagttcaaattagaggaaagaaaaagagtaaaacactgggttctctaggacagggaattgcttgtcaaaacttgtgataaatagcaaatgggaagtcattagacccaaaggatagagaagaaagggtctaatgaacagtaacaccaattattttttccaccttgcttttacttttttttttaaattgctttttccattattctttacattctaccactaatttagtggcagggacaatagtgttatctacccgatagggctgttagggggattaaatgattaatatttgtaaagtacataaaaaagtatttggtgggcgggtgtggtggctcacacctgtaatcccagcactttgggaggctgaggtgggcaaatcagctgaggtcaggagtttgaaaccagcctggccaacatgatgaaaccctgtctctactaaaaatacaaaaattagcaaggcatggtggcaggtacctgtaatcccagctactggggaggccgaggcatgagaatcgcttgaacttgggaggcggaggttgcggtgagccgagattgcacgactgcactccagcctgggcgacagaacgagactccatctctctctctctctttctttctttctttctttctttctttctatctatctatctatctggcatatatgtacttattaaattagatctgtccgtccaataattccagttagattcatacaaagttgcctggctgtagatattacatattgtaagaggccttttatcaacatggtgttcagctgcaaataagggaaagttctactaccctgacccaaactaggaaggagcggggcagtcaacagcacttgagttccatgccatcgaccacccaggctcctgccatttctcctttcctcagtgccccctgcctgtgcgttgttttctctaatgctggcagatggctgcagcctacaggttgctgcatctttactccaggcaagaggattgaggtaggactcaaccgacggagatactgataatgacaagcattacctctacatttacatggccaatagacagacctctctctaatattattacaaacagtagtatcttttcaacatttcatgaatttacttccaaatatgattttacactgtcatgaatcatagctcctgtcatttctgttgccaatagtgaggaaaaaaagctgatgaatatggaaaggggaaagacgtgtgagtagaaacacaaacggcaaagctggagtagaggctccgggagttgacaggtgcaggaagctgagctgccgtcagccctgactgtcagctgtgtgtaggtgtgtgtgagggccacagaagggagttatctatacataaatatgtatgtacgtgtgtatatatgtgtgtgtgtgtgtgtgtagatctatacatatatatgtatagatatatacatatgtatagatacctacacacacacacacacatatatatatatacacacacacacatacatacatatgtacatgcatacccctacctgttgggcaaggggtttgaaacagtttcagttttcctgacaacgtaattggttttacctcaagcctttcccactcaatgttctatatatgcctgggaccacagtgattaagaagtcagagtgaatacctttacagacaaccagaaacatatttaaggcttgtgaagaagattgtgtagattgcctaacctagtgctcttgaaccacattcttccctcccttctttagttttagaagctgaaaagcaaaattctcaaaatcttaacctcacttaaaactgcgggtgcccatgttgccccattctggcctgtaatatcagctaaactccctgggagagctttgcttcccaaagaaagcctttctaggagaaagactcaggccctacctcaatctcttgcctggaacaaagatgcagtaactggtaggctgcagccatctgccagcataagagaagacacctcacaggaaggagggactgaggaaaggagaaatggcaggagcctgagtggtcgatggcatggaactcatgtgctgttgactgtctggctccttcctagtttgagccagagtagtaggactttcccttacttgcagctgaacaccatgttgataaaaggcctcttacaatgtgtaatatttacagccaggcaactttgtaagaatctaactgaaattactggatggacagatcacatttaataaacgtgtgtatgccagatactattttatatgctttacaaatactaataatttaattctaacaactctataggttaggtaacattattgtcctgtttaatagatgaagggactaaggctcagagaaattcaataagtgagctaacacagaaccagctcccggagccaggcagtttggcatcagtatccttgatcttaatcaccccactgtgttctctaaagattcttactgactatgagattatgaatggaaattaaaatatgtatagttatattgatggggtgttctcttattttggggttctgtttttgtggggttttttaatcttttaataagctaaaatttctaagcaggctttcataggctttctcttgatcttaatttctttgagcctcctggtgtaatcttaaattccccaattatatttacatttttaaataccatggtgagaaatgatctgaggccccaaagttaggaaataagaaaaagtgtgggtggtggtagtaataaatcatttatagtggaagtggaagcaaaaattatacagagacacattagcaacaccaagggagttttttaaaatttattttaaattgacaaactgtaactgtatagatttgtgggatacggtgtgatgttatgatgtatgtatataatataggatgattaaatcaagctaattaaatatccataacctcagatacttgtcagtttttgtggtgaaagcaccagtgacaccagtcactatgtatactaagagtatctgatcagttcatacgcatgaccactctgaattcatttggggaatgaaagataaatcacatattttccctgacttcaagtgtgtctagtgattatgtcgctgggccaaagttaattgaaaagacaaagattggtatgagtaagtacagttgattgagttgatgtatttcagaatggtggcattttcttctggatgttctcagtccttgaaatacgatttgggggcaagagatagctgactaaaaactgctagtcaggaggctacagagtatttctgagtttgactttttgtgtagtctgttccctgcacagttttgcagtgatgaaagtggtctctctttggcattcctgccatttcttcccctctcttagtaagtgccagtgagtgaagtcctgtctgggtttaagccaaagaaggagtctttgaggctggtcgtggtggctcatgcctgtaatcccagcactttgggaggctgaggtgggtggatcacctgaggtcaggagtttgaaaccagcctggccaacatagtgaaaccccgactctactaaaatacaaaaaattagccaggcatggtggcaggtgcctgtaatcccagctactcaggaggccgaggcaggagaatcgcttgaacctgggaggtggaggttgcagtgagccaagattgcgccactgcactccagcctgggtgatagcgtgagactctgtctcaaaaaaaaaaaaaaaaaaaaaaaaaaaaaaaagaacgagtctttgagtggtctccagatatcaaagcttcatgctcatgtacagaacaacttgtggtacctgtaaataggatggtttaaggcttccaaagtccttataattctttcttgcagagtataagctcatcatttttcaaagatgaaaaagttgtaagctgtgaaataaattgtgccataatcttgtgtagcaggaagttttcctccttgatatttacttaagtgtgggcaattgaattagaaagaacaagagctcacatgatatttattgtctgagatccattattagtgatgcagaaatcatagctaactgatttgagtagtaccaacaattcaggcaacactattgactttctccagggttagtttggaggtgggataccagcaacctgtgctcattcactacttttttctgattttattttccctttgcatagccctttagggtggcattccacaaaaatcttagttagccagaggaataaaagaggaagtcttgtctcgtaaaacccaccaaatccattaagggcttacttgagaaaaactgcttattagaaaacaaaatcagccgggtgtggtggctcacacctgtaatcccagcactttgggaggccgaggcaggcggatcacgaggtcaagagatggagaccatcctggccaacaaggcgaaacctcgtctttactacaaatataaaaataagctgggcgtagtggtgcgcacctgtagtccctgctactcaggaggctgaggcaggagaatcgcttgaacctgggaggcagaggttgcagtgagccgagatcacaccactgcattccagcctggtgacagagtaagactccgtctcaaaaaaaagaaaagaaaacaacatcacaagcagtgatgtgatttgcactgcacatccacctggcctgtttctagtctcctttgggaactgagcttaagtttcattgtcagggacagaactgaagttttggcttttaggcactgttactgacagatggctatttattaccattgtctggtctgattgcatcttgctcataccattctagttattaaatatttttagcatcacccttggtcaagtaattgcattgtgtcacttgctttccgtcaagtttaagtgtctgttacctacctaaggtacattgtcatggcttaaagcctctgtgtgggtctgagttcagaggtgcttctctgcattgtgagtaacttagttcaatcttctcaagccaacttgcctcttgatggcccttttagtcctaagcttttaaagtgggagcatatgaacacagtagtcaaaagagggaagtcatttgccacccacccaaatgttccatctgcagtatcgaggcagggtgcaccactgtccaggcagtcccctcagggtcagtgtgatatagtgaaagtagtcttgatggatattagccgaggtgctttggcacccatgaaaggtacctgctctggagagaggtgaccaggatgaggtctcagagtgtagtcagcccattaggatacaatgtcctaattgtgggcaatagggcctgttccaaagtttcctactatttcattatcaaaaacagggttcatccctaccaagactgactcatcagaaatggcagctcattttaaaatcattctatttctatcttctttgctgctatgtttaggagaagcagagctcataggttacaggtatggattttagagttggactggcctaagtccaatcccagctccaccgtttatataatagctgtatgaccttgaccaagtcgcttagctcctctgtgcttcccgttttttaacctgtcaatgggaatggtaaaaatatctgcctcaaagtgctcttagtgacactacaaatgtgcttattaaattaaatgtataaaaataccacagtacgcacctagcaccttttatttttggatttagcagttgttggtagctacaagattaatttgatttattaaaagcaaggttttcccatgttcacactgctaagatatgatatggagaatttcagatggaaacgcataataatagcaaaggctgatacaagttttactatgttttggatactgttctagtctctttaaatatattaacttacttaatctacacaataactttataaagtgaataatattagtattcccatttcacagctgggaaactgagacatggtgaaattgtctttccaaggccagacagcatgtaagccaccgaggcaggccttaagggacccccctaccctcgcttaccatctggctgcaaatttcatgctctttcccttcataatagataatgtctcagttgggggccagcgggatggatagtgatggaatgagtgtgcactgtatgttatttgaatgtgatgaagaaatagaataactctctcatgtaaataggcaagttcaattgttgcagatctgtagaatttcagtgaaagtgaaagtgttttctggaggcttcgtaacccacctagcctcccttgtggctttactacccctctcttgagttacattgggtgatgcaggcttagtggcgaatgattcaaaatactactcttcattaaatcacaaagtgttttggtcttctggtagtactttctcatattctcaggtctgaagtgatttgctcagttttccaaaaatacatccactttgaaatgcattaagttgttgtatttcaccctacacatactgatatatctcacaactatataccattctgcacacagtgccctatctaaaattgtgctttttgtcaatgtattgcacaacctttctccttccttccccttactttacacttgctaactacaacaactagactattctatgcacctttatttgttttctttgcgatcactgggaatgatgcgcttggtttgtctttatactgcaggagaacttttaaaattgatgtaacgatgaagctgatgctatgctcagtttacatttctgcccaaaatgatagctctcaataaatatttgctgctttgaggtacacatcttttggaagaacttgctccaggggatccatcttaaaaaattctcaggtgtttatgtcttgtaaacctttgagtaaggctttagagcaaacagttacatctgccagcatttctgtgggtactgacgtttcacagggagacccagagtcttagacttttgaacattataatgactgcgtagtttttaattgtgcaacgaaggaaatctcaagtgaatttagggcactgtgctgacagtgtcatatgcattactccactggatttccacagttactctataaggtaggttttattacaatttccatttacaaatgaagaatctgaggctacacagctcagatgtcaccttttcaaggtaaaaggaaactaatgaacctaggaatgaacctctgtagtctgtctgtaagctctatgagagcagggatgaggccaattttgctcctcattttgctcaaaccctggacctaacacagtgaatggtccatttgatgtactcagcgatgcatgaatgaataaatgaaagagacccccagaaaaccagaaccatgattgttaacagcaagataggcatatctggcggggcatggtggctcatgcctgtaatcccagcactttgggaggctgaggtgggtggatcagttggggtcaggagtttgagaccgtcctggcccacatggtgaaacctcgtctgtactaaaaatacaaaaatcagctgggtgtggtggcatgcgcctgttgtcccagttacttgggaggctgaggcaggaggatcgcttaagcctgggaggcagaggctgtagtgaaccaagatcatctcaaaaaaaaaaaaaaaaaaaaaagaatatcttgaagtattaatgatttcctatctggcattcaacattttcttaggttttgagatgtggcaatttatacaaataaatgtttgtatagcataaaaattctaataccgttacttgttgtataatgaactgcttttagttgacattctcttttcttttaactggactttaacttctatagtttgtctatttttttataaatcatggttccttaaactgaaggcagcaaaccatcaggggcctaattaaggctgcatagtacattataattacagtgctcattttgtgtgttttatttcagctaatttactccagcaaactcctgactcatattcatcttttcttctaataaaagactcttggtccatcatttttgtttgtctgttttgcaaatgcatccacgatattccctcattctgtatatggataatgatgtgatccaccttttatcttcactaacttccatttttatttatttttctctccttttcttaattttgccaagccgtgttatattttagttttaacctctgttgcttttttctcctttttggagctttatgagtgctcaagatttaatgggcttattttcttctttagccacaaaaccagcataaaaatatgaagcatatgtaattatgtattttggtaatttggcttgagcccaaatctcttggaattgttatttttaagtgtatatatacatatatatatatatatatacacacacatatatatattcatatcaatttatttttctctatttctgtgacttacggaaactctatttagagtaatgtatttatttcatgagttaaccccctgttaacaggaagcaaaatgtgcactgcttcttttttcttttctttctgattatatgtaaagaataaaaagttaaaaaataatttaccagtttatcttatattgagactcaaatgatttcttgacttcaaatttatacccattttaaacaaacaaaaacatttttctccggctcagtggtgattcagtttgtgatacacaaaattcactgcaaacatttaaaaagatgtgttgtaattatgctatatattgactcatcattcaactcttgctatttgttttgggtagacccaattctccttggtaggaagagcaaactaagcttccagttagctcaagctagacgtttctatagttcctactttctcattttccctcatggttgtgcttactcttgaaaataagacaacttagatgcaatgcgtaagttatcactcattggcagtttaatttaaactcgtggaaaaaaacaacagatttgtgcctttacagaaccctctcagatgcacaggcccagatacaaattactgcttttacacataactcagattctttcccttacagcctcaccattgctgtgtagcaaaaaaaaaaaaaaaaaaaaaaaaaaccacctcccaaactccttggatcttgtgccaacatggaactagctagaccatgtcttctctacagcaaactgctgcttacttcatttgcatgtttttcttttttcatgatgttggtttcgtaagaagacactcctgttaaccaggggtgctttatgctttgttttagcatttattaaaccctaagtcttagttgaactttcactacttttttaattttatgagtacatagtaggtgtatatactcatgggacacatgagatgttttgatacaggcatgcaatgtgaaataagcacatcatggagaatgggttatccatcccctttcaagcatttcttctttgagttacaagcaatccagttacgttctttaagttaaagagttaattgtacatttaaaatgtgcaattaagttattattggatatagtcgcactgttgtgctatctagtagtaggtcttactcattctttctatttttttgtacccatcaaccatccctacattcctctagagccccccactacccttcccagcctctggtaactatccttctacttcctgtgtccatgaactcaaatgttttgatttttagatctcgcaaataagtgagaacatgtgatgattgtctttctgtacctggcttatttcacttacatactcatctccagttcatccatgttgttgcaaatgactggatcacattcttttttatggctgaatagtactccattgtgtgtatatactgattttctttatccattcatctgcagacggacatttaggttgcttccaaatcattgcaattatgaacagtactgcaaccaccatggagtgcagatatctcttcggtatactgatttctttcttttgggtatatactcagcagtgggattgctggatcacatagtagctcaatttttagttttttgaggaacctccaaaatgttctccatagtggttgtactaatttacattcctaccaacagtgcaggagggttcccttttctccatacccttgccagcatttgttattgcctgtcttttggatgtaagccattgtaactggagtgcaatgatatctcattatagttttgatttgcatttctctgatgatccttcactgcatttttgactcagctctcctgtaatctcaagaatgcaaaactttctgtggttctgcccacttgccctccttgtttctctgtgcctcgctgtgtctctcgccaaggtctaacaggctggtttaatttctcctgatttactaatttacctgattttatttgaatcaaactaactttgattccatgtcttcatgctgattcatagatatctcccctgaattctcctctgatcagtgttgtccattcagcatttctctacctcttacgactatcatcactgctccacaaaggagcatattggtaattcttccctgttgatctttgtttcatttgccttattttatttcaaccataaaataatagcaaatacttacatcacgttgctttgatccaagctctgttctaaatgtcttacatgtattgctattcataacaatttctcctctcccaggcaccattattacatccatttcatagaggtggacactggagcacagagatgttaaatagtttgctaaaaacctgcaaggacacaaaactaggcacatcggcttacatccatgcttatcaccagtatataatacaatagaataataatgatacctcttactatgatatttccccattaaattttgtaaataccaagactgccaatcagttactcttctgaaaggatgatggtctgtcacatccctaagttatttcatttaggaatgcaaatgtcgttcatgttctgtgtgtttccctgttctttctagtcatttcccagtttacttccccatctttttactcgttatgtcactttatttaattactcagagctaaaagacaaattttcctactttcagtgaaatgtcagtgaaatctggagatattaataaaaaggttctgaccaaaaaagctctaacaggtttcgactcccaggtaggagggaaaaaaatccccaaacaaatacctgtggtttgaataatttgtaattaattcactgggtctctgattgtgacttctttcgctgatctgctgtggacaccgccaaactgtttgactggcactgtatctccactgtttcctttacatggggcagttcaattcctactaattagcactcagccggagtcttcctgtttgcctacctctagcttagacgaaagggtttccatgtcatgattttcaggtggggccaggtgctccttctggagtaatcttttgtccagtattattactcctacttgaaatagaggtggaagagagactttccttctcccagagcagaatcacactcctgtatccttcatgaatagagaactaggttccatctaaatccacatacatcttggtgttctgggatgattttgactgtgttttatttttgcaaaacagttgtaaccatagatgagaaacagtaccatggggggtggggcatggtggtttctaagtctgtggttttcctgggctttctgcagtgatcatgggagcaccagcgtcatggcttgctttgtccccacgttggcctcctgtgcctgtgtggctaccagtctaattccattcacttcttctcccaaatgtaagcttatgcctacttgcgatggggcaaaatccccaggctagattcttcttggtaggtaaagtcagcctacgtagagcactcttgccctgtggcttgtttctagtttttctatacagattctcaacaaattttgttcaacctcagacagcctgagttgtgacctgtgaatatacaatagcaaagtcaactttgatctctaatgaagttcctacagatttgtaagtcaagtaacaaaagtctaagtctatcagtaaaaagcaaacaggaccacttttttttggttacaaaaaacatgataaggaatattctctacccatcacagcacttggccacagctcccaataccattaagttatttctagacatttagttacatccttggagattttcctttctcgggagaacataaataattcacagttacaaccataaaagttttaaggcaaatggctaaatatttgcacgtattaaacatgcagtgcctgcagcctcaattttgtgttctacaaacaaacagcacagaaatttgccgaattcaccaagtaaaatttttcctcaaattgaaacacagataaggaaatcctagcactaagaaatataaattccctatgttgtgtcctctgtcttttctacatttaaaataataacggttttaaatgaaattctccagatataaagtatttcagttattctatttacacttaacaattatgaatcttgttatgagtaaataaataaatggcagatttattttgtttaaacagaatgtgagaaccaacagtccatttatattcattcacttattcatttggcaaacacgagatgaccttccctgggtcagagtgagctgggtgacaaggaggcaaaattaaatcaatatctgctctcaagggctcgttctgtaatgggggattgaaatgagaattttaaaaatgtgaatgtgcttgttactacaaaaggaggaataattaattcatctcagggcattggtaaagactcaccaaatgaggtaactttcaacctttgcaagctgattgagattttgcagtcttagacggtgggagtgtatttagatctgagaataacatcagcaaaggattgaaggtgggcaagttcctataagtttcaagagggccttgcctgtctggttcactgctgatcccattccttggaacagtgcctggtaggtgcttaataaatatatatgattcatatgtaggtatacatattaattgttgtttgtgggaggaagcggcaggaattgaggctgcaaaggaaggttgcactatctggtttagggactgatattctatgctaaggggagtggactttgaccttggaaggtctgggaagccattaaagattttaagcaagggagtgacattgattaaatgtgtgtttcagcataaccacctacagtttggaggatgggttggggagggaggagaaactggaggagaggatatagtaagaggctattcagtgaaaggagaggatgagtttaggagataaatttggacacaggattaatgaattttaacaattagatttaggaaaatgagaaagtgaaagaggattcaaaaatgacttcaggtttttagcttgaatatatggatgcacgatggatgagagaagcaattttacatatatacgtacaaagaaaggtgttatgttcagcttttgaaaaagttagttgggggtacttagagacattctcattgaaatgtccagaagataattaggagatgatatttgaaatcaacttggaatagtcaacctaagttcttgtaactcctcactactaaggtaaatcatgcatgttaaatggccagtaccctgagaccaaccctagtttattgctgtacaatacttaattctagtataaactctcagtactgtaatttgtgtgttctctgtgtagcaactggtagcttttgtttatgcttattccaaacttatggaatgaaaataagtttatataacttggatgaagtataagacttaaaagactccatagattaaaagttaattatagttatatactgtagagaggaaaggcagctaatgttactggccttttgttgtcaggcctcattaagttgcatgaattgactaagtattgagatttagtggcagaaataaaatgtaagtagacattacttcctattgttttatgattcttttaaaatacgtttcttactataaaagttatgcatgctcatttcacagaatttatgaaatattgggagagaagtatacaaatccagcaataaccaagactaacctttttaggtaataacttctggtcttttttaaaatatgtattttatacaaatgaatatattttacatagttgcaattataatctatatgttattttggatctactcttaaaaagttacattgattattatatatttctatgatgttaaaaggttctctcaaatcatttctataaacttattaaaacataaaattcaattgttttgcattattagttgtagttagttgaaatttttttaagtaatttgtagtatatttataattctttcattccataatactgttatgatctgccaagcttttaaatttgagaatctaaccataagcttcacgactatagctatttcttggtcttattgaatgtatttagaatttagtggtcaaatgattgtaactattgatattataatcttcattaagcactgtttctctgcatcatttttcatccaagtgttcaaagcatatatcagcataatttaaatatacgcataatattgtatacctattcctttttttatttaaaaatggactctttggtgtttctcatttgttgtcctttaagaattttttattatacaaaagcacatttgctgtttatttcaataaaattaaaaatcaaatttatttcaggctgggtgctgtgtctcgcaactataatttcagcactttgggaggctggtgggaggattgcttgagcccaggagttcaagaccagtctgggcaacataatgagaccacccccgtctctacaaaaaaaaaaaaaaaaaaaagctcagcatggtggcatgcacctatagtcccagccactcaggaggctacgggaggctaaggtgggaggattgcttaagcccaagagcttgaggctgcagtgagctataatcgtgccaatgctctccagcctgggcaactaagcaagatcctatctcaaaaaaaaattattccaataaaccagggttattcttgaggtattggccatctaatatgcctgcatatttcagtttattccaataaaattgaaaataaaacgtgttttctctgactttattgttataattaatagaattagaagctgtcaatgtttttcaactatttatttattggatctgacctgatagaattgaaaaacaaagaaactgttttaatgttaaaccccaaattctgaaagctttctattagactaggctaaataggagaaaaatcggggatttgttttcatatagccatttttgcactttgtgacatacgctatttacttccaaaatctggtcatatcttttctaatatattcagtttattcactctatgggccttcatgagtgtttattttagcacgaaaatttattggtcttcgtcttaacttcttggtcttttttcttaatggttatattgtattccacgattggcaatctttttctgaaaaaggctagtgtcttagtcaagtaggactgttgtagcaaaatatcacaaactgggtgatttataaacaacagaaatgtatttctcacagttctagattctgggaagtccaagatcaaggctcctgcagatatggcatcctgagggcctcctttctcaaagaaagttcgtcctcacatggtggaagggacagcaagctcccttggggcctcctttataaaggcactaatcccattcttaagggctctaccttcatgacctaatcacctccccaaggggaacatctcctaataccattgtcaggcctttgagcccaaaggctggatgtacactgtgacctgcacgtgtacatccacatggcctgaagcaactgaagatccacaaaggaagtgaaaatagccttaaccgatgacattccaccattgtgatttgctcctgtcccaccctaactgatacatatattctcccccacccttaagaaggtactttgtaatattctcccccgcccttaagaatgtactttgtacacctaccccaaacctataagaactaatgataatcccaccatccttcgctgactcctttttcagactcagcccgcctgcactcaggtgaaataaacagccttgttgctcacacaaagcctgttggtggactcttctcacggacgcgcgtgacaaccattgccttgggggttaggatttcaacatatcaattttggagagacgaaaacattcagaccatagcagccagatagttactattacaggccgcgtggaccatgaggtctgttagaatcactcaaccctgcctttgtagtgtgaaagcagccatagacagtatgtaaatgcaggtgcatagaatacacaataaaattttatttataaaaataggcagtatgcgtctgacaagggtctcatatccagaatctataaggaacttaaataacccaacgagcaaaagccaaataaccccattaaaaaattgtcaaaagacttgaacagacacttctcaaaagaagacagacaagcagccaacaaacatatgaaaaatagtctacccacatctccaatcaccagagagaaatgcaaatcagaactacaatgagataccatctcataccagtcacacttggctattgttaaaaagtcaggctgggcacggtggctcacacctgtaatcccagcactttaggagaccaaggtgggcggatcgcctgagatcaggagttcgagaccagcctggccaacatggtgaaaccccatctctactaaaaatacaaaaattgcctgggcatggcggtgggtgcccataatcccagctactccagaggctgaggcaggagagttgcttgaacccgggtggtagaggttgcagtgaagtgaaattgtgccattgcattccagcctgggtaacaaaagcgaaactccatctcaaaaagaaaaaaggcttatattgttggtgggaatgtaaattagttcagccactgtggaaagcagtttggagatttatcaaaaaacttaacagagaactaccatttgacccaggaagcctattactgggtatatatctgaaagaaaattaattgttttaccgaaaagacacatgcacttaaatgttcgtggcatcactattcacaagagcaaagacatgtcatcaatctaggtacccatccacagtaaactgcataaagaaaatgtggtacctatgcgtcatgaaatactacggattggataaagaaaatgtggtacatatacaccatagaataccacgcagccataataagattgacatcatgtcctttacagcaacatggatgcaactggaggttgttatcctaagcaaattaatgcaggaacagaaaaccacatacagcgtattatcacttatagtgggagctaaacaaggggtactcatggacataaagatagcaacaatagactagccactactaagtgggaggaagggggatcgaacaagggttgaaaaattacctattggttgggctttgctcactacctggttgatgggatcaattgtactgcaaacctcagcattatgcaatatatccatgtaacaaacctgcccatgtatcccttgaatcgaaaataaaagttgaaattattttttataaaaaggcagccgtgtgctctatagcaatcaataatggggagaaaacaaacaaaaacatcgggatagcatgaccagtctattaaaaatgcttttccatttccatgattttattttagcacagaatgaatgagtttattttgtttctacgtttttagtaatagcaaaaaaaaaaggtattcagttttagtatacttatataaagatctgctttaactcgtcagcctcttgtagcattagtttctgttgtctttgatttttaactgttatgcattgttggaacacagcagctgattttgaacagctccaaaatgtaactcaaaatccttttggctgaatatatatttgtgttttaacaaactaagtcattagtgaagaaattagcattaacagtcctcgttttgtaatggattggggcttggatcaaatatagattgtgacagccatagagaattgcctctgtattctatgatacctttgtaaatgtaaaactttgtatttcttttctaagaatattaactccatttgagatgtatgaccctttccacagggttcctctggggcccttcccaatactatgtaactcttagaggtgatgttttctgtatgttgggtctaattggtgtgaatgggacccattctcattgttgacaaggcaagcttgttcagaaaacatgaacacagaggtacacatttagctttacaagttcatgctaaaatttctgataatgaaatttattttctcttctttcctttttaaacttcaagaaaaggcatatactattttatattttgtggtggctagtacctaaaaataccacgatttttaatcccgttttatacattgtgttatttctgtttatttatgtcttattttacatatttctcttatttaacaaactaagaaatcttgtgtactataaacctcaaggagaatgtcatgatctccatggattgggatgcactgttgcaggattacactttcagtgccaagaagcttcataaactggccctaacccacctgtcccctcccccactcactctgtacatgaggcacaccagatatgccccacgttcaagactttactcatgcacatactgcccttcctttcctggaaagcctgaaaatggtcatgaacgtattctttaaggccccacctctgtgttgcttcgtgtacgccctccttcgggtagcgttaccggcttcctctgctaaacaccacgtctcagttgtttgccttttcttccctcaactgtgatgtcttcatctttggatattagtcccctctcccaaacaccacctgtcacctatcacagtgccttgtaacagtcacattgagcacagataattacatgttgtactgaatgcacctatgtagaaaaaggaagacactggtcattgtacaccaattaatcatgtgttttttttcctctttctttgttttatctttaggcattctggaagttttacactgtgttttagtagaaagtccagaagctctaaatattattaaagaaggacatattaaatctattatctcacttttagacaaacatggaagaaatcacaaggtaaatgaactattttatttccctgaatgaattctcaaatccttttagatatatttttaaatacaataacttttaaaaagtgtgtcaaatttttcatgagtgtttttaatctcttaattattttttgagatgcagtcgagctctgtcgcccaggctggagtgcagtggcgcgatctcagcccactgcaacctccgcctctagggttcaagcattctcctgtctcagcctctcaagtagctgggactacaggtgcatgccaccatgcccggctaatttttgtatttttagtagagacagggttttaccatattggtcaggctggtcttgagctcctgacctcaggtgatccacctgccttggcctcccaaaattctgggattacaggcatgagccaccgcgcctgggcttcatctcttaatcatgatcaagtaatattttttagtgtttattcatagcatcagtgggaacatgaacagttctcaatttatatatgaagaaaagttggaaaattagtgggaaactactgtaatgtttaaataactgagtcaaatgtaactggaggaatgcatttgctttgtaaaaaagtgctgctgatgcttgattctgaagggggaattcgaatcagctgacagtgactgcacccagtggctcatgcctgtcattgcagtaattggggaagccaagatgggagggttgcttgaggccaggagtttgagaccagcctgggtaatatagcaataccctgtctttacaaaaaaagaaaattagccagatgtggtggcatgcacctacagaggctgaggtaggaggattctttgtgcccaggagttcaagtctgcagtgagctatgatcgcatcactgcacttcagcctgggtgacagagtgagatgctgtctgaaaggaaggaaggaaggaaggaaggaaggaaggaaggaaggaaggaagaagggaaggaaggaagggagggagggagggagggaaagcagggagggagggaggatcagctgaaagtaatttctcttttcaggttctggatgtcttgtgctcactctgtgtttgccacggggttgcagtccgttctaaccagcatctcatctgtgacaatctcctaccaggaagagacttgttattgcagacacgtcttgtgaaccatgtcagcaggtaaattcagacagacaatgtcacctgacaggtaccataataaaagaattaatgttcttgccctgtagctgatactatatggtctgttttttaaattagaccatatagtattattttctgtatttttgcagtgaataatatgtctttttctctaacaatcagatgggctaataataaatgaacctagcaaaatatggatttgccgcaaacacatgtataagagcttttattcacattcctatgtagatacataaccattggcatcttcaggaccaccctgacaactgtataggtatatggttgtatataattgtactttacatcttcttagaatgtaactaaaaacactatccttcaatatcattgtttttttctttttttttaagacagagtctcgctctgtcgcccaggctggagtgcagtggcacgatctcggctcactgcaagctccacctcccgggttcaggccattgtcctgcctcagcctcccgagtagctgggactacaggtgcccgccaccacgcctggctaattttttgtatttttagtagagacagggtttcaccgtgttagccaggatggtctcgaactcctgacctcgtgatctgcccgccttggcctcccaaaatgctgggattacaggcgtgagccactgcgcccagccccttcaatatcattttgaggtacctgctatgtgcaatcaaaaatagaatgtccaaaatgtaataaattatgcaaataaccaataaaactacatcttcagttagatctgccttccaaggcacctaacgttcattgaataccatgtgccagctgtggcgctaagggctttacgtgtattctctactgtttgtgtctgtgctttcctaggaaccatgatgattcacattttatagacgaaaaaactggaactggaagtggaacttagatctaaatccagagactgagcttataaccaccgcgccacactgcctttcttatcccctgtattagtcaggcttctctagaggcacagggcgaataggatagctgtatatatgaaagggagtttattaaggagcattgactcacatgatcaccaggtgaagtcccacaaaaagccgtctgcaagctgaggaacaaggacgcccgtctgagtcccaaaacctcaaaagtagggaggccagaagtgcagccttcagcctgtggctgaaggcccgagagcccctggcaaaccactgctaagtccaagagtccaaaagctgaagaacttgggagtccaatgttcaagggcagaaagcacccagcacgggagaaagatgaaggatggaaaactcaaccagtctagtctttctgcgtccctctgtctgcttttattctagctgtgctggcagctgattagatggtgcccacccagattgaggatgggtcggcctctcccagcccactgactcaaatgttaatctcgtttggcaaccccctcacagacacacccaggaacaatactttgcatccttcaatccaatcaagttgacactcagtatgaaccatcacatccctcaaatgaacacataaataaatgataagaaataacggcttacaatcaacaaaacgctgtgtgtgatagtagtaacattgacatactgtatctagcagctagcctggagaaactgataacttcctcctgttttaaacagaaatgtggggtttgttgtgtatttctatgatgtgttttgttttttgagacagagtcttgctctgtcacccaggctggagtgaagtggcatggtctcagctcactgcaatctctgcctcctgggttcaagccattctcctgcctcagcctcctgagtagctgggattacaggtgcacaccaccacacccagctaatttttgtatttttagtagagacggggtttcaccatgttggccagcctggtctcgaactcctgaccttgtgatccgcccgccttagcctcccaaagtgctgggattacaggtgtgagccactgcacccagctaatgtgttttttaaaaatatataatatacatatatacttattgcatattcactctagggcaaagactttacatttattctattattcaatcctcacaagatgcttaaatttatagatgtttaccagtccattttccaggaggataaatggaggatgagcaaggtttcataactagtgccgggtcacagagctagcaaatggatgctcaaattttctctcttgactcggaaacccatggtcttccaactgtacttccaaccacactgtgctggaaaaatggaaattgttaggaaatggatacagctggtttttttctttcgctccttttgaggagctcctttttaaaataaatcaattacatattaaattatgttacctctgctgagctaggaagcaaagtccaagcaccttctatgtttttgtttgtttgtttgttttacagtattgatttaagatttccttcatgattctttatataacagacctgccgtttatgagtgatatgttctgagaccttcattcatttctacctagtattaccatagggtatatgtccactcctaaaatggaattaaatacaacttactgttgtattttttctgttcacagtgaggcataatgaacaacaaagcttattaatcaccttggttccttcataaacaacatgacctacctcagccccatgccccatgtgacacaaagcttagcttaggaaaatttctccatgtccggaattcccaataactccattaattctaaaagtctgctctgagtgtctcagtttatgacataaatatgattaatgatacacaacatgctgaagaggaattaagacaaaataacattagttccttgggtgacactgccaagaaatctcagaagcaaaactgctgatggaatgttcacagtgaagctggctttctctgtgtactacctcagtggtagttttaataattttttagtaattaaggaaatatatatttaatatgtggcatcttagagaagcatgactaatgtttaaaatagtgagatgtggctgggcacggtggctcatgcctgttattccagcacttgggaggtcgaggcaggaggatcacttgagctcagaagtttgataccatcctgggcaacatagcaagatctcatctctactaaaaataaaaaagaaaattagttgggcgtggtggcactcgcctttagtgccagttattcaggaggctgaggtgggaggattccttgagcctgggagatggtggctgcaataaactatgattgcactactgcgcttcagcctaggcaacagagcaagactctgtctcaataaaattaaatgaaatacacaagtgaaattgtgagatgtaaatgaaaacaatgaaaggtttttttggactttccttacatgtgattcccgtctctttaaagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggtacgtactatccattttctttcaccgtgttccagaagatcttttgctgggcatttctgaaagctattggtgctgcttccattaggtacttctatagggtattaattattcagaaatttagcattgagatgatgagtaagagtgttgaggaacaagcagtatttcactaggggaaaaagaaaatacttaaaattatagtacatttccaagggactgccgagcttgtgaacaatgctgtgtatttaaagagtagatttaaataagagtgtattgcttaggaacaatactgtgtatttaaagagtgcattccgaagcatgaatgaactgcaagaaacttgtgagttttctgctttaattggtatgtttaaagctttagttgccaacataaaagaacaaaaaacaaatcttggaaaataatgggaagaaatagactaagttcagccttctgttagataatgtaatggtgggaaatcaataatttgtaaagtgtggtatgaggactcagatcataacaaatgacactttgtttcagaagtataaaatggtttaaaaataaaggaataggtcatttcaccagctaccaactcttagctttgatggttgagtatatattaaaaatgaatactttatattaaaaaataatattcttttctctgattcatgaagaagtagagtttggttagctccatttaaaagcttagctcttgattatgtagattttttagatgttaaaattcatctggattctgcagacataagcttatattaataaagctgcatttggaatatagtcctggtatgatcttggcatagtttataaattatttagcatatggaagatgcagaaagttaccttaagttataaagctgaactttgcctcatgtggagtacaaatgatagacatttatgaatgctttatgggcctaaaacttatgaaaaataagaaataagttgaactacacctaagattttatgctaatgagtttatatctaaaagcattccatgtagttgtatctaacaatgatacttactgaattctttcttcattgagtgccaatagctcagttgtctagacgagaggaagctgtattttgattttttgtgaatttttaatttttttttttcgagacagagtcttgctctgttgcccaggctggagtgcagtggtgcaatcttggctcattgcagcctctgcctcccgggttcaagcgattctcatgcctcagcctcctgagtagctgagactaacaggcttgcaccaccatgcccggctaatttttatatatattttagtagagtcggggtttcaccatgctggccaggctcatcttgaattcctggtctcaagtgatctgcctgcctccgcttcccaaagtgctgggattacaagtgtgagccaccgtacccagcctcaatttttaatttttgtgagtacataaaaggtatatatatatttatggggttgaagctgtgttttgcatatttcatctaacctctgaggaatgtggttggagtcctcacagtactgtagactgctttgtacaaaggcgacctgtgccagccagaccatagtcacagtgccttgttcccacaggaaaattgtcctgctgaccaagcagagagaaagagccctaacttcagaagacctattaaacacaaaatagggctaaagtccatgttataaaacatttgaactataatcctttagatactattaccccctctctccctagctcctagtattgctctgcaggaaataagtactcaaatgaataaatgaagcacgtggacttgttttcccattacacagagattagatgaaaaaaaaaaaacattgatcgacaatgccaagttgctttcatttagtctctccatacaataacatattttactatttttgttttgtattcaatttgaagctttttctttcgatacattaaaagtacctggttcttatggaattgaattgtatgcgttataccttttattacaaagtatctgttcagtagaacaataagaacaacaaaaaaaaatttagtgaatctgtggacatgtaccagaaaggacgataggcagtggaatttcaggagaaaagcatcttgaaattttattcattttttttaaatggcaagaaaatacgtatcatatcaggcctacagttgaaaagtattttctcttaagccactgggagtctattaaatgctttgctgattttagattcgtaattaatgaagacaaatctaaattagttggaatgtgagttatgaagctcgaattcatagtaacagataaccttcttgggggtcgttctcctgttttcttcttaatggttgatgtacaatttgaagtatcaaatatcagtgatttccaggatagagcaccttctctgccacttaacattttgtaattggagagtggcagtatttctcggaacaaggattgggctcataagcaaaagtttttagctatgtcttcatttcttctcttcaatttaaactttgcggtgttgctacacttcctctctgtcaatgcagaactggattttgggaatccaggtcccaggtgtttgagaggaccaaaagtataaaaaaatcttggtgctttgagagaatttaaatatagaagtagtgtggaggaatgtacaggaaagatgggtacaggtttctaatagagggtctataaagctatcgtatccctccaagtgaaaaatatatttgattataatagatatcgtgtaaataacatcgctattagctacagatcatggtacaaacaagaaactagacctttttctgcattgcttttatatgacttttttaaaaagctgcctttattatattcagggaattctagaagagacacttgatagtgaatttattgcctgtggatttgaatattggtaaaatagaaagtgtccacattaaaaaaaaaataggtattctctactactggcatttcagatatgtccttggtagagatattggcatgctagaaataaaaagaattattaaaaatacaaagcatgtatcacaaagtctatttttgtctttgctcaagttgaaggttttgtttatgtttatgagcatgtgtgtttgggagaaccttaccttcttttctttcattgtgcagtgagaagcagatgctctcgggacgaattagcaaaggagttcttcgaatcaggaatgggcttagaccataggttggtcttgccggggcaataaataacatttatccaatatcattttcacacctccagttatatcctgctttacttaagaagccaaccaagatcttgtgtgaaataaatgaaaaactataggccaattggcctatagttgtctcacaataagcaacgtgctgcaggaatgaatgatcatattttctgctttcgttatctttatgtatttttattttaaattgatagaatgaagggagtttagcatttgaaaaagggactgacatgaagtacctgctgtgcctgagactctgttacttgtaaaacattaatcgtcaaaataactaaacaaggtgatggtacttggtgttctgtttataagacatccaaattaagagaggttaagtaatttggttatggtcttacaagtagtagatggtaaggtagctatttgaagtccctggagatgttcctttgacatcattatataatctgctcatagataatttctggatcagttgccatccgtctacatgcagaagtttctgtgtatcagaaggtccattttacaacataagtagcagcctgactcctgaaataatctttttatttttttgacaaagagtttaacatgtaacatgcgtttacattcaagatttattccttctgatgttgtgcattggtttgtcactacttattcaaatcttttgactttggctctgaagctgattctctgagataaaaaaatacatgaccttccttaatgttttccccccaataggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaagttagtatgtctatgttttttggtctctttcctttctcatttctcatacctccacagaagactctgcactgccattgcccttcttctctaaccattgtttgtctctcctgggcacctgtcctctgcgcattttgcctgtgccttgaaggaggaggtaagcctcacctaagatgggcatcctgcaaggctgaatgctttgtttacggatcccacagtgtttagatgtgggcagtctccctcaaaccagggtcctgaactatttcaaggtgtttttttttttttttttagttcatttatttagatgaaatgagcaaggctgttttaaaaaatactgcttattttcttatattttcattcattttccttttttaagacatagttcctcaccccattgcacaccctcttatttcaatagaaattaaatatcctttttgttgatgaggcccagatggctttcttcagtgttcctctccacctttattctctttattcctttattctctgcccatggtcaatggtgccaagatggtttcctcacactctttccttttttgctattaccagagggaaacaaattaaagtgataatccattgtagttctgcaaatgaaactttaataaatgatggtctgttataataagtaactactctgtcacttatttttatacacacacacacctgtacacttagaaggactccatttgtttcagttattcttttagttataattctcccaggaataattcctagttacaaaagcatcatattgaagaagaaacagagtaatcatgaatattagctatccacgtaccagttactttttctgatgtatttatacaaattatgtttctataagcttctggaatgttttaacatttttatttttcctcacttttctttgcttttctttatttttttggactggacctgatacacaaattagaaaaagaattatggacaggtgcagtagtttgcacctgtaatcccagcactttgggaggccgaggtggaaggattgcttaaggtcaggagtttgtgaccagcctggtcaacacagtgagaccctatctctgcaaaagttttgttttgttttgttttgtttctttagttagcacctagttttgtatgcctgtagtcttagctacccgggaggctgagttgggaggatcacttgaacccaggagctggaggctgtagtaacctgtgactgtgtcactgcacccctgcctgaacaacagagtgagaccttgacacacacaaaaaaagaattacgaggaaaatgaaaaatttaaatttatttttgtaaacccgagggccccaggaaatatatatcatttaactgtttcaaaaagtgtttttcaatggaactcagattaaaatagttttgcttaaatgagcagaatgtataaaagattttagtaagttctttttcgttgttgagattgataaacaattagcgataaggttacctgctttcttcaagttgaagtgacatcagaatctcctttaaagcagcagtccccaacctttttggccttaggcaccgcttttgtggaagacaatttttctacgggccagggctggggttgaaggtggggatggtttcaggatgaaactgttccagctcagatcatcaggccttagttcgattctcatagggaatgagcaacccagatccctcacagacacagttcacaatagggttcgcactcctatgaaaatctaaggccactgctgatctcacagggggcagagctcaggcggtaatgctctcttgcccacacagctcacctcctcccttgtgcagcctggttcctaacaggccgcggactggtacctgtcgtggcctgggggttggggcccctgcttcagagaatttcattaggaaattggacattgaaaagtgaccaagaaagtgaaaaaagaatctaaaaaaaaaaaaagaaaagaaaagtgactggtttttcccctcattccttgttaaatcctgtaattttaagcatatagatatttagatcaggtcttttctttatctttcggtactttgggactttaagtgaccagttattacggacatgcacttcattcccgtaagaatgtggtgcatgtgcttttggttacttctccagcaggtgatgtcttcactgacccattaattaacttaagcaggttttctcttttgatgaatatgatgtcctcatgttttaccttttacaattagaggcccttgaattctaaggtgatcacattatgatggtacgtaggggaaaatgtggcttctgataaaatacttttgtactaacaatttttccctaagattttgtgaattagaaaactttaatgtacaccagagataaaattgactctaacgtgcatcctctttagagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccaggtaccaagatccactcgaatggcaatcactggtattgcagtcatgctgatacacagtggctttacacttggaccacaacccataggaacgaatttcacagtaatacagttgtacagttgacatgtaggactgaaatgagtctcataaaataacacttacctttaccatgtccactcactcattttctattctattctatgtttttgttgtcgttgttgttgtgatggagtcgtgctctgttgtccaggctggagtgcagtggtgcaatctcggctcgctgcaacctctgcctcctgggttcaagcgattctcctgtctcagcctcccaagtagctgggattacaggcgcccaccaccacacctggctaatttttgtatttttagtagagatggggtttcatcacgttggccaggctggtcttgaactcctgatctcaggtgatccacccgctttggcctcccaaagtgttgggattataggcattagccactgtgcctggcctctattctatgttttaagtagttttcccaacccaataaactgattccctaatgtacgaacagattacaacctgaggtgttaaaaacactgttcaaggttgtctttaaagttttattaaaataattaatattacttagtttataaagtgcatattatacttttcatgcacgtctgtgtgaagagactactaaacaggctttgtgtgagcaataaagcttttaatcacctgggtgcaggcgggctgagtccgaaaagagagtcagcaaagggtggtggattatcattagctcttataggttttgggataggcagtgaagttaagagcaatattttgcgggcaggggtggatctcacaaagtacattctcaagggtggggagaattacaaagaaccttcttaagggtgggggagattacaaagtacattgatcagttcgggtggggcagaaacaaatcacaatggtggaatgtcatcagttaaggctatttttacttcttttgtggatcttcagttacttcaggccatctggatgtatacatgcaagtcacaggggatgcgaaggcttggcttgggctcagaggcctgacaatacttttaaaaataggcaataatagcaacaggtggaacttagtgacaaaaatcgtgcaagaaattttaaggtataatagtgttaagatgatttaatatctggggtaatgtactgcacttgaagtaatatcatacagatgtgacacacaccgatcttagagtgtagttcttaagcccccaacctttttggcactaggtaccggtttcctggaagacaatttttccacgagccggtgggctggggttgaaggtggggatggctttgggatgaaactgttctctctcacatcatcaggcattagttagagtctcataaggagtgcgcagttcacaatagggttcacactcctatgagactctaaggagaatatagagaaagatgaggatgccgtataggaaacatggagttttcaatttcttctcatttccttcttcgatacgcttatttggaagatatttagctgacttttatcttgggtatagattaagatcatgaactctagagtcaaagtgcctggcatcaagtactcttcccttaggggagctgctcaccttctttactgggatgcttagagtatgtttgtcatagttaatagataccatattacttggcaaatagtcacccaacaaatgttagctgttgttcctctttttctgtttcatagatgtaatggtgttctgaggttggctatgaattcaatatcgacttatattgatggtgaagtagcttcagtgaggttgtttagatattcaaagtttgtttcttagtttttaaagatcaaagacattgcttccaaagtctgaacttgaattaataccatgcctccaaagcttcagttgcttagcaatcagatttttagctcctcaaatcgtatttcttgttccccctttttatatcatgttgttaaaataaacatgcaaacattgttcatggccaaaattcagtttgcattgcccattgctaaaaggtgggaggatatgtatagtgcaacctaagtttataggaaaaaagatttgggagactagaaatgaacaactagatgacatcatggtagaaacttaaggattacctgagacccagataacctctatcagggaaaggaaacagttatcacctgcttctcttgggaatgccacctcgtcgttgggcattgtggtcatttgcccactctatgtgttgcgagactagctgtggggtcacacagaagtgcttaatcaagacgtaaacaaccagtcccttaccttgggttttttatgaacattcaatttcttccttttaatgggaacatataaagattttgtttcttttctgtgaagcttatatttagaaaccactaacagtaacagagtagagtgtaggggaagatatcaatcactagtcagacatttatacgctcaaagatccgatggactataatgtgggcactgaattgcctttactctggctaatgaatgctggcccagttggtgtaagagcttggggatgatttctcattttaaattatacattccttggtagtagccccatatccattaaacatcttttggttgtccccaccaacactcctttttttttttttctggtggctcataaattgatttggaaacctaagttgtcaaaaaaaaaaggtaccaaaatttatttaaagaatatcatgaaggctgggcgcagtggctcacgcctgtaatcccagcactttgggaggccgaggcgggcggatcacgaggtcaggagatcgaaaccatcctggctaacacggtgaaaccccgtctctactaaaaatacaaaaaaattagccgggcgtagtggtgggcacctgcattcccagctactcgggaggctgaggcaggagaatggtgtgaacccgagaggcggagcttgcagtgagcagagatcgcgccactgcactccagcctgggcgacagagtgagactccgtctcaaggggaaaaaaaaaaaaaaagaatgtcgtgaaatagatggcttagaactttgttctatgattactggtttatgaggcagttttatttagttcaatttgcagtgaagactgttggcactgcatcttattgcatttgtttctgatgtgtcttttttctttttgtaaattttagatcgtgttgcctcctcatctagaaagaataagagaaaaactggcagagaatatccatgaactctgggttatgaataaaattgagcttggctggcagtatggtccggtatgtaattttgaaatttattttcagattctgtgaatacatctttctgaaaacataactttttctgccttttcccgctatggggtgacatcaatcagttagttggattgatttttttccccctacacattagtttttgtgcagttttgccttactacgttattgtagttaatggggctgacaggcattattggcaggttcactgaaggatggtctagctgcctagacaatggaaagttatcagtgtctgggctgaaagttatattttcaaatcaaggttaacatatacagataataggcattgatttttaagccacttaaaagatctcagtgaaattgaaagtgaaaactgaaaatgaaaagaaggcaatttacttttctctcgctcatgtttcttttctttcagttccaattgtgtgtaaaagcggaaacctgtgggcaagtgttcctagttggtttcacaggtagaatgaagactgagaaaccatgattgcacatgcttctaaatgatactttgctaaagagcttagtttacaacttaatacaatttagatttaaaacaaacaactacctgtgtaatcctagtgtatatcatatacttgtttgtgtcaaaaccatggtaatactttcatttgtatgatatattctaagtgtcccaaaggccataacactttcttatacctgactgaatatggaaattaatgtatttacccttcatagtttattgcattgagctctgaataaagaatacttaatataacgttagtagtagtatcatgtgatactccacactactcagtaatatttatatatttattcagtgttttgcattcttgcatacagattattaggtcaaattgtcattacagtgaactgggttgtgttgttatttcagttgtactggtgatgacctagcggagagttcttgcagttgctaaatgccttggcaggcatcacatagctagtgagtagcagctccaagactggaatcaaggttttctaagacagaatttagaaagtgactgcaagtcactgtaaggcttgctgaagcatgaccagaaaatgggatgcttttattaactaaatgatagttagacatttgttacaccaacaaacacttgggtacctagttttgtgctacgttcatcaattttttttatttttttgctatagagtttcgctcttgttacccagcctggagtgcagtggtgtgatcttggctcactgcaacctccacctacccggtttaagcgattctcctgcttcagcctcccaagtagctggttttacaggcatgcaccaccacacgtggctaattttgtatttttagtagagaccagtttcaccatgtggccaggctggtctcgaactcctgacctcaggtgatctgcccacctcagcctcccaaagtgctgggattacaggctggattacaggcatgcccggcctcatcaattcttaaaattgaaggacatgtataaatgctaaataaaagactggaccatctattagtcagtaggaagagagatgctacaaatgtgtaagtaatcaattgccagaggaattacaggcaacattctccagaagtttcaaaaataggaagagatgattagaggccaggaagattttttaaaaagttcccattaaaaaaaaaaaaacaaacaaaatgtaaaacaaacagcaaaaccccatattataatagcaaatatttcaacgggcttctaagatgatctccactgcaaactcctagtaagttcacctaagtggttatgttttgcagtggaaccttaggtgtgtttcttctttaagaactgactaaaatataaagtctcactattattgattcttccagttacatttagttctggttgataccatacatcacattcctgccatgttcaagacactcttcgggttttcttttttttttttttttttttttttttgagacggagtcttgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtttcgatctcctgacctcgtgatccgcccgcctcggcctcccaaagtgctgggattacaggcgtgagccaccgcgcccggccagggttttcaaatattaaaggataatacagtaccgtggggccttcttgcccgcaactgactcaagttatcctttgctgggtctgaggccagttgaggcaacactgggcttgatgtacctctgggggaaacactgagcccttggtctgctgctgttgtgttagcacccgcacctttcctggtgcaggaggtgttctctcatctaatgtatgatttgcagtctgcttcttttccaagaccttccctgaaactcctttttgtgtagtagttagaatccttgaccttgtgatgtcaattattctagattaagatatgtgcctgttactatgctaatttcataaattcattaacattttaaatgaggttttgaagtattcaagtatatttttctttggagcaatttatacttagctacccagcatgctggattttttgaagaagaggaagttatcgttactttgggatatatttcccaggagtatggtgcaagggccctattttgtggaataacaaggcagatctgtctatcatttattcgtccctttaacatttattgtatgtctactatttgcctggtgtgtttagtactggggacccaattttgaaaaggccttgacttttaaggtattatgtttgccttcttggcgcttcctctttagttgaatgattggtaggcaaacaattacagagtaaagaagtaatatttagctcttcccagggaaatcagggaaggcttccaggaggaggtaaatatttgatccaagactgagggatgtgtacaagatagctggcaatcagaaagcatgaccgtgtagtaggcagaggacctggcatgtgtaaaagcgaggaggcagaagagacaggacattagccatgacctttcagtagtgcagtgttgcaagaggacacctctgctgtggtgtggagaagaggtgagaagccaggccatgtatgcaggaagtgtgtcacaaaaggcttggaaagaagatgattttattctgtagggggctaaagagcattgaaaaatgcttagcaggaaggtgacagacttatgtctgctttcaaaagaagctctgctgtgaatgtggaaaagcagagagcctggaggcaggaagagagacagggagagggcacaggtacctcaggtgagaggcgactcagagccccgcagtggggatagagagacgtgattacaggagatgttttggtgttcacgtatgggatgtagcaggagaaggaagggaatctgcgcagatttctggtttcattgagacacttgagaagatgatggtgttggttattctggtatagagagtagagacaaagtggagatgacctaaatagggagattatttgtgggttcaacacattcatttttacaaatgctcattttatgtttcgtttgtagggttagagatttagagtttagaataaaattacataactcaatttcattttcaaagttctgcaatcaaataagtatatctaatatatgattctatataagtcttgttcattcataatgatgaccagaaagaaaggaataaatacatcatttctaacttggtgactgctgaagacttaaaaaaaaagctcactcatgtttctgtccttctcatgtggcatttttaggatctggtaatgatgctcatgaactaatttgttccctgacagcatatggctgccatctaggtgctgccacggcgttaatgccgatgcgatttaggtctctgagaagataacaaacctaattactaatgcaaggagagagaacatctttctcattaattcattcctaaaaccttgcatttagtttaatgtgattgctaatatgcagtttcaagaattaatataaaaaccacctgcatatgatgctaatggattttgcgaaggtagtagggtgatttgtgagatcaggaggtaacatgcagggggtaaaagaaacagctagaaccacctcaaagtgtttatgtcagtcagtcctgtcgttaattgatgtctgtaatcagtttggttctatacaggaaaatcactatgaattaaaactaagtcattgccacacccttcttacacaggatttatttcaatttataaaacgtgtcaagtgcctaggacataccaggcatgtttaaggtgtttgggacacatcaaagaacaaaagagaccaaaatctttgcatttttgatcttctaattcacggagacagacaatagcccaataactcaataaatccaatctgttagaaggtgtatggaccaaaaaaaaaaaaaaaaaaagagtaagctgggcaggcagactgtcctaattagacaagtgggcagggtaaacctcactgagaaaataagatataagcaaatgctgcaaggagctgactgagtgagcctgtgggaatctggggtagaagtctgcatggcgggggttcatggaagctctgtcaaacagaagggaaggaacgaagataatgccagcttttaccagtgacctcagatactcactgcgcctgagaggttgtgggggcagctttgcaggggtaatgatctgggtgtttcttcttgccttctgcctccactttctaccacacagttgaattccattgctagtgcctggcattggagactattttatgtcaatttcctgtcctgtttcaggttagagatgacaacaagagacaacacccatgcctggtggagttctccaagctgcctgaacaggagcgcaattacaacttacaaatgtcgcttgagaccctgaagtgagtttcttaactttttctattttccaacctgccttccctgaaaaaaaaaaaaaaaaaaaaaaaaacaggtattgatgctatatgttaattgagctgtgaagtgatttttaattccagctagaactttttataatgcataagtggattggatcagtatttgttgagaataagactttgaccctgttaatttatgtcctcttgttctacatcagtattttgcaaagggtgtcctacaggtgtatatgggtattatggatgatgaggattttgtgacctgataggatacaggtccacagaatgtgggctgtggaccgggactgtgtcagtcacaaattgttactggtttgtgactaaataagatattaagagcaagtgtttataaacttctataccaatttagggaagcaattttacatatattgaatctaatgatttaagaaatgtgaggtcatagcctgtatgtcttcattttgaaaattcagttttctctaacaattttattgtattatatcaggaaaaaccacaatagaccaaatattaaaagaaaattagttcttcaccataggtaatttgagaagcactgatttaatatatttaaaagatgctaaattcaaagagttgaataatttaaaattttttgctgatggacttttcagaactttggggtgaagtctgtttatggtatttcctaaactgatttcaccatagcagcctgttttcagagcatacctatgaggactatttatctgagcaccatatctttggttttgttttagttttttaaggagccaaagtcagctgggcatagtgactcgtgcttataatcccagcccttcggaaggccaaggccagtagatggcttgagcccaggagtttgagaccatcctgggctacatagtgagaccccatgtcaacaaaaaatatgaaacttatctgggcataatggcgcacacctgagtcccagctacttggaggctgaggtgggaggatggattgagcctgggagattgaggctccagtgagctgtgatcacgccactgcactccagcctggatgacagagcaggaccctgtctcaaaaatgatagtaataaaaataaatttaaaaggagccagagtcttactgtgttgcccaggctggcgagcaacggcaattcacaggctggatcatggcgcactgcagcctgcaactcctgggttcaggtgattctctggcccagtctgggtatctaggactacaggagcttgccactgcatccagcctgagcacatattttgagaaaagctactgtagagtattttatatcacccagtaaaggcaaatttgctttttagtgattgctgccagttgacctcttgactttgccccttacctttgcagacggaataatgggactgaaatggaataaaggaaggaatataatttcgaattttgatatagaaaagtaaagagaatatttttgcaaagccagtaactttactcttgtcctccttccatccttgatgtcctacagaactggatttgttccaataggtcacttatcctaatatgtttttatattacgtacaaaactctagtcctttttgtttgtttcagttttgttaagagtagtaaggagttatttccactgaaattattttaccagggacccggaacataaaatttaaaccgcatttcaaattctagaatttggactcgggtatatagtcatgagctgcctaacagtgtttgactcaatgatggactgcatatatgatggtggccatgagattataatggagctgaaaaattcctataacttatgacatcacagttgtcataacatcctagtgcaacgcactaccttttctatatttagatacccaaatacttaccattgtgttacagttgtctacagtatttggtgaagtaacatgtacaagtttgtagcctagcagcaataggctatatcgtatagcttaggtgtgtagtaggctctacgatctaggtttgtacgaatatactctataatgttcacataatgatgaaaacacctaaagacccatttctcagagtatatccccattgttaagtgatgtataactctatatcctcaaggatgcagattatcatgtaaataaacacattaggcataagattgagcttagggtctactaggaacttaaaagaaaaagcaatatatacacatcaagtaaattgagaacctaaaggttaaaaatgacaaggtttgcttgtaataaagaatgcataacgagccctgtgtcctgagtacgtggattcagcatctctgatcttcctttgcgctcttgacatgaggcttgtatatttagcttagtaattcatagcagctcattatttcttcatcttttacaacagaatgttttattgaaaggtcaaggtctaacataatttaaatttgcagtgcattccctattattttagcaattgacagctaagccagctatagcagagagtaaattctggactgtagaaatctctgtatttgcatttagcatgttgtgcctttgactattacatgtaatccagtgtcatacctaccagctgctggtggctgatttggttaatcttcagactgcacgtactgtggttttattctctctgatgaatgtaaatcaccctcttcacaagcaaatgcttaacatttctttgttgattttcttatagctagtttatatggttttatgatggactgatttttatttatttatttacaaattgaattaggggaaaacatctgtacttctctaagattcataccatgcccaattccaagggtttagagaaagtacagtactttcttcctatatttcctttattcacttatttaattggcaggccccagagcagcgtagctaagaacacagactctggagttgggtcatctggacttaagggcttggtccaccgaggaaatgttgctggagtcactcaactcctctgaaccctaggttttcttctccttagtagaatgaggatcataatgtatttgcttcatggaattattatagggactaactaataggatattgataaaggctttaacaccatatgtctgagagggagcatagtctaggttttttgtttgtttaataaatatatcatgggagggatgaacagcttcatttgtttacatctttagaagttccaagtaacaaataagcaagaaattattccagaatatcccttattttgggttgaggagcaatttaatgaaatatgaattttgggtgctgtttctgtgatttttttcttatgtaaattgttgacagtgacaacttactttagacttccatcgtcatctgtgtatcgtacggtactgcgaaattgtgacactctcagaacagcacagcttggcagatcatgcctgccagatgaccctcaaatgtgaccagtgttaccaaaggttcagtttctggtttagtttttactattttccgaattccagatcttaatttctgaataaacagctcacgttttagaaataattgatataaggatttttaatcgacatgtaatacacattcatagaatttatttctttggaagttaacaaaaatatagtgacactacaatgatatttttcctcctagccaagtatttttcctgaaaattatttttagatgatgtagtgtgcttgtgcacgtatgtggtgaaggatgggaggaatagtagggacccaggacacagggatggagaggaaagcagtatggaagggagacaaataactgataaggggagaggtggaatttttgtccaagagagcaagttagtttctcatacctcttttcctcctcctcctccccctccctcccctccctccatcacccaccccttccctccccttcccctccctttttttccttccttccttccttccttccctcccctccttctccttcttctcttcctccttctttctccttccccttcttcctcttcttctcctcctccttcctcttctccttcccctacttcctcttctcctccttctcctcctcctccctcttctcttcctccctcttctcctcctccctcttcttctcttctctcttcttttccttcctcttctcctcctccctcttctccttctccctcttctccctctccctcttctccttcttcctcttctccttgctcttctccttctcgctcttctccttcttctcctccctcttcttttttctcttcttcttcttctctttatctttctcctcctttttctgtctcttcctcctcctcctcctcttcttttttctctttggtttcttgctggcaacaatcttcccaacttacttacttatttatttgtttgtttgaaggagtctcgctctgttgcctaggctggagtgcagttacgcgatctcagctcactgcaacctctgcctcccagattcaagtgattctcctgcctcagcctcccgagtagctgggattacaggcacctgccaccacctctggttaatttttctttcgtatttttttttgtagagatggggtttcgccatcttggccaggctggtctcaaacccctggcctcaggtgatccacccgcctcagcctctcagaatgctgggattgcaggcgtgagccactgtgcctggccaatcttcccaagttctaaatgttgtgaatctttatgttcagtcctgggccatttcttctcagtgtgcaagctctctgaaggtattctcaccactccactccgtgacttaattaccacacaggtgctgatacctccccaaatatccatctctaccccagacatctgctctgagtgacggaattgtttgtcctatcattccattgacattttcccctggatgcatcagaagtgacctagacctatatagctttatgtcccctgtatttgcatttagggtgttgagtctttcaacatgccaggctattcatcctgctacacatgccaggaacctgggaatcacctttgactcttccctttgtttcattcctacttctagcccattatcaggtccccccaagtatacgtcactcttcctccatcctgcctttccacagcagtcagtctggtccaagccaccatcatctgtcacccagactaccatagccatctcctaactggtcctcccacttgccgtctttattctgcacacagcagcctgagttcatacacacacgtgcattcattcatattttgcttaaaactgttcaatggcttcccatggaacttggagtctgatatcttcacaagtgtgtgcatggcccagacaatctgacacccctcctgtttgtcatcatgccttgcaccactctttgccttgttccttatgttccagccctcatggtctcttcctgataatgagttaaactttttcctgcctcactattctgttccctttgcctggaaaattcttcatttcacccttaaaggatctcctccctactcatccctcaggccttcatttaaatatcacttccctgataagaatttcctcaccacttccttcacttcctttataacacctgatagtgtgtttataactcaccacaatttgtaatatcactttctgaggttatttaatatttgcctttccttctagaccaggggtgtccaatctttttgcttccctgggccacattggaagaattatcttgggccacacacaaaatacactaacactaatgatagctgatgaactaaaacacaaatcacaaaaagatctcataatgttttaggaaagtttatgaatttgtgttgggccacattcaaagccatcctgggctgtgggctggaaaagcttgttctagactgtaagctccatgaagccaggaactataattaaaaaaaaaaaaggttttattttttagagcagatttaggttctcagcaaagttaaaagaaagatacagagacttttcttatgccccctgtttccacaggcaactgccctcaacagagtggtacatttataacaattgataaacctacattgacacatcattatcacccaaagtccacagcatgattttttttttaaattcacaatcatgtacctagtcctcaaaaggtatccagcgcataacattctcagatgccaacttgcttagatattgcaaatgtacctcaaactttgtgacttttttataccttcaaatctcaggctcctttcagtgtccttctcttgttgtgttaagtgcccctcagaacacaactcagatatctgggagtcatcctggacacatcccttcccttcacccatggctttctattgatatgttaatctatcgacttctttattttcttccattattaatgttactatcaccacatcatcaactccaacatgattgccaccctatgctaacctagtctaagctaccattgtttcccacctgaaattataatatcctcccaacagatccaattgaaatacaccctagatactctcttttctattgtttttttttgcctttttaaaaattgtacaaatttacagggtacatgtgcaattttgttacatgcataaagtaacaaaagtcaagactttgagggtatccatcacccagttaatgtatattgcacccattacgtaatttctcatcatctactcccttccaatcccctcactcttccaagtctccatgaattgtcattctactctctatgtccatgtgtgcacatttttttaacacccacttgtgaatgagaacatgggtatttgcctttctgggtctagcttatttcagttaaaataatgaccccagttctaatcatgttgctacaaaatacatgatttcattcttctttactgctgaataatagtccattatgtatatatgccacattttctttatccattcatccattgatggacacttaggttccttccatttctttgctgatgtgaatagtgccgcaataaacatgcaagtgcagatgtctttttgatatatggatttcttttccttcgggtagatatccaatagtaggattactggatcgaatggtagttttatttttagttccttgacaagtttctatactattttttcatagaggctgtactaatttacattcccaccaacagtgcataagagttcccttttctctgcatcctcgccaacatctgtttttttgtttgtttgtttgcatttttaagaatagccattctgactggtgtaggatgacatcccacctgggttttagtttgcatttctctgatgattagtgatgttcagcattttctcatatacctgttagccatttgtatgtcttattttgaaaaatgtctattcatttcctttgcccagtttttaaggagactatttgatgcttttcttgttgttgaattgtttgtttcttgcatattctggatgaatgagtagtttgatgtcagatgaattctttgcaaatattttcttgcattctgcaggtagtctcttcactctgttgattctttctctcactgtgcagaagcttattagtttaaataggtcttgtttgtctatttttgtttttgttgcctgggtttttgacgtcttagtcataaattctttgcctagacaaatgttcagaagagttttccctagattttcttctagtatttttataattttgagtcttttgtttaagtcttaacccatcttgagttgatttttgtacatggtgagagataggggaccagttttactcttctgcatatggccatccagttttcccagcaacatgtattgaagagtgtatcctttctccaatgtatgctcttgttggctttgtgaaagccaacaaatatggctgtaagtatgtagctttatttctgggttctctattctgttccattgatctattcatctgtttttctaccagtaccatgctgtgttggttactatagccttataatagaatttgaagtcaggtaatatgatgcctccttttatttacccctcaggattgctttggctatttggactctttcttgttccatttgaattttaggattgtttttccctaattctgtgaaaaatgacattggcattttgatatgagttgcattgaatttatggattgctttgggcaatattgtcattttaacaatactgattcttcagatttttgatcatgggctgtttttgtgtttgtttgcatcatctataatttctttcatcattgttttatagtttctcttgtacagatcttgtacacctccttggttaaatatattttaattaggtattttaggtatttcaatgaggtattttaatttttatgtggatattgtaaataggattgcctccttgatttgtttcttagttagattgttactggtctatagatatgctaccaatttttgtacattgattttacatgctgcaactttactgaattccatttatcaaataagagttttttgtggcatctttaggttttccttgacataagatcaaattgtcagcaaacaaggataattagacttcattttttccagtttagatgccatttatttctttccattgcctaatttctctcactaggcctttcagtactgtaatgaataggagtggtaaaagtaaatatccttgttttgttccagttcttacagggaaagttttcaactttccccattcagcataatgttagctgtgagattgttgtatatggcctttattattttgaggtatgctccttctatcccttgtttatggagagttcttattatgaagcgatgctgaattttatcaaatgctttttctgcacctattgagatgctcatatggtatttgttgttggttcagtttttgcgacgtatcacatttattgatttgcagatgttgaaccatccttgtgtccctgataaaaacccacttaactcctgaaaacatgcagcctccctcccaagactgaaccaggaagaaattgaaaacctgaacagagcaataacaagtagcaagactgaatcagtggccaggtgcggtggctcatgcctgtaatcccagcactttgggaggccaaggtgggtggatcacttgaggtcaggagttccagaccagcctggccaacatggtgaaaccccaactttattaaaaatacaaaaattagctgggtgtgatggtgcacaccagtaatcccagctactcaaggaggctgaggcaggagaattgctttaacctgggagacagagtttgccataagccgggattgtgccactgcactctagcctaggtgacagagtgagactctgtctccaaaaaaaaggattgaatcagtaataaaaattgtcccaacaatgaaaagcccaggatcagatggatttacagatgaattatacctaacatacatagaactaatatcaatcctcctgaaactgtttcaaaaagtcaaggagcaggaaattctccctaaccgctctatgaagccagtatcaccctggtaccaaaaccagacaaaggcacaacaaaaaagaaaactacagaccaatatccctgattaacatagacacaacagtcctcaacaaaaataccagcaaacaaaatgcaatagcacctctagctattctgtactttgtagccagtgtgttcatttcaaacattaaggtgaccatgtcaatctttctatttaaaatcccttaatggggccaggcacggtgggtcacctgaggtcaggtgagcctgtaatctcagcactttgggaggccaaggcaggtggatcatctgaggtcaggagttcaagagcagcctggccaacatggtgaaaccctgtctctactaaaattataaaaattagccaagcgtcatggcaggtgcctgtaatcccagctgctcgggaggctgaggcaggagaattgcttgaacccaggaggcagaggttgcagcgagccgagatcatgctgctgcactccagcctgggtgacagagcgagactccatctcaaaaagaaaaaaaaaattaaatacataaaaaaaaataaaatccattaatggcttttcattgcttttaagttaaatatggtgctttaatttgccaaagtatcccaaaatctggggcctcccctctcaccagcctcattataagtgaggctgcccttgtactcttgcttgcagtcacactgacctttgtgttgcttgcctgtccacacattccattccaccacaagatcttccacacgtcctcttcttggaatgctcttttctttttttattatactttaagttttagggtacatgtgtacaacgtgcaggttaaatatgtatacatgtgccatgttggtgtgctgcacccattaactcgtcatttaacattagctatatctcctaatgctatccctccccgctccccctaccccacaacaggccccagggtgtgatgtggaatgctgttttctatgcctggctctcatcctttggatcagggctgtccaatcttctggcttccctgggccatagcagaaaaagaattgtcttgggccacacataaaatacactataatactaacaatagctgatgagctaaattttaaaaatcacacaaagaaatctcataatattttaagaaagtttatgaatttgtgttgggccacattcaaagagctgtcctaggccgcatgtagcccgcaggctgcgtgttggacaagcttgccagatctaaggtcaggttcacttctttcgaacatgttgtctgagttccttgactcaacaattttacttctataggtactcatcctttctgtactcccagtatagaagctttccctgtgtgtgggaattacatggttgcctctgtactccaccgaccatatgtttcatgacagcaggcatctcacttgatttttgttaccatttttcaaattttacttagagctcagtaaatattcatcaaatgaatgaattaataaataaatgataaatctcagtcagtaactgggtttttacataccaaatgcctacctacagggtgcctcacatttgcttcctaacagtctgtttacttttctgcagctatatagtttaagtactaaaatgctacattaccaatccctactgcttaatctagtagtaaatatttactgaatgcatgtaaggccaagaacctgctcccaactaatcctttcttgcttcccttattttgtgcttttctagcctttctatcagctttgcagttccaacttatagtgtgctgtttctctcaccacccttcagcagacttaaaaaaaaaatgagttaaacaatgttaaatcatcaaataaagtggttcaataaagatgatacagaaaccaaacacttcattcaaacaaagaacttgatatggttgtagtgttaataaatatattttaaatataatccattgctcccattttaaaacctcctaggattgggcaaagagtacttagatacaatatccaaaacatgacctattaaagaaaacagtccatccattggagttaattaaaagtaaaactttctgtacttcaaaagaagccattaagaaaatgaagagacaggccaccagctgggagagaatatttgtgaatcaagcacaattgtattaataggatttgtagtaaatcataccaatcctaacaaaggacttgtatccagaatatatatagaaatcttataactcaataataagaatacacaaaacctgatttaaaaattggcaaaacagctgggcatggtggctcacgcctataattccagcactttgggaggctgagttgggtggctcacttgaggtctgaagttagaaaccagcctggccaacatggtgaaactccatctctactaaaaatacaaaaaaagtagctgcacgtggtggcaggcgcctgtaatcccagctactagggagactgaggcaggagaattgcttgaacctgggaggaagtggttgccgtgagccgagattatgccactgtcctcctgcctgggtggcagagcaagattctgtctcaaaaaaaaaaaaggcaaaaattggcaaaatactttaccaaagaagatacacagatggctaataaagtgcaatcaaggatgttacacatcatcagtcagaaaaatacaaattaaaaccataagaagatactaccttacacacaataaaatggctataatttttgacagacataccaagtgttggtgaagctataggaaaactgaaacccacatgtattactgcaggcaatgtaaaatggtgccaccactttggaaaatagtttggaagtttcttaaaaagttaaacataaacttaccatagcctagcaattctactcctatgtatctactcaagagaaataaaagcttatgtccctgcaaagatttacacgtaaatgttcacagaagcattattcataagagccaaaaactggaaactgtgcaaatgttcatcaactaaggaatagataaaatgtgatccagtattacaatggcatattattcagcaataaaaggaaacaaactactgccacagactccaacatggatcaacctgaaaaactttatgccaggtggaaggagccaaacacagaagactccatattgtgtaattctattcctatgaaatgcccaaaacaggcatattgatagagacataaagtagcttaggggctgtctggaggtgagagtgagaaacgcctgcagcaggcatgggggacctcatgggctcgtggaaatggtgcaaagctagattgtgctgatagtcatgcaactctataaatttaataaaaatgaaaataatcagcctctaaaaagtacattttctacctgatgacttctaactttgctattctgcagaataacctttagcagctcctagtccattcacataagtgtaattccctcagcatagcatatgaggccctcacttaatgtcttaatcagggttcttgagataaacagaaccaacagggtgtatgtatgtgtgtgtgtgtatatatacatatatatatagacatatatgtatatacagatatatatagagagagattccttaaagaattggcagggtgctggcaaaattcccttttgctcagaaggtcagtctcttttttctgttgagacctttcactgattagttgaggcccagtcacattatggaaggtagtctgatttacttaaagtgcactatacttttttaaaaagtttagtatttaattttagaatcagagggtacatgtgcgtgtttgtaacataggtatattgctatgtacagagatacataggaatttacctatgtgcgttgttacataggtataatggtgggaatttagattctaatgaacccattacctaaatagtcaacattgtacttgacaggtaatttttcaacactagctcccctcctgctctccttgctttgaagtccctactatctattatttctgtctttatatctgtgtgtatccactttgcttggcccccacttacaagtgagagtatgaagtatttaattttcttttaaatgatgaggataatggcctccaactttatccatgttgctgcaagaaggacatgatttcattctttttcgtggctgtatagttttccatggtgtatatgtaccatattttctttttgcagtcaacagttgacagacacttaagttgattccgtgactttgctattgtaaatagtgccgcaatgaacatgtgagtgcaggtgttttttttgtttgtttgttttttgtttttttgacagagtcttgctctgttgcctaggttggagtgcagtggcatgatctcggctgactgaaacttctgcttcccaggttcaagcaattctcctgccacagcctcccaagtagctgggattacaggtgtccaccaccacgcctggctaatttttgtagttttagtagagacggggtttcaccatgttgttcaggctggtctcaaacgcgtgacctgataatgatttcttggacagatgcggtggctcactcctgtaatcccagcactgtgggaggccaaggccggtgaatcacctgaggtcagatgtttgagaccagcctggccaacatggtgcaaacccatctctactaaaaatacaaaaattagctgggtatggtggtgagcacctgtaacctcagctactttggagactggggcagtagaattgcttgaacccgggaggcggaggttgcagtgagccgagattgcaccattgcactccagcctgggtgacaagagcaaaactcctcaaaaaaaaaaaataataataataaatataatgatttcttttcctttgggtaggtatccagttgtgggattgcagggctgaatggtagttctatttttagtttttggagaaatattcatgctgtttcccaaaggggttgaactaatttatgttcctactaacagtgtataagctacatcctcacccacatcttttattttttgactttttaataataaccattctgactggtgtgagatggtatctcattgtggttttagtttacatttttctgatgattggtaattcagatcattttttaatgtgtttatttggctgcttgtatttcctcttttgagaaatgtctatttatgtccttttttctttcttttcttttcttttttttttcaggaccagagtctcactctgtagcccaggctggagtgcagtggtggatcataggtcactgcagccttgatttccgagactcaggcaaaatttctgcctcagcctttagagtagctggggccacagatgtgtgccaccatgcctgattaaactttgaattatgtgtagagacagagtctccctatgttacccagactggtcttgaactcctgggctcaagcagtcctcctgcctcggcctcccaaagtactggaattataggcatgaaccaccatgcctgaccctttggccggtttttaatacagttgtttgtttttttcctgttgagttgtttaagttctgtgtggattctggatattagtccttcattgggggcataatttgaagatactttctcccattctgtaggttgtctatttactctgtagattattttgctgtgcagatgctttttagtttgattaagtcccatttgtctatttttgtttttgatgcatttgcttctgggatctttatcataaactctacctaggccaatgtccagaagagttttttctaggttttcttctaggtcttacatttatatctttaatccatcttgagttaatttttgtacatggtgagagatagaggtgcaatttcattcttccgcatatggctagccattttttccagcaccatttattgaagaggttgtcatttctccagtgtttatttttgttaactttgtcaaagatcagttggttgtaggtatgtggctttatttttgggttctgtattccattccattgatctatgtgtctaattttgtaccattaccatgctgttatagttactatatccttatatataagtcaggcaatgtgatgcctctggatttgttcattttgcttaggattgccttggctattcggactcttttttgattccatgtgaactcaaagtgtagcaatttaaatgttaatctcacccaaaaacagcttcacagaaacatctggaataatgtttgactaaatgtgttggcactatgccccagccaagttgatacataaaattagccatcacacataatgagaaatatttatgaagcatatagtgcaccccaaacttaccccagtatttctttttacccttaacctatagtacacggtcagatcttaatactccagtcaacccttctctgcccctcccacacagacccacgatctcctgcttctgtaggttgtctgtcttattcacctacctgaaatatttgcctcttcatctctttatcctttattcccacatgtcttcatctttgaaatgtttaattatccttcttggaatatcttaaagatgcttctaaaacatgtaactttttaaaatgtggaaccctacttggttttattataattcttcagtcatcatcttttctcctatcagactgtaaacgctgtcaagagaaacatgtgcagtagtactcctgaaaatatcaaatggaaaactttagaaataaacaatgtataagttttagattgcatgccattttgagcagtgtgatgaaatctcacgccctgctactttgtcctgcccaggatgcgaatcatcgctttgtccccctggcccatgctgtataggctgcctacctgttagtcacttagcaaccatcttggttatcagcttgattgtcatgacactgtagtgcttttgttcaagtaacccttattttatttaataatggccccaatgcacaaaattaaagatgctggcaatttgaatatgtcaaagagaagccataaagtgcttcttttaagtgaaaaggtgaatattctcaacttaataagggaagaaaaatactgtatactgaagttgctaagatctataaaaacaacaattcttctgtctgtgaaattgtgagcagtatgttgttataatagttctattttctattagttactagttttaatcccttactgtgtctaattcatatgttaaattttagtatgtatcatagtatgtatggataggaaaaagtatagggtttggtactatctgtggggttcaggcatccactgggagtcctggaacatatcagccatggataagggaggactactgtactacagagtaccttagatatggtggtaactcaataaatatttatggacttatatatttatgcacatgtggtctattatgttcactgtccgtgtgagttgaattcatacttttctaggtagtttgcattgggaagaagattatgaggctgaattaattagttatgagaagattatagtattgatggcataaaacactggctctctctcagaagcccttaaggatgaattaactaattacattttctatggctcaggcttacttttgatgtcagtacaccatgtgactttgtctctcggtctggactcacattaactacattcctggcatgtcacactgaggtactgatttgcagtgataataactgtcttataatccaaaatattcatttttacagatcagcttgggaagacacattatcatcagaagatttcttggtgggcatgtgctcaaaggtttaattgcctgagtttatggtaaatcctaatattatgatcaatcttgagttctctcagagctgggttggacatccctctttgatacttttacagccttgtgattacctcattgccctgaagatactatcataattgcctgttgtctgtagcacagggccttgcacatgatagcactcagtagatatttactgaatgaataaataaaggaatggagggtgctggtaaaatcttcctgtcctctggatagtgtctgaataagtgtaatctatatttgttcctgtgagttcgttttttattttattgctgatcaatccctttcaacgtgcacattctttattcagcttattttgtaccttcaatcagctcttggtcttcccatagttttgcaatttaacgctagaaagataatttcatggggttattttaattttttcatatataacaaaatttaactgataattgtgtgtgtatagatggatagatacccatatgtataagcttatatgtatctgtctaaatggttaagcttatacatatagatacttgtctatatggaaatacatatatataatgtacgtatatgtatatacatataaccatcaacctatccacacattattaaaatattatagagataagtattatgggttttagataattcccacattcttactagaactgatcagaccttagaaattctgtaatcccaaaatattatgccgttatttcttactctatcaaggcaggagaaaccactcagtgccgtgggtactaaagacaaattgtctcaaaatgtctcctgtatatacgcatttctataaaaggtaaaacaataatatcatacacacacacacacacacacacacacacacacacacaccacgtatatctgctttagtaggtacatagactccccagcaggatatcgaagaattgttaacaattgatgcctttagaggaaggaaacagaattagaagaagttggagggagacttacttttcagtgtattcctttttgtgccatttcagttcgcagtgtcttatcccttactcagaaatgaataattagcaaatcagtaaatgttcctttcaccttaaaaacaagacttctgactgggcgcggtggctcacacctgtaatcccagcactttgggaggccgagatgggtggatcacgaggtcaggagatcgagaccatcctggctaacacggtgaaaccccgtctctactaaaaatacaaaaaattagccgggtgtggtggcgggcacctgtagtcctggctacttgggaggttgaggcaggagaatggcgtgaatccgggaggcggagcttgcagtgagccgagatcgcgccactgcactccagcctgggcgacagagcgagactccgtctcaaaaaaaaaaaaaaattgtgctttcaaggttgtatctcattgctactgctgctgtcttgggttattctggacatagagaagaaatgatcacacttatctctggttttgttttccaggactttgttggcattaggatgtcatgtgggtatatcagatgaacatgctgaagacaaggtgaaaaaaatgaagctacccaagaagtaagttgaatgactaagcaatattaaataatctgtgtagagatttagtgcaaccaaataactcttgatggacacacagatgccttgcttttactgaagctttaaaattcagattcaaggctgggtgcggtggctcacaccttaatcccagcactttgggaggccaaggcaggtggatcacctgaggtcaggagttcaagaccagcctggccaacatggtgaaaccctgtctccattaaaaatacaaaaattagctgggcgtggtggcaagtgcctgtaatcccagctactcgggaggctgagacaggagaatcgcttgaacttgggaggcagaggctgcagtgagtcaagatcgtgccactgcactccagcctgggcaacagagtgagactccatctcaaaaaaaaaaaaattcagattcaaaaatttaaactaactgaatgaccctaggggttacattaagtatctggtgaaacaatagtttctatcacattgctgagtgatgaaacaaagctcagaatatatttgggagtgtgttataaaaattgtgttattttcccagtgtgtgtttatatgttaacagaggtatccatatttctaaatgattacatatagctttctactttctgcccaaaaatctttataattttatttacttttacaataaaaatatattcgaggattaattatgaagtcagcattattatccacattttaagatgagaaaattgaggtagatagatgctgtagtactggtttggcctgctgttctatgacctatgtttgtgatcctggttcacttaagacctcacctttctcatctgcctgtgggcattagtaatacctacttaacagggaagttttaggtattaaagaaatattcaataaatgatagctgtttcatattactttcttatttatttaaacttaagtattcaagctgcttttctgatgtgcaggacttgtaagtagcaggcctgtagatgtattaaataatagcatcgagatataatcaaagtagccaccccataatctctatcagtcacctcaggcctcatgttaccccagaaaaacataaaatccaagtagaaattgtgcttttgctgtgcaaatgcagatttaagcaagtctctagttcaacagtctatgaacatttttactcaggtgctccataagtgagtttataaaaactgtattgttacctcgtgcagttttaggttctaaaatttttcttgaaaatttaaatagttccaaaagatgtgttttatgggtacattttgcatatttacatttcaaaatgacactttttcatcaactttgagtgtatcttatgagcacagaccacagtgttcagatatctgccatcatctgtgtaaaaatgatataaaaatgttgataatggagaattttacattatttcattttcctttttcaactgtattttcaaattatttctcctactgtatattatgctaataatcaatgttttatgcttggcagtctttgagtactctatcctacattataagtaagatatgtatctaaattgaatttttaattgtttttgttttctgcgatcatagtcattaagttaaaattttcctcctgagttatcattatattattttagtacacaggtgctcaaaacaacataaattgtttttaataaaaagtcatagaaaataggatgttattggaaatagctcatagtaagatggatttaggtattctttatccaattacattatgtattcacgtacaaataatatttattgatagagtcaagttggcagagtggttgcattcttcgttcacataaataatttttgttattaaaaagatcattgagttaagttaaccaaaaaccataattgtttattatgaaaaatcatatttaatgatttttttcagggtgacagctcaattatgcctttgttcagtttcttgaaagccaaaaattggaatctacctaacttccaaaagaattcattatcctctcattttcattatcctcatcctttccaaaccactctcaggttttttggaaagtatccaaaaaaggcattattaaggctaaaacagaacaaaaccaaaaaccaaaaaacaacaacctagtaattatacctgttactcttttactcagaagaataagaaagtagaaatgttaatttcacattatctttgacagcataatacatttaatcaattgtatcaaatgctatgcgtgagtgtgtgtgcatgtgtgtgtatgtatttgggatacaattcaacttatttcatgtatagattctatctgttataaaatctaattgataaaggcagttttcactgacaaaacaatcagctaaaacagaattatcttttgtcaaaaatatctggttgtatttttctgttgaaacaaatgggttaatacatgtccccatgacaatcatctcaattccaatttctaactttaagataggtagatgatagattgatagctagatgatagacagatagatggatggggcacagggtttaaaaataagtttgtctcattgaggaactaatgtcctctgccttgagtatttattaatgcatattccttgtgttgctctcacaacgcaacacagcaattatttgagagtgggtgaagatatggaaaagctgagacccttaaatgaaaactatacttggatctgctgacagtctatatactgtctctaaattttccatgagatatcattttattctttctctattgacaaaaatcttcataataactggtattgatatgtatgcagatcagcgcgagcctaaaatgttggggttttttaacaaccattttgcaagcaatttggcatcattgtgtaaaattgaacatttgcacgtcttggtacccaacagttccactcatagagatataccctagagacagttcgcaccgacgagcaggcaaactatcattcatagcaatgttatttggaatagctaaagaataagggggtagttataggaggtggaagaaatattcttcaataagaaaatgaatcaagttggctatagtctaataataaaatcacggaattataaatgacaccatagatgaacctaaaaaataataagggtgtaaaaaacattctacaagggtgatgcaatgtaaaaccatctttgaggctcaaaagcaagtaaaactaaaaaataaaaactaaatacatattttggagatacatacttcgataaggactgacttttaaaaatcaatgaaattataattctagatagtaattatctttggtataaatataggcagggatgtaagatggggagcaacacacagatagatgtaatgttagtaatgttctaattgttaacttcgtggtggattaatgaagttaattttattataatgctttgaagcatatacttttgtagttattttataatgattttttaaaataaaaatctgatgacagatgtaaatccagatacaccattagtcataacaaatgtacatggtttaaattctccatgtgcgtaacagaaattgtcagattggattcaaaaagataatttatgatatacagctataagaggtacatcaataactttagaacatagaaaagttgaaaatagtaagaatgacacactaggcaatactgctcaaaatgaaactgatgtactctccttttatcagtttctaaataaaattgaccttaaacaaaattaatattaagaaaagaaggccactatatggagaattgagaaaacaagcatcatgctataactactcatgtatacaccaagtaaaacagcttcaaaaatcaatgaagaaaaatactagtagattttcaaaaagaaatagacaaatatgcaatcacagtgatagacctaacacaaatctcagaaactgatatgtgtaacagataaatgttaacaaagattaataaaaatataaacacacaccaattaaaagcttgacatatatagagtgctgcatgcatgaaacatttataaaatttagtatcctttaggacattagacactgatatcgtaaagatcatatccactggatcacaaagaataacagcaaaaataacaaatcatgacacacttagacatttaaaaatatacttctaaataggttatggatcaagcatatcatctggaaaattatttacttatttaccactctgcctttgtttatttctagttaaaaagataacccatatttcttgatcttgctaaatgaacctatccttttttcatgcctttatactcttataaatggatgattcaaaaccagatttttaaaaagctttttaatattttggtttcatttattttattttttaggttgatgaatatgaattgcctatatttatggtataccacatgatactttgaaatatgtatatgctgtggaatggctaaaccaagccaattaatgtatttattacctcacataatccctttttattttgtgagaacacttaaaatcaaatctcttggcaagttcaatatataatacctcattattaactatattaaccatgctgtacaatagatctcttggatttatacatcatggaaattgtaaaacaataatggaaaaggaaaatatttcatattaaaacatgaattgcatatattaagtattacttggagaaagtaaaagaaaataaattataataagagcaatattaatgaatttggtgggggcgggatgaaatataaacaccaatgatgccaagagcctgttttaaaaacctactaagcaggggaaaaagactctgaaaagattgacaaaggaaaaagaaaaaacaattttgttagcaaacttaggaatattttgaaaaatgtaacaaatgtacattaaaactttctaaaggtaaaagtatggacaattgtatagaataatatcaaaactgatccaataagaaagaaaatacgaatagagctataactattaaaggaattgaatcaaacacacatacacacacacacacacacacacacacacacacacgtcccaaacaacttttctattgatttctaccaaatacaatctcacataaagaggaagaaacacttcacagtttattttctgatgatatgattttcatatcaaagcccagatcaagacagtatggaaaagggaagttatagtccattgctattatgagcatagatgcaaaaatgctaaggaacatactggcaaacaactcagtagtgtattaacaaagtataatatgaccaagctgagtttatcctagtagtgaaaagataggttaacattagaaaatgtatccattaaattgatgcttaataaagacgaaaattcatatgatcatcccaatgtatttagaaataaataattcataagatttttttatttataagcatataaactcttagaaggcaatactctgagagatttctttaacctaacaaggggcaacagaaaccaataatctataaggtaaaatctcaaatttttcctttaaggtttaggaatgagacaatataagtcactactacttgatgtattcaataaggccagtgcagtgagacaagaaaaaaatcatgaggcttggaaaggaaaaacaccaaattgtcatcaatagcaggtaatattgcatagaaaactcaggagaatttacagaattatttctaacaataataggacgcttgaccatttccttaaccttgctttatttctttttaagtgtgcttctgcacttgatgttatttatgtttcatgtcctctaatctgaaatatgcacttgctaaaggaaaaaaatctgtgcatcaaaagcatctgttaatcccagcactttgggaggccgaggcaggcggatcacaaggtcaggagattgagaccatcctggctaacacggtgtaaccccgtctctactaaaaaatacaaaaaattagccgggtggccgggcgtggtggctcacgcctgtaaccccagcactttgggaggccgaggcgggcggatcacgaggtcaggagatcgagaccatcctggctaacatggtgaaaccccgtctctaataaaaatacaaaaaaattagccgggcgtggtggcgggcgcctgtagtccctgctactggggagactgaggcaggagaatggcgtgaatccgggaggcggaggttgcagtgagccgcgatagtgccactgcactccagcccggacgacagagcgagattccgtctcaaaaaaaaaaaaaaaaaaaaaattagccgggcatggtggcaggcgcctgtagtcccagctactagggaggctgaggcaggagaatggcgtgaacccgggaggcggagcttgcagtgagccgagatcgcgccactgcactccagcctgggcgacagagcgagactccatctcaaaaaaaaaagacttgcagaacaatatcaagaactcctaaaaattaataaaaagatgcccaaatagaaaaatgagcaaaggatatgaacataattcataaaaaacccctgcagatccaataagcatatgaaagacactcaacttcagtactaatcaaggaaatgtaaattaaaatcacaatgaaaagctatttcacccccaccaagtgagaaaaaatggaagactatgtaaattagtacaaccactatggagatcaatttagcctaatcttataagacccatttcttttccagaaataaactttagagatacttttgtactcatgcaaaacaaacctgaaaagaatattcattgcagcatagattgcaatagcactgaattggaaacaatttaaatttccaccaaattcccatcaatccctatacagttgtttttttgtttgttttgttttgtttttagatggagtcttgctctgtcacccaggctggagtgcagtagcacaatcttggctcgctgcaacctccgcctcccgggttcaagcaattctcctgcctcagcctccctagtacaggcgcccgccaccacgcccagctaatttttgtattttttagtagagacgggatttcaccatgttggtcaggctggtcttgagctcctgacctcaggtgatccgcctgccttggcctcccaaattgctgggattacaggtgtgagccaccgtgcccggcctaaatatagtttttatagattcatctaatggcatactatagagcagttaaaatgaattaactatagctagatagattcaaaggacaaatctcaaaaatactccttagagccaaaaaacaaaaaaagcatgttaccaaaaagatgatacagtgtaatactgtttaaagtttaagaacataaaatataattctacagataattcatagagccagatatatggaagaacactataaaaatcatgtctaggaatagtcaacttcaaattcagagtaataattctctctggggataaggaggggattggaattgaggtgtaacagaaggagagcttcaagtgtattcactatttttgatacttttgcataggcctggaatttttcatagtaataacaaagaggtgattgataacagaaaccaggttttaatctacttaaaaaaaatgttggtggaaaagaggagataggaggaatataactagtctttaggaagttcaggccaggagcagtggcttacgcctgtaatcccagcactttgggaagtcgaggtgggcagatcatcagaggtcaggagttcgagaccagcctgggcaacatggtgaaaccccgtctctactaaaaataaaaaaaaaaaattagccaggcatggtggtgaacacctgtaatcccagccactcgggaggctgaggcaggagaattgcttgaacccaggaggcggaactttcagtgagccgagatcgtgccactgcactccagcctgggtgacagagcaagactctgtctcaaaaaaaaaaaaaaaaaaaaaaaaaaaaaaaaagggaagatggtattgatggtattcgtttcagaaggaaatggtgtttaaagaagtttttttttggccaggcctggtggctcacagctgtaatcccagcactttgggaggccaacgcaggcggatcacttgaggtcaggagttccagaccagcccggccaacatggtgaaaccctgtctctactaaaaatacaaaaattagctgggcgtggtggcacaacctgtaatcccggctacttggtaggctgagccaggaaaattgcttgaacctgagaggcggaggttgctgtgagccaagatcataccactgcactccagcctgggtgacagagtgagactccgtcacaataaaaaaaattaaaaaaaaataaaaatttgataaagcataggagacacatgagcatgtttatgtaaatagtgggaagaaaccagggggacgagttttaaaggagagaggtggtgattgagagcaaggtttcttatttccatccttgtcctggtgtcttgaattctacatttcaagggacttagtactgactggattagggagaacaagacataggcataacctagcggatgactttaaaggtccattcttctgaacattctgtatggatgcacaggccatataacctagatacaacctagatacactgataaaagtcatagattagaaattgtcttagctttccttaaaatgtattatttaagcaaaatataatgttcacaagaagattaattttgggttaaaatcttgataagaaccagtattgttttctaccaggtttacctctgtcatttctgagtttgactctcacttccccttgctgaaagcatgtatttcctgagtgccagggttttatatgacacacatatgcattttaagttgcttttgtgtaactattagaaatatggtcgattcctacacgcaacccttgggctatggtctatgaaagagcagtatcatagcagaataaccttttcatagcccacaatatttctactgctgtctcttttgcatatattttagagacattttgataatcggtcaagttcaatatatcaattggaattaaatgctatattccctattaaaaatagctaatttttgtactgtgcagccagtggagccggaaatcattatcctcaataaactaatgcaggaacagaaaaccaaacactgcatgttctcacttataagtgggagctcaacaatgagaacacatggacacagggagagggacaatacacactggagcctgtagggagtggggcatggggagggagagcattaggaaaaagagttaatgcatgctgggcttcacacgtagttgatgggttgataggtgcagcaaaccaccatggcacacgtttacctatgtaacctgcacatcctgcacatttaccccagaacttaataaaaataaaatgtttttttaaaatagccaatttttgtgtacatcttgcacatgtaccccagaacttagaaataattttttttaaatagccaatttctgatatataatagacataatttaatggaaaattcttaagaaattttgaagaatggatgattcgttgtagtttttttctttcctcctgtgcctctttttctccttcctctcaaaacaaacaagcaaacagtgaagagcacaacacattatcatctattcttaatttcacgcatcttccctcatttattgcagctaaactcttgacacactgcatagtttgatgagcctagagttaaattattatagcaataaagaaatacgcaactgaaaaacaatccactcactccaagagcttgtggtcctcactatctcatatgcctaattgagtgtttgagattgttcgaaaagctgtagatttaaatgaaaataaaatcctgtctgaatattaatggcattcatttaaactttcatttagcacttatctattatgaaatcaacacaaaacacagtaactcaaaggctgcttgagtgtttaaaagcctattagggctgagcacggtggctcatgcctgtaatcccaacagttgggaggccgaggcggtcagatcacctgaggtcaggggttcgagaccagcctggccaacatggtgaaactctgtctctactaaaaatacaaaaattagccacgcatggtggcaggtgcctgtaatcccagctacttgggaggctgaggcgggagaatcacttgagcctgggaggcagaagttgcagtgagctgagatcgcatcattgtaatccagcctggacaacaaaagtgaaactccgtttcaaaatattaaaaaaaaaaaaaaaagcatactaggatcatctgagaggtttctaaaactactgctaggttttctgctcttcccaacacagccttagccctaatgctgtgaagctactacatgtgacaggaaacaaggtgatatctctgaggcatagtagggcagataaaaggctgagaatgatatggttgatgcatgtgtgtgtgtatatatatatatatatatgtatgcacacacacacacacatttaaaatgactttctgaaatgaatgtattagatactgaatgtgtacccgtatgtatactgtttacatagacacaagcacatgtacaaaattcactttggtaaatatttacctcagtgaaaaatggtttagaaatacagttggatttttctgtaaagatgaggcactgtaattatgaagaaaagaaaaacccttagatactctttttgtgtgtagtgggtaaatttcacagaccagaaatttaaaaatgcaccaatgtgccgtgttcttcattttctctgattgggcctaatttaggatttaaatccaatgagccttgtagccagaatgcagcctgacagtgataaattaattctagtttgtttagggcactaattctagtttgcttagggcaaacataattatatcaatattttctgtgtctagtctcacctttaagtcttgattccaatgtcatcttctcaagtggtctccctcaacgtctttaaaattgtgctctatttaaaaacgtgcttcctcctatccccctttcctactttatttttcttcatagcatttaaatcttctaacatactatcatattatactttatttggtttcgtacttgattcctcattggaacattttcatgcgcgtccgtgtgaagagaccaccaaacaggctttgtgtgagcattaaagcttttaatcacctgggtgcaggtgggctgagtccgaaaagagagtcagcgaagggagataagggtggtgccattttataggatttgggtagataaaggaaaattacagtcaaaggggatttgttctctggtgggcaggagtgggggtcacaaggtgttcagtgggggagctttttgagccaggatgagccaggaaaaggactttcacaagataatgtcatcacttaagacaaggaccggccattttcacttcttttgtggtggaatgtcatcagttaaggcggggcagggcattttcacttcttttgtgattcttcagttacttcaggccacctgggcatataggtgcatgtcacaggggatgcgatggcttggcttaggctcagaggcctcacaaacataatttctataaaggtatacatttttgtctttatttatttatttatttatttatttatttatttatttatttatttattttgagacagagtttcactcttgttgcccaggctggagtgcgatggcgccatctcggctcaccgcaagctccgcctcccgggttcaagcgattctcctgcctcagcctcccaagcagctgggattggaggcatgcatcaccacacccagctaattttgtatttttagtagagatggggtttctccatgttggtcaggctggtctcaaactcccgaccttaggtgatccgcccgcctcagcctcccatgtattattagttcctagaatagcacctgaaagcattctactgctgaatgaatatttgacggtgaaattgaatacaagatttatgcccctcttattaccagggctgcttatgttctgggtactcacctgatagggaggtcttgttcagtcgttggccattctcatctgactttgctgtcttcgactgaattgtcttcattcatctctgctggcattttacaggatgtttgtgttctgcactgatttgatattgggttcacattgggtgccctcctcccctctgtgagtcactgttccttctcgtgcctcatccgggcctctttaggagtgctggaaagctaagaatgctctctctggccgcttggagattgcagcctattggtggagggagaaggaagggttgccacagccccatcagcctggaattagtttgtcaccatatctgtactgttcatgggtttggatctgtgaaattatgagaccctgccatttggctgagtacaatataggaagcaagatagaagctcactttggctctgcgatctatctggtcctcacttgggcagaaggctggggagaacttgcctcctctgactctcccctcctgtaggctctggaattttcagcctatcttagactggaggccctgggttctttatctgttcttttctgtcctaaggcataagggctttgttcctttggtattcaaaagcagagattttaatatcacaaggccctgctataaagatctttgtctctgcattgaatattcaaagacattttaaaatccaaaagccaagtatagcttttttttccctctctctctcttgaaatgcctccttcttgagagcagtggatacttcatggtcttgtttcaaaggggctgaggggtgtaggaagcccttcaagtaaaaaggagtttggggtcaggggagtagggcacatcttcatattacatgtttttatttaaaaacaaacaaaagtaaaaaagtagaagaaatataacccttgttttctcccttctggaaattaatccttctgtatttgttttctggagaatgattctgaatattctctatatgttttctgtgaaaatgtcagcctagtattcgtttctagtagatgtgctttcagcaaaacttgctcttaatgtctctggtgtgcagtcatctgagatttctcatttgttccaaggtacttgaagggctgatttggctttgaaatttacagctaacactccctgaacttggctgtagcctttacatatttactgtacatctttcacaatataatgatttccaagcttcatttaacttgatccatattaaacaagtaagcttgggaggtgggggtggcttaaaaaaaacaaaaggttggtgcttactgtttttggtattctgccttgtttttgttaaatcactttaattggccctttaattacattacactgagcccttgtttcaaagactcatctggaatacctgcttaggaaaaatgtgggtcagatgggaatgaagcacaaaactgagctgcaacttaacatgaaaattccccagtggagccaaacactgtcaattttttgtttatatctttggtgacttgatgcaaatagaatcgacagttggccaggatctttgttgttttgttttgttttcagaggtatttaaaaaaaattttgctatcgggaaagcaaagcctaaactgttaggtatttgattactctcaatgttgttgttttattcttttttattttattttattaaattatgtagttgccaaaataaaactaagagctaataactataaaagtattttgatactttgtaaagtgagcatattaaatcatttgtttaatttcatatatattcctcataagctaattttataggatgattgatggcacagagaatgtgcatgttaaagaaagggggtaaaagctacttatacctgttcagtaaataaattggaggagagaaaagtctgtcggctgattctggcagaagtttctcatgatgtttgagaaagtagaatgtaatacagagacatcttaatatgagctatatgttttttgtatgaatataataataataggagtttttcccattttggtggctataaaattttactttccaagagttattttagtattttttcttttatttactttaactttttggaaatcaatctgaaattttacttgaaagtgttcagtttctggttcatgtcaattacatttgattcaaaggctttgttcatttttaaccacaagaagataatcattcatattagcagttggttgtcctctgtgtacctaattaaattgtattaataaggtgaaatgaacattgtcaaactgtacttatttacttttaaatatatctcattttgatataacaatttgattcttagctcctttgtcagaatgtactacaaacagaaaattcgtttcataaattattgctgttaccattaattcatactggtgaaacattcatgatgtcaatagtgttatccattataattagttaaagtccatgaatttcatagatgttcatgtttatttttactgtacaaatgatttgttgttcaaaataggtggaaataaaaaggttcaggtgaagtgagagtttgtaactataatttggatgggattattagccatttaaaaaaacaattctaagcttcaaatcctttctcgtacaaggttatagaggaaagaaggttaaaaaagtgtagtttacatctgaagatgaatgtgaacaaattattgggctacttaaacagatgcaaatgcatctccataagttttcattgagatcacagattaaagcaattctagaagaaatctgtatgggaagaaaacaatgtagaaaataaagaggaatgattttgtcaatattatccagcttcgcacattagcataacttgtctataagtttttattgggaaagacctccttcccaccttccacctttcaaaagtacttcctcattccatgagatattgctagaaagtctaccattaaaaattggtttccagaaagtatcactcctctttgggaatgcatgtatccctcattagggtagcaatggctccgatcagtgattcacaggtggatatcgaaacttcatcatctgtgtggcctctgtggctgctagatgggatcaaggctgctgaaaagtgaaagaagattgtgtgctggcttgtgctgggtgaccatgggccagttgtggggagtgagaagtagttgtgaggaagcaaggaagtacagaagactgggctcttcatcatgtaccctgaggctgcctccagcaaactgttaaacttggaaattagactatgctagcttgattacctgttggtgcatttgaaatgcagtgggagctttttcttgaaaaataaaaaaaaaaaaaaatactttccaggccaggagtggtggctcatgcctgtaatcccagcaatttgggaggctgaggcaggaggactgcttgaggccaggggttgaagagcggcctgggcaacaaagtgagaccttgcctcaaaaaagaacaaaaataaaacccaaaaccataaatatataatatgtaaaatatatatattaatgttttgggttttttttaatttaaatacataaatatatctatatctatatattctaaaataaaagaaaatacttttcaaataagaacttatatcttcagctgtgattacagtttatagatttgcctatttaaatgtcagaagtctgtcgaatacaatgatttatagaagttgttaaaaaaaattcccacatggcttctttattaaaaaacaaaagctacagttaattgcccatacaaacagagtttttatttaaaatggaacaaaatttaatgtccataaatttaacttatgaatgtaaattgaatgacatagatcagtaatttgtcctaattgttataatctactcaaaacaaaacattggtaaagcttttgtctacagaaaaattacttttttgtgtctatagataaattacttttttgttgttgttgttgtttttttgagacagagtctcgccgtgtcacccaggccagagtgcagtggcacaatctcggctcactgcaacctctgcctcccagattcaagcgattctcatgcctcagcctccgaagtagctgtgattacagttgggtgccaccatgcccagctaattgttttgtattttttagtagagatggggttttgccatatcagccaggcttgtcttgaactcctgacctcaagcgatccacctgcctcggcctcccaaagtgctgggattatagaagtgagctaccaagcccagcctatacataaattacttacaatatatgggatgtattatagtaaaatagaagtaactaagctaaagccatctgtattcaaccttaaaaaagttatttattgctgtaatatattgattcattcaacaaatttttactgaatgcctaccatgtattggtcactattctaggtgctggggggtcactgtgaataaaatggacaaactccctgctttcaaggagcttgccttgtaatgatgccagtcatagcccagattagtagtctatttttaagagaatttgtagtttattttcaaaagcatatatatatatatatatatttatttatttatttatttatttatttagagatggagtcttgctctgtcacccaggctggagagcagtggcgtgatctctcctcactgcaatctctgcctcttgggtttaagcgattctcctgcctcagtctctcgaatagctgggattacaggcacccgccaccacaccttgctaatcattgtatttttaatagagactgggtttcaccatgttggccaggctggtctcgaactcctggcctcatgtgatccacccacgttggcctcccaaagtgctgggattacaggtgtgagccactgtgcccggccttttctcacatttatttttaaaagcattttctcatgttttaataattaattttgtaacttagcataattacctagtgaacgttcttgagttgaagatgcatttatgtttatattaatttggtaaatgaaattaattatttcaacaactgtatatgaaaaggctgttatctgctgggaactgttttaaggataatggcagttagaaaaatgaatcagaaacagatcctgacctcaaggtatagtcaataatggagaatacaacagtgacagaagaatggaagaaaagcagttataaaataggctttgtgccaatctcagtagttaaatagaatgaagcgctgtgtgtctgtgtggagcagggcagtactattgcccttatatgtgtgcattgaaaagttaatattttcaactttgtatttcttccaacgattacaacttatacctgttttattacgataataccttctctctccagcctagaatgtagaagcagtctctgctaagagatccttgaactctagggaaataaaatgcaatcagattttagatggttatatagctgtgattttctttactttctagtctctatcttatttagtcttcctaaataacgtaactaggaatgacagtaaggaaataagttacaaatgcatttaaatttccctgtggaataagaaataggtagtatctgaaggatacactgatttatgaaataaatattacattaatctaacatttaacaattgaagaaaaatgacttcacaggaagagaaatctctaaaatatttcaataaataaccaatattttgatttagactatacaaaagcctcagctattaggaacacaaacaatgacaggtccttttcatctctgagagacaggtaagttgtctcatttctgtcttattggtgtaaaaacaaaaacacaaagattatgtggcttttcattctgatcagttattagctaaagtgaaaggaacctaggcttgctgtctggtacttcaccactggttaccactgtggtttatggaagaacagtaatgaggtagggccagaaaatgatatttacagagatttttatgaaaaggccaattatacacaaatttctttgtctctgatttgtagttaccagctgacaagtggatacaagcctgcccctatggacctgagctttatcaaactcaccccatcacaagaagcaatggtggacaagttggcagaaaatgcacataatgtgtgggcgcgggatcgaatccggcagggctggacttatggcatccaacaggtacatgggaattagcatttggtctgagacttacttaagtgggaattagcataatttgtaacaggaaggattacataatgactattttaaaacttgtatcatatagatcacatatagtgcacatttggactaaaacagctgtttaatgctagactcaagaatttacatgaccttagttctggctgtgatcgtgaacacatgtgaggcacacaatgaataatactacactggtgacttataatatggttttgtggtatttctctctctgagactgtattttaggagaaacttttgaaatgtaagaagactgggataaagtgataataaaatgggttcaccatcccttattcacaacccctggggccacataaatttcagaattcagtctttttatttggttttcagaatggtgatttgaggatatattacatgtatatacataacaaccttggtagggcaagtgacttcaaattgcaattcattccgcacaagggaggcatggtcataccaaagaggggtaaaggccataaacagcctcgcatcagttcaggtttcaccactgagttactgttgcagatcattttgctctaggcatcagtagatattcaggtatttgggtattaaggtattcaggattaggtattcagtacaaatttgcctgaaagagggaaggaagaaaagacaagacaaaacagtatttctggctgggcggggtggctcacacttgtaatcccagcactttgggaggctaaggtgggaggactgcttgagcctgggagtttgagaccagcctgggcaacatagtgagagaccgtctctacaaaaaattaaaaaattagctgggcatggggcacatgcctgtagtcccagctactcagggggctgaggtgggaggatcacttgagcccaggaggttgaggctgcagtgagactctgtttcaaaacaacaacaaaaacaacaaaacaacaacaacacagtatttacagtatttattctctggtttaccagaacaacccctgtgtgattccatagctttcttttttttttttttttttttttttttttaactcttgggagatgtggtgggaacatccacagcctcccaattcctgcttatcttaaagtattgagaattgattatgcttcttgaaatgtggagacttgagcaaatactgcagcaggtctcaggaagtgaatggaaagaagtaatttccaaagtggcattgccctacacacttgtaggagtagatgcatctccccgatcccatggaattcagttctgtactctaatattaagcatccttttgccaagatagtaagatagcctgttcactctctctgtgtcaacacattttaaccacagtttaacattggagcctctcgtacaatagacaagttatgggtttcatagtcattttagtgcccctggcattgccgggtttcactggttggtggattcaacccaatgcatatttttcagttagggacatagaagggtggtccataacacgctggaattttttgaagaagggaaagcagccttaagttcttcattgcctgaaaaccactgagggagaaccagcactaatttggctgttcttggaataaaaccctgtccatgaactgtactcagaagttatatgttctctaagtttgtcctttgccatgtgaacgtggcagatggaagtggttagagatcactgaagttgttttttgttattgttgtttttccttctcatggagagggtctgctttccatagatgcgcttattcatttgattgaatcctgtatattgatagtgttttggtaactttgcagcctgggaagacgcatggattgtggaagggtcacgtttttctcatggaatttaaagtttgatgtatttggtagctacttatttctaaaagcccttggtattgctttgacggctgcaccctgtgttttcctgcaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatggtattttggttttactttcctcttcttcggttgcaagatgatgtagtagttctttaaagccaaataaatgaataaaagggggagtactggatagagtcctctagtctaggtgtggaatttcagccaagtggattttcttccctgaaaaacacctgagggattagacccatctctcagtgggatggctcaggatgctgatgattctttgggcggagaaaatgggcctgtcttcctcaagcctctgagatcagtaggtacctccctgattatgatattgggctcctcccctagcccaccagccctcctccagaacagctgatttttgctgatttggggaataagcttgtagtggaggctagtgttttacaaaatcccaccttcatcatttacacacacgtacaggcaacattgaattaattaatgtgatattctgctttaagggaaacacattacaatagatactcaataactaactatgtgttgaacacaatggatttttaaaggttctgcaaagaatacattttccttaaataatacctttgaagaatgtagtttaggccgggcatggtggctcacgcctgtaatcccagcagtttgggaggctgaggcaggcggatcacaaggtcaggagattgagaccatcctggctaacacagtgaaaccccatttctactaaaaaatacaaaaaaattagctgggcatggtggcggacacctgtagtcccagctactcgggaggctgaggcaggagaatggtgtgaacccgggaggcagagcttgcagtgagccgagatggcgccactgcactccagcctgggtgacagagcaagactccgtctcaaaaaaaaaaaaaaaaaaagaatgtagtttagaatgatccactctttaatccgttgctcctgcagtctgagttagtttaatacccattttcaaaaaattggcaaaaaacaaattacggttgtgtgcttcgtcacagggcctataatttttgatggaaagttttaaaaatgtattccaaatgtattctagtggctcatattttcagtgcattacctgtacataaaagtggatcttaaataataatgatagtttatatattcactgtgtaagtgtttctaagacttttacaattattatttaatcctcacagtaactcttatgaggatgatgcttgtattacgctcattttacagataaggaaactgagattcagggacttctgtgtcttcccatttaaagtggcaggtgtaggatcctaatcataggcatcctgacatattttagtcctttgaattgagtaaagacatacttggcatcttgacagatcttatcagttactggattcttatatttgctgcaaattaaatgacgtatctacttgttaacagtaatatccataatgctaacataatatctatcttgaggttagctttctaacaacagagatgtggtacacgcattatgaatcagttgctgttaggtgtgcagataccaagaagattcctgtctcaaagagtgtacagtccctgtaaccactgggaagaaagtaaacaataaaaggcttgtaagccaaaaaatggcaatcaaagagacttctgtaattctctgatatagaataaaccctcaaagctaattagttctatataattatgtttttaaattgaaatagaaattgttttaaaaacaatttaaaaaatagtttttaaattgaatagaaatttgtatacaataaaatgtacacatctgaagtgttcagtctggtaaattttgacagttgtagaaacaaaaggaaccactaccgaaaacacctccaatattttcttcattccagaaagtttgtgttcccaacaaagtaaccactttgtaagttctatcattacagattaatttatagcaaatagacatataaatgtaacctataaatgtagattttataatcattatcacgtgtattttttatatgtagtttcttttgttcatcatgatgcttttatgatcttgcatgttttatgtatatcacaaaatctattgctcagtggcattccttaaataataatagtaataatttactgtttgtttatccattctcctatagatggatgatgtgggttgtttccaattttaggtgattatgaataaggctgctatgaatattcatatacaaatcttggtatataattaatataattaatctttcatttctcttagactaaatatttaggagtataattaccgaggcatattttctaatttttgttggcctttttactgaattgtgtttctaaaagtatattttggatagaagaaccatgtcaggtatggaaggattttcttccgtttgtaagttgctttttcactttcttaatgaggtctttcaaagagcagacattcttaatttgaagtccatttatgatttttttcctttatagttgtgggttcctaggacatctttgcctatgcaaaaacaaaaatattgtctcttatgtttccttccagagttttattattctagcttttacttgtaggtgtgtgatctaaagtgagttagcttttgtgtatgatgtaagcttaagatcaaggttcatttgttgcacagatgaatatccaactgtcccagcaccatttgttggaacaattatccttaccaaattaaattaccttggcgtcttagtcaaaacctattgaacacataagtcagtctatttctggactgtatattctgttccattgatctttatgtctgtccttaagttaatattccattgtcttcatttttatcacatagtaaatttaaaatcaggtagggcaagtcttccaacttctttcatattttataaaggttttttgttcttcttttgcatttccatatacatttagattcaacttgttaatttgatttggatgggattacagttgaattcataggtcagtttgggaagaattgatattttagccatatttagtcgaccaattcatgaacatggtacatttgtccatttattttcatcctctttagtttctcttagcattgctttgcagttttcagactagaggtcttatacattatttgatttatctatatttttgatactattaaatgaaattagtttaaagttcatttcattttccaactgtacacgaatatgagatatataattgatatttacatattgatcttatatcctgtgatttggctaaatttatatgtcagttctatttttttgtaaattcagtgggattgtctatatacataatcatgaggtctgcaaaaactaaacctcactttttcttttacaattggtatagcttttttgcttcttgatttattgaactggtaaagaattcagaacactattgaatagaaatggtaagagagtttattctgccttatagggggaaagttgtgatgtttcaccattaagtatgatgttaagtatagctttttatagctgtcctttatcacattgaagagattcccttctgttcttagtttgtgggtgattttatcataaatagggtcatgaattttgtccagtgcttttttccccatttattgaacagattatgtatttttctcctgtattctgtggatatcatgactatcaagtgattttcaaatgttaaaccaactttctagttctaggataactctcttcagtcatgatgcattgtccttttttacacagagctgtattctatttgttaatattttgcttaggacttttgtagctaagtttatgggcaatacactggtatatatttttttcttataatgtctttgttagattttgatatcaatgtaaatctagcttcctaagtaggaaattttctcttctgttttctgaaagaatttgtgttaattctacattgtttctttttcaaatatttgatagaatttatcattgaaaccacgagcctagagttttatactataggaaaggtattttgttatgaattcaatgtatttgatagcttgagagctatttagattttctatttatttgtgtgtcaactttgataaattatgtttttctgtaaattagttcatttaatttaggttgccatatataggcataaaattgcactaatgtgctcttattattcttttaatgtctgtaggatctttaatgatatctctcttttcattcctggtaatgatagttgatgttttctctctttttatcttgatcacttctctaagggattaattgattttataaatcttttcaaaggttaattgaacttaaatgtacttttgttttggttaaactttcagacatttatttatttctccatatcaccaatcgtggattattatgagtgatctgctgtggttatgtgtgactatgtcttacattaccttaggaaagcatggcattattgagtaggactatggcatcctatggagaacgttaatgttcaatcacagtatcaagagatcctggtttcacagctttgaaatgacctattaaatgtactttctaatcaacaaatgtatatatcaggcatacaaatattcactaacattgccttatgataatatagtatttccaatagtgtttttgcatattttcaaatatttgattcaactactctctttaggcaaaagaagggtgtaataatcaaagagttcttgagcttccctctaactttataattctttaacatttgtgcatccctagaggatgtaggtagcagtgatgacagtcaatatatttttaggttggaaagatacttatataatgataaagataaaattttggggaaaaaactcacacctggttttatagtctgacacatcaaccatttgatttccccaggttttcattactttacacatgaatatttatattttggtatctatagtcttaatagagatataattacctgttttccttccgctcccccactctgcttaatatcaaacattttgaaagttacttactctacatttagaaggaactctgacaacattgctttcctgatactcactgaaaattgcaaagagagaatgcctaagtctggttgactcaattttaaacttatagataataacttaataataaatgtctaaagttatagataataactaaaaataagggaaaacactacagctcagagaatttataaccttgagtcttcaaggaaagagttaattatggtcagtatccaggaaaaggagtacagtttcccctgcacatagaaatatgcattgcaatgccagacagaaaaaaatcaatgatggttatattttaaagatattgtcacttaagggcataaactatattcagtgacacatgatacatttgcttttagagataactttactccagaatggtgccagataagtaaaatgttaagaagttattctgatgacatacagtgttttatactatttgtagctaatacgtattaataatttcatcttcgtaacaccgttgtggacaacatattgctaccttatgggtacctactttcttctgaattatgtgaattttaagaagaaagaaaaggagcttatatttataaaacatatgctccacttcattttacttccatatttgcaattctcatttccattttttaaaatattattattattattattattattattattattagttgagatagaatctcgctctgtcccccaggctggagtgcagtggtgcaatctcagttcactgcaacctctgcctccctggttcaggtgattttccctgcctcagcctcccgagtagctgggactacatgcgcctgccacgaggcccggctaatttttttttttttttgtatttttagtagaggcggggtttcaccatattggccaggctggtcttgaactcctgatgttgtgatccacccaccttggcctcccaaagtgctgggattacaggcatgagccactgcacctggccactctattttattttaacacatagatatggaacacctactgtgcctagttctgggaattcaaagatgaataagagtttttgtcttatgtagctctcagtgtagacagggaaaatagactaaattgctaccactaccatacaatgaaagtgttaagctgaagagtcataacacagggggtttaaatcagcttggtgatatgagggaaatctttaaagaggaggtatattagttatctattcctgtacagcaaactacccctttccctcccaccaaaaaaaaaaaaaaaaaaaaaaaaaaaaaccctctcagtggctaaaaataacaaaatttgttatctcaaagtttctgtgggttatgaatgtgagtgataggtggttctggatcatagtctctctgagattgctattaagttggccagggcttaagtcatctgaagacttcactggagctggagcactggatactaagacagctcacttgcataactgttggctaaagaactcgcttcctctctggctgttggcagaagacacagccagatgggtacagccttgccacacagagctcttcatagagatgctcgagtgccttcacatggaagctgacttcccccagaatgaaaaatcgaagagtgagtacaaggatgctgtaatgcttgttacaattacttctattatattctgtttgttagaagtgaaccactaaatgaagcccacactttttgaatggaggtgtactcaagtatttgtggacatattttaaaaccaccaaagtaggtacagctaagtcaatcgggttcatgcatttcaggcagagagaatagtatatgtaaaggcttagagacacaaggaggattgcaaatgggaatttcagagagctttgtacgaccagatgtagagtggagtttgaaaagtggcagtagatcaaatagaggaggcaggagttgaaacagtttttttttttttttaaattaaagaatgattctagtggctctttaggaaaaaggctgaatgtaaacaaaactggagatgaggacagcagtttggtgacaaaaaagaagtatagatgaggagtgttggagaccttgtctttggcaatactgtgaacagaaaaaattatttggcatttagaagtagaatcagcagaaggacaaaggaggcatctgagatagtttctggattgatagatgtcaagtacatacacactggttgggaacacaggaattggagcagatggacatggggtagtgggaagattctgagttttattgtaaacatcttcagtttgaggtgcatgtgagacaactcaacacatataccaggattcaattacatatataagtacaaacgtgagactattgctagagagaaacagagggttaaaaatttaattttttaaatgaaagaaatgtggacatttttacactaagggagagagagaggttgaaagtacagtaagaggagcttgatgagctgtggtctctgagaaggttgaagggaatgaaattcagagcatgggtaaagggattggcctcctgtaaaaggaacaacaacacttattcccctaaggttagtaggaaagaagtaaagattgaagacgctgcaaaaacctgtgtacagggaaaatcaggaggaagctgagggcagtctactgtataattattgtcttcaggttgaaatagaaaatgagtttattttcctaaggagtagaagttagggcaggctggactggattagaagccttgaagagagcagtaaagatgtgttgggtatagaattctcagctgacaattattttttcttttagtactcagatatatcatcccgctgccttctggcctttatgttttctgataaggcattgacattaatcttttggagggtcccttgtatgtgatgagttgcttctctcttgctgttttcaggattctctctctgtttttggatttgaacagtttgattatgatgtgtctagttttaatttctttgagtttatccccaaagtttactgtacttcttagatgtgtaaatgaatgtttttcatcaaatttgggaagcttctggccattatttattcattctttcttctcttttctgtctctccttacagtctgtgatttccattatgtgtatgttggtatggttgagtgtatcccccaggcctctgaagctctgcttgtctttcttcatttcttcttcagtttttcatacttgactaacggacttatcttcaagttcattgattcttgtcagtgcaaatctgttgttgagccctctgatgtatgtttaatttcaggtactgtgcttatcaactccagaaatttttattcttttttataatttacctctttattgatattcactatttggtgaagcatcatttttgtacttttttttttttttgagatggagttttgctcttgttgcccaggctggagtgcaatggcgtgatctcggctcactgcaaccttcacctcccaggttcaagtgactgtcctgcctcagcctcccaagtagctgggataataagaatactggcaaaaaattatgcaaatcaaatttttcatagttctggaaattaactaaaggctggccaaaatccagggagtgtttatttgattaaaatgtccaaatgttgctaagaacagcaactagtgatgttttaacttgctcctgccccatcaccctctctctaattctatggcatattgaaaaccaacggcccctcaatcatagtgaaaatcagccacccacaagccgctggagtgggcagaacagagttggaccaccaccatgcctggctaattttgtatttttagtagatatggggtttcactgtgttgatcaggctggtctcgaactcctgacctcaggtgatccacctgcctcggcctcccaaagtgctaggattacaggcatgagacgctgtgcccagcctcatacttttatttagttcattacacatggttttatttagttctttgaacagatttaaaatacctaacttaaagtctttgtctaataagcccaacatctcggcctcctgaggaataatttctattgactgctttttacccctttatgtatgggacatactgtcttgtctttttgcatgtctcacaatttttgtgaaaaattgaacatttaaagtaatgtaatttggtaactctgtattcgcccctatttcagattttgttgttgtgcttattgtcattgttgtttgctttcttggtaatttttctaaactagtttagtagagactgtgttgcctgtcatgtgtggccactgaagtctcagtttcattagcttcatggtcagctgatggtaggacagagacttctttaaatgcctaggactgataagtctcccagtctttaccaaaggagaggcaatgtaatgtgagcatattggcacatgccttcaacactcaaccaggcaatttataatttcacattagccttctcttactgcatgtgcagagcctcaaggtctttcagaggtgtaagctttctcaggtttttcctgaatacatgcacagccctgggcatgagcatggccttctagagtcccaggaatatgttggagcttctcacatcccactatggatatttcactccccagcttttcctttcaaactttttggtcagttgctgtttgcctcagctgttattgctgcctcacaaagctgcaaggctaacaaattgcctcagatgattttcaacaaatgtccttggagaaacaactatttgcactgggcaagctctaagtcaagtggaataaagacaagtcttaccgatggaattttccagaaaagggaacataatgacagttatctgggaactgggctttggaggaactccagctctgttctgcccactacaagggcttatgggtggctgattttcactatgattgagggtcctttggttttcaatatgctgtggaattagagagagggtgatgcagcaggagcaaattaaaacatcactagtttgctgttcttaccaacatttggacatttttatcaaataaacactccctggcttttgccagcctttagttaatttccagagctatgaaaaatttcatttgcatagttttttgccagtgttctcattaattctgtggagaagaggatttttggagattctttctctaccatttctactgatgtcactcagcaataaagattaaaaattgctgttttgtgggatggaacagagagcagactgcaaacagataaaaacattgtggagaaacattgatggtcccgttgaggttagagactctgagttagtggtgccaatctgttcggtgcatgtgttttctggcgaactcagcagagcaggtatagatgttgagagtgaaggtagtgaaattggacagtaattggggttaagagagcaagtaggggaaaagctaataagggcaagaaagtatggaaagttatatagggaagggaagaatgaaggaatctaatgagtttgaagagtgagtgtataagaaaatgagaaaacagggagaaaaaatggtgatcacacaatctctgtattttaagaatttagagatagagccactgacagttgtttgacaaggtttgattttaccgaagttatgtgaacagtgagcaatgagaatagagtggcatattctacagtagaagctgagattatgtttagtgtttactatgtgccaggatataacagcatgcttcatagtagggatgcaagtgatctgtatggaaaagacataagaagaaagattaattttccaatgggaggaatcagtaaagggagaaatatcttcagagttagatgttgaaaggatcaggaatcagtaaagggagaaaatgtcttcagaattagatgttgaaaggatcaaaatttcaacaagtagagattagtgtcagaaaggccatcgctactagaaagaaagtacatctgatgtgattaagtgtagaaagagttgaggaagggtagatggtccacttaggataaaatatagggtacagatgggcagagagaacagacatagatgaaggtagaaagattagggcaaaatatggaatatcttgcaaactcagctaagaaatgtggataaatttgtataaggagtaccagccccaggaagttttaaagcaagagcttgatgtgtgatcacagtttacaatagcaatataactacggcaacagtgggaagggacagattggagggggcagtgcttggaggtagaccagttgggaggctttagaaaaattgtttttttgaacaaggatggtgggaataaaaattaaaagatagatgttgagagattttatagcataaagcaaaatcagtctgattatcactaagaggagattcaaaacattcatttataatagtctatactgctgttgctgacatttaaaaaaaagtcaagggcataaaaagtttaataaaattgaatcaagccttatgtaattaatcagaattataatttattttctcttaggagaatgcttacatattccagataaaacatgaactctgtatttgagttgtagtatctttggagtactgttgtcaataatattttaaagcatttgaaaatggaatttattcttatttactacaaggtttaatcaagatttgaattgttttatccaaaataataccagaaggttgaaaggatggctgattaataccaataattttaaaaagtattatcattagacctaaaagattctagatatgtataaaattttagcttttccttatagcttcttgtaacttaagattttaatgtatagttagatcttgactgccctctagtggcatatattttcttagctatattgtttggagagcagagtgtatggttactttaggcctttttaggccctagttaggtgattggtggtgtgtcatgcctgggaggtacggggagcacagtctttgctcagtccttggccttaatcttgaggtagttcattaataatataattcctgaattgtttctgctttgaataccaacagacttgataatgtatgacaggaatatgtctcccaactattcatttttaaatgtccattattattatattcattataacagtataaaaatcacttatataacatacttacatgagttataattgcctatcaaacacataaatatatcgtgtttaaaatcgagcaaagcataaggatgttcgggggagagttctgtgcctttgacaggatgctacccattagctatttgtctgggctgctatatccggagcccggaagagtcttcgtttctagatacagtttggcaggtatatatggagcacttactttgtggctcaggtgcttgatactacaaggtatgcaaaataagtttgttacggattgcttggatctttttaaaaaactcctacaaacccagatttcactttgtattagtattttagcaagaggtataatgttgaactgttgcttctttaaaacgtagttgcaaactaccctaaactaacttaataaatatatactatggggcagggcacagtggctcacacctgtaatcccagcactttgggaggctgaggctggtggatcacctgaggctcgaagttcgagaccagcgtgacaatggtgaaaccccgtctctactgaaaatacaaaaaaattagctgggcttggatggtggcacatgcctgtaaccccagctactcaggaagccgaggcaggggaattgcttgaacccaggaggcggaagttgcaatgagctgagatggtgccatcgcactccagcctgggcaacaagagcaaaactccatctcaaaaaaaaaaaaacacaaacaaataggaaaatccacagagattaaaaaagaaaaagaagagtccttttttttttgtgaagtcccttgcatgatagtatctgtgaaccacatgtttgtttcaaattcaggttaagtatcatcaatgagcataagaatagcatagcattagggccaggaagaagaatattaggactcagaaactctgcattgtttctactgcaatatattctccatgtagtaccccctattttcattccctatagtaataaaggggattagtggtatgttttaattccaagagaattgtgtagggggcttttggggaaattattacatttttataccgaatttgccttctaaaatatttgatttgtgctaatattaaaattagtttgcattacttgagtgcactatacatatttgtgaagtcttgatatattagaaaccaaacacagaaaagagaacctggtatttttcagtagtttagttttccaaaaaaactgtagtatagttttcatggtatataatgactatagtatatactaattctatatttagaaaattaggagttacatctattaatgcatactagaatgtaatgtaatattttatttgcaaatatcaacataattaaaaataaggataactacctgatcattttttcttccctgaaaataatctccaaatttttgtgtaatttatagctcatatttatctcttagattcatttagggaagattacaggcatgttttaaggaaacaatttatcggtaatctgttttttgaggaaatactaactctgagtaaaaatttgactttcctgtttgtttagtattgcagcactgagaacgagtttctttctttctttctttttttaaacacagagtcttgctctgttgcccaggctagagtgtagtggcatggtatcggctcactgcatcctctgcttcccgggctcaagcagttctcctgctcagcctcccaagtagctgggattacaggcatatgccaccaggccctgatgatttttgtattttttgtagagatgggatttcaccatgttggccagactggtctcgaattcctgacctcaagtgatttgcctgcctcagcctcccacagtgttgggataacaggtgtgagccaccgcgacccgccaagaactagtttcttaatagcacaaactacctttaaatatcataaaatctgatagaatttttttctctcaaaacaacgtttacgatcctatttttcaaaatatatttacttaccaagtaataggcatgagaatttacccttaaccatagaaatgtttctctgattcagagacttaagctagtttctgaagggttagccagcagattcagttagttctacattcagtaagcactaccaccattatcaaaaaagcagttattgatcgtttcattaattaagcccatgtgatagggagccatctcatgctacagccatggtgtctccactgctttacttcatctcattttaaattgttacatatgacctagctgtatgtttattggcaacctttagtgcttatatagattatttttatagttctaatttgatcataccaagtcattgattgaactgttattaaatttttattatgcataaagtctttcccaaatcttaaggagaaacaaataggaacttccttcttctcttttcttttctttctttctttttctttctttctttctttctttctttttctttctttctttctctttctttctttctttctttctttctttctttctttctttctttctttctttctttctttctttcttttgtctttctttctttctctctctctctttctttctctttgtttgtttgttttgttttgagacaggatctcactctatcacccaggctggaatgcagtagaacgaccatagctcactgcaacctcgaccttctaggctcaagtgatccttctgtatcagcctcttgagaagcttggacttacaggcatgcactaccatgtctggctgaatttttaaactctttgtagagacagggtaccactatgttgcccgggcgcgatcctcccgccttggccttccaaagtgttgagactacagctgtgagccaccacacctggctgaaaactagcatttaaccagtaactagtaactctgtgcgagctattggaggcaaagtaggaagaagaggggctataacatgaagcagctcccaagttccaccatttttagttgtgcgatgttggtcaagtctgaaatttcctcctctgcatctaactcagatgttagctgggtgaccaccttctttgagatatcaattcaatgaacactcattcctctcctctgtggtttcagaaggacttaccttctcatcgtcgttctggctctgggttcctcattctgagacttccccctctcgtctctctcaatctcacctgcatctcatttcctagggatacttttcccccttttgcatcacactggtcctaatgttggatgctgacctttttatttttcccccagatcttttaaatacagcatttgtatgtatagcagatcacagtgaagatgtatgcgagaatggaaaaattttgcatcacatttgagttccttagccatcaccatcctgtagggaaatttttactattgatgctattgttacttttctccactgtttacaactttcccttatttctgtttctcttctcttccttgcttcgtcttccctcttctctctcacccgtacatgtctactcatttcttatgcagagcagttcggatcttttttcttattgacttctttccatctcatcctccacaaccaaagcaccaaggcacttgggttttgttctacagaaaggtcgttccctcctgaaaatgaggctgacggagactcattccccagtctctccagcgcaagccctggtgctttccacttcacccagctggtctgacagtggctgatcctagatcagaaagcacttggtaaaatgggaaagaagataagaaggtatcattatcatcatcgctctaggttgaattactaaagtcgtgatttatctttccttcttttatttatgatatctttccttctctttcacctccccatccaatgaccaccagaaatctctgtccatttcccagcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggtgagtggactttgtcctgtgccagtcatctgtacgtgctggaggctcatctcctctgctgttcctcttggtagcttcacagtaccagtgtttcccacagcacaaacgtggaaaaatatttcacaggaaagcttttgtcctcgtagtctcaaaacccttccctacaacccatgaatgcagtgaaattcaccaagtaagacattgcttttccatggttatcaaaaagataaatcatctttgtctatcaaaatgttaaagatacatatgtagaggaaaaatgcatatacattgacgcagcgattccgtatcaggagtttatctttaagctataattagtggtttgtatgaacatttaatagctacaatgcttaatgtagtgttgtttataatcacaaacggttttcattttcaacattattggtaatttctattaagttggatggaagctggtcaggtgtttattttgttatttatatactaataaatgtttaaagattcttttacatgtgtaaaatattttgatcagtaatatgggcgaggtgcctgtaatcccagcactttgagaggctgagatggagggatcacttggggctaggagtgcaagaccagcctgggcaacaaagtaagatcctgtctctacaaaaaaaaaaaaaaaaaaattaaaattagccaagcatggtggtgtgcacttgtggtcccagctacatacgaggctgaggtgagaggattgcttgagctcgggaggtcgaggctgcaatgagccatgatcacaccactgcactccagcctgggcaacagagtgagaccttgtctcaaaacaaacaaaaaaataataataacaacaaggtatatatgcttatagccacaataggataataatagtcacttttgattggtaaaatcatagatttttttaaagtcttcttttttttttattttttaagtgaatttattttccttttcacatgagggggaaaaagctactttttaaccaagaaaaataaaattagaataaataagcaatcatgaagagatttgacgtttggatatttcttggagtgaaatgtcctgtgtaggaaagcatttctaggcttgaaattagggcagttgacccacttagttttgaaacatcacatttcctgaatccagttttttaaaaatttcaaatagaaaaatttaacacttttttggggggttggggggcggtcaaaattagcaaactttaaacttcaaaaaataaaataacagataaaaggcagctttaggtttatacctcctgaagatcagatgtaatgaaccagagtgggaagtaacctgaggaagttaaaataacctttactcccagtcaaatgataggcaagaaaggatactcccgatttgggaacaggcatggggtgggtggggtaggaaggagaacaccacagccaggtaagtcggttgggcattttatgccttttgatacctgatgtaaacttttttaaaaagacagtgtgttatattaagaagaattatgtcattgctttgcattggcgactctgtctggtaacgtaccgattcacaatgaaggtgaggtttaagaaaaagtcaaaagatttatctgaaaaaaaaattcacataactcaggtgtgcttatgaatcaacggaatatacttgtagatgcaaaagtcacgtttatcaaaactatgtttcaaatgtacttacaatatgagatttcactttatgtatatatataaaaaggttggcatctatattcaatttttggcttgttacttcagcagatatcctaaggatatttttaggtttgatttgaagcttttttacttttagtatgtaactgaaatgcttctagatttccattttgttaaagtatctgtgccatcggttctaaggaatgaaatttcattttgaaatagatgaaaattacactatcattttcaatgacagatgcccagcttgattccctagctcataattatttgtatttgtgggagtagagaaaaacaaaccgtattctgggaaacattcattgtcgcagaaaaatgatatattctaaaggcatataagttttctttcagtagaaagtatgtgaggttcgatttttaaaataataagctctcaaaatcatgacatagattttggatttttttcccaagattcgataatataccatgttaatattaggtagggatttagaattcccagacagctccattttgcttaggacattgcagtagaccgatatgccagctggagtttctcctactgttgtgttgatagaagggactgctgttaggtcgtgacagagtggtgggtgggtgcgattttcctggcttagtctgtgacaagggacttttctgtcctctgtataggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggtaagtctactatgttttgtgttttttttaagtttgcagcacaaggaagctttcatcctgaggcttcctaaccgggcgtttctgtttcagggtgagtgagcagatgagttgcagctgtaaatcgtgagggtgccttgtgactgacttgatcagatgcccttgaaataacattattagaaatgctatctatacgacttagctaggatttctagaaggctgaaatggcttttatgagtatgaataagaaaataaatagcagataaaagaataggtttccatcattgttaaattttcatttagaacttccctgcttcatcagctgcctagagcctctttctgtttattcatctcataaaagtgaaatgaggacccacaatggatcaggtactttgctggatgctgaggtgacaaagatgaatgaaacactgtcctatctttgtatagattacagattacctgccaggggaggttgacacttgtacagtttctgtttagtggctaagttctaagacagaaaaatgcagaaagctctgtggaagcaccatgcagggagcacgtgctgctgcctgtggggccccgagatggcctttgagcagagttgtaaagatggagggtgggccgggttcagtggctcaagcctgtaatcccagcactttgggaggccgaggtggatggatcacaaggtcaggagttcgagaccagcctgaccaacatagtgaaaccccatgtctactaaaaaatacaaaaaattagctgggcatggtggcatgcacctgtaatcccagctatttgagaggctgaggcaggagaattgctcgaacccaggaggcagaggttgcagtgagcagagatcacgccatggcactccagcctgggcaacagtgcaagactgcatctcaaaaaaaaaaaaaaagatggaaggtgttggtgaagcaaggaagacatttactcttcagacatgcactcccaatttggtggccttggccacacagggctgtttatatttaagttagtttgaatttttttttttttttttgagtcagagttttgctcttgtcgcccgggctggagttcagtggcgcaatctcagctcactacaacctctgcctcctggattcaagtgattctcctgcctcagcttcccaagtagctgggattacaggtgcttaccaccatgcccagctaatttttgtatttttagtagagacggggtttcaccttgttggccaggctggtctcgaattgctgacctcaggtgatccacccacctcagtcctccaaagtgctgagattacaggcctgagccaccatgcccggcctaaattttaaaaagttaagaattgagtttcttagtcacattggccaccatttaaagggctcaattccctcaggtggttagggatgcccctgctggacagtgcaggtagcgaatatttctctcatcacagaaagttctattggatagtgttactctagagcatataaacaagacagtatctgatacaaattatataattatcttatttcagccaggcatggtgattcatgcctgtaatcccagcactttgggaagctaaggcggaggatagctgagcccaggagtttgcgaccagcctgggcaacatagcaagactctgtttctacaaaaattaaaaaaattagccagttgtggtggcatgttcctgtagctccagctgctcaggtggctgaggtgggaggatcactcgagtccagggaggtcgagactgcagtgagctgtgattgtgccactgtactccagcctgggtgacagagtgagaccttgtctcaaaataataataataaccttatttcaaagataagccaacacttcttttcaaaatggcttttgaatatatcctgttatatgtttgcatatggatttgcatataaaaatgtatatatatttgcatatatatagtcttggattttaagatacatacctacctcaaccagtatttctttttcttttcttttcttttttttttttttttaagacagagtttcactcttgttgcccaggctggagtgcaatggcgcgatcttgactcactgcaacctccgcctcccaggttcaagcaattctcctgcctcagcctcccaagtagctgggattacaggggtgtgccaacacgcctcgctaatttttgtatttttagtagagacggggttttatcatgttggtgaggctggtctcgaactcctgacctcaggtgatccacccgcctcggcctcccaaagtgctgggaatataggcgtgagccactgcaccaggcctatttctaatagtctatataaatttgtcactgatcttcaaaatgttagccagtttgttgcttgtatgaagttttatattcattcatttagctagcttttgagcaggtatgaacatcatttccctaacacagatttgcaaagataataggaattttacatttgtgtaactcaatatctatgtttaaaatttttaatttttactttttggagatacatggtaagtctaatatgtatgaggtacatgagaagttttgatacaggcatgcaatgggtagtaattgcatcatggaaaatggggtatccatcccctcaagcattaatcctttgtgttacaaacaatccaattatacttctagttattttaaaatgtatgattgaattactactgaccatagtcaccctgttgtgctatcaaatattaggtcttattcattttttctaactatttttatacccttaatatctattttgaacacttatctccgggtggtgaaattagtgctctaaccctcccctacctgtctccctttctctgatattggttttagggatgtcaaagtattagtgggaaggtaggaggaaggctttttattggtgttatctatctgtctacactggctgctactatggatgtgacttaggtttcatttttttaattggctttttaaaaaatacttgactgctgtgcttcctttctttggatgttaaaaaaaatttaaatgcatgtgtgagttctgtttgtatggtacgtggttcacatgatacacacagatttgcagaatgctcatccgtactatttaagcacgtaacaaatgttcatggtaccacacagtcacatagaccaatcaccattgcaataatgagatagactctgaagtgtgtcaccgtggcacatggttttgaacaattttggcttttgactttgtatttcatagaatttttaaaatttaaaaactgacttgaactttgtattggtatctctatcatagagttaacacaggattttgatgaattgtctgaaattttgtggttgaggttgctgggcttttattagaggttttgggaggacctgcgttttggtcttcaaggcaggttataagctttatgtagcaataatcattaagtagtaactttgtaggggtcagtcatgaatctaaattttctactatagaaaggctttcagagtttatccatgcctatgatttttgaatgctttttggtactggaatatctcttccccatccctcctctcccaaattgactttatatagcttcccaaaaaagctccttaatttacctgtcactactgggagctagcattgaggtagctagagctcaaaggatccagtttgaaaaactatttatttagggttttctagcacagaaacatactatggttgctaaagtactaaaatggatttataagtggtctattttaaatttttcttacacctagcctgtctttatgtctgtatcatgttcgatttgccatttttaactatcttcataatctcttcttattgctacagagaaagctcagtcatttatacactgactattaaagtatgtggtaagatggataaatgtagaaattattatctatggagatatacacatacacacacacacacacacacacacacgcatacatatgtatatgtgtgtatgcgcacacatacacacagacacatgctgtagatccctgtctggtcagcttagtagacaacatggccaagtatattttgacctttctatctattgcatagtttatacaactgaaatgatttgctgaccagtataagttgtttctatataccgtcaaaaagaaaatcacaaacatctttgaaagactgatatggccatccagttaaatccaggggggagctatggctatcccagttctggaagaggatagggttgttctataaaggtactgctaggaacaaccctatcctcttccagaactagatggcggatcacaagatcaggagatcaagaccatcctggctaacacggtgaaaccctgtctctactaaaaatacaaaaaattagcccagcgtggtggcgggcacttgtagttccagctactcgggaggctgaggcaggagaattgcttgaacctgggaggtggaggttgcagtgagctgagatcacgccacctcactccagcctggtgacagaggagtgagactccgtctgaaaaaaaatgaaaataaaaagatgctgttaggtctcttctaaggggctgcagacctcttcctcaaatagggactgcagcagccctcaggaaactcatctgttaactggataaaaaccaaatgacagaaacactggtctctggtagaaggagcaaggctctcattccctcaactcctcctcaaaaccacgcttacatggtcaagatcaagagcattgttgaactagagtgaaattccactagaatttcagggtttaaaggccgcattgtctatgtggcagatcctctgttaggattctcccttctctttggctttttaaaaatctcttcagagtatctttggggaaggcaaaaggattccttcaatcatcacttttaaaagaccccttggactgtaatgtcacaaaggaatagtgaggggcatgtgtggaagcagtttttagatgagcttaagtttttccatgaattcttgtctcttctcaccattggactgataaccattcaaaatcaggattggggaagcccagggaaagaggttgcagtgttcactcttatggacagaatcccaagattgcttctaggaatctttctctgtggtgttcacaccattttatataaccctctcctcttgagtgtcagcagaacttgtgaatatgatgggatatcactcatgattaggtcactaaatcagtttactttgagttagtcaaatagagattatacaggtgggcctgacccaaccagatgagcccttagggattgggtccttcctgaagtcagagagatacaaaatatgagataaattttcctgctggacttgaagaagcagactgctgtggtatggagagagcaacatgatggtaacctgcaggctgcttctgagaactgagaacagccccaagttcatagctggcaaaaaaacaaacaaaaaccgagaaatctcagttctacagcccaaggaaccaaattccatcaataaccagggagcttggaagatgactccaaccctcagatgagaatgtagcccacgttaccatcttgattatatccttgtgaaaccctgagcagagaacccagccctaccatgctggacctctgacctacagaactatgagataagaaatgagtattgctttaaatggctaagtttgtggtagtgtgttccatagcaatagaaaaccggtatgttgatcaaggggctttcttaggttcaaccgaaccttcagactcacaagactatcaaagaccacccatgacaccagtctgtttagagagagaacaggaatcatggcttgccagcagggcagtcccaaggattcctcttccaacaggagtgtttttagatgtacgtataattctctgagttcatacgcggttacctcatcagaagccatttttattataagccatgctgcctaataacttagttgacacttcagcttttacccacagaggtatagtagctaatcaagctgtgatactcctccataccaagaacctaggaggagctctcctgacacatctatggtctactgcattttaccaaaaccagagattattccacatcatgttttgggaccaaggctttttatattaaagccatgatttttatatggagcatccctttatgtacacattcctcaagagcctagtggaggtgatcctcatcacattagttgggggacaagaacaagggtaatagaggcctgagatctctcttctttccccccacccccggcgtacctatataaatttccatccatcttaccacataattattttcattactagccaatgtaacaataagaaggaattatgaagatggcaaaacatgccatatcaagcatgacacagacacagagacagggtagttatatgagaaatgtaattacagagcacttataaaacctttcagtactttagcaaccacaacttattgctgtgctaaaagattttttctaaattgtttttcaaacttgtaatatgacaagaaaaagaaattggagatgataagaattggagtaaaagggacgaatttatcatcattcgaagacaatataagtatttacagagaaaaccctaaagaatctatacacattactaggaacaattggagtgtttcacaaggtagaatttctattctagcagcagttaagaaaagtaaattaaagataccatttacagtagcatcagagactagcagtagctaggtatctctctaacagaaggtatataatacctttactgagaaaattattaaaacttattgagagatggttgactttattaaaagacttattaccaaataaatgagaggtgtgttatgttcatggagaagacaaaagcctgaagatattaattcttccaaaagtgatctatagcttcaatccgtcgatcagacttttcaaataaaaatcccaacaagtgtttttatggaagtcgatgtgatgactctaaaatgtatatggaattgtaaagggctaaaatatcttctgtctaaaagcagtgaggggatgcatgtcctaccagatagcaggatttattgtgaagctatagtcattaaaatagagtggtattgttgtagggatagacaaattgacaaatggcataaagtagagatgccagaaacatagaactgatatagaaacagatgccatagaacatgatgaggtagtgtgtcagtatgttggagaaaagaggcctgtgacaaatggggatctgtagtgaaaatatgagatggtcacttcttcacaccctatatgataacgaactccaaatggtcttaaatgtcaacagcaaaactttgaaaccactggtggagtatatagacaaatttaagaacattcatttaaaaaaatgaatgttctgcttccttaaaggaagcagaaaaacagtcaggtattaatggggagaagctattcacaatgtgtacaactgaaaaaaatgttagtgctaagaaaatataatttctgaaatcaagcaaaatgatgaaaaggtatgaacaggtatttcatagaagcaacaactcagagggacaataaacgtgtgaagagatgttcagtattattgatcagggaaatgcaaattcataattaaatgctattttacatccattctgttggcaaacatttgtaaagacctgacaatactcagcattggagagcagtacacccatagaacctcttttacgttgctcttaggagctcaaattggtctctccactttggaaaactgtgtgacaggatctctgaaaatggaatattcacatacccatgacccagaaattctactccagttttttagctacactagtgtgtctcaacagcaggagatatgtacaagaatggttgtaggagcactattcacaattgccaaagccaggatacaactgaaagcacacaggatggatgaattaactggaaactacggtaataaatgacaacatggatatttaagggaaagaagtcccaaaagataactatggtaggccgaataatgtcctccaaagatgttgattgatggcctactcttggaaatctgtgaatatgttactttacatagcaaaagagattttgttgatgtgattaagatagtgatcttgaaatgaggagattaattaacctggattatctgggaagccaatgtcatcacaaggatccttataagaaggaagtaggagtgtgtgtttctgtgtgtgtgtgtgtgtgtgtgtgtgtgtgtgtgtgcgtgtgtgtgtgtttgagagagagagagagaaagagagagatcgatctgggagtcagggaaagccagagacctctagaaatgacaggaaagtcaggaagtgggttcactgcagggcctccagaaggaactcagccctgttgagcaataggttggtagatacttaagagtatttttaaaagaaccaactaaataaataaaaacaggtgatgatgagagtgtgtcacaaacaaaagtttatcagtaatccacggtccacttctgtgtattttgaaattcttcttttgagacagagtcttactctgtcacccaggctggagtgcagtggcacgatctcagctcactgcaacctctacctcccgggttcaagcaattctcctccctcaacctcccaagtaacttggattccaggcacatgccaccatgcctggctaatttttgtatttttaatagagacggggtttcaccatgttagccaggctggtggctggtcttgagctcctgacctaaggtgatctgcctgctgtggcctcccaaagtgctgggattacaggcgtgagccaccacacctgttctgaaattcctaaagaagaaacaggattgtgtctgtagagcttttgggactgatctagtaagaagaggagaaattgatgataaaggtataagtatgagaggagataattactcatgttcctgataaggtgaaggggggtgtgatctcaagcacaagtggatgaaatgagacaattttttcattttagcacagaaaaaaaaatggctcaggtacaggtcatagtagtatcctctcttttatgagcagggtgctttgtatgtgtaggggaactccccaagcaaaatgaacggctttgaatgaatggcttctctgtatttctttatcttctccaactccctagtgtttgattgcctcatatcctacatagtcctttggtgcttcccattgccgccttctctggaagcctatttccaaagggaagtctcccttccatcttctaacataagcctacacaagagaatttctttcaaaagatttctgaactagagttgatgcaatgccccttttggaggtattatttttttggagacttattttgcaatgcctcttttgggggtaattttggagatttgttaaggtctctcacccattctgcagttttgataaggtggtgggagtgggggcatgtacgctccctcagtgtctctcgcccattctgcagttttgataaggtggtgggagtgggggcatgtacgctccctcagtgtctcttcctgcctgcatctttgggataagtctgtgacctctgggaacagaagagtcctgcagtgaatggcttaagatggtcctggccacatggagaaatggtctcttccttgatgacctcttgggttgggtttatctctccctgttcttttgtaccattagaatagtaacatcttaaggactgagaatcagatatcagcttagagggaaaaaaaaagaaacaaaacacaactaagaaggccaaccagtgcctttcattctaagtctctggagaaacagaagcaaatcttctagttcatttatgatctaagcccagctcaccaatttaaaaaatcagaacttgagtcccaaataccagctaataataaattgtactttttctttgccttgtgctctcttccttgccacgtgaggataatttacttcttcttcttctttttttttttttttttttttttttgagacagagtttcactcttgttgcccaggctggactgcagtggcgtgatcttggctcactgcaacccccgcctcctgagttcaagcgattctcctgtctcagcctccagagtagctgggattacaggcatgcgccaccatgcccggctaattttgtatttttagtacagacagggtttcaccatttggtgaggctggtctcgaactcctgacctcaggtgatccacctgcctcggcctcccaaagtgctgggattacaggcgtgagctgctgcactgggggaaaatttacttcttaaagcacactcatagggcaaatttccatgggtcaaaaaactattattaatttaataggaaaaaagtgcattcttgagctcctatattaaacctaatttgtattaaaattatactaaatctccctaaaatgaagtcagtaattaattaacatgtcatatgctcacctaaatgtattcccttcttcacttgttcttcagtttggttgttaacctgttctaccaaagcttgttcttaactatcacatagtataaactccagattcccttacagaatatatcataccgaatatgtacataattcaaacttcagtgtaaggaaagcaaaacaaaaccagcaacaataaagttggaaaaaaacaataaagacaaaggaatgtcagtgaagaaacgcagatgatatctgatttacccagcatattgacggcatagggaaaaccatgcacagagtcttctctgatgtgaagcgtgtgcttgtctgctgaaagaacttaggcgctatgggctaattcttacgactgtgaggaagactgcacatctcactctgcttctgcttggctcctccagagccacgtgaaatcacaacaattctttttttttttttttttgagacggagttttgctctcgttgcccaggcttgagtgcaatggtgtgatcgcagctcactggaacctccacctcccaggttcaagggattctcctgcttcaacctcctgagtagctgggattacaggcacacaccacgacgcctggctaattttttgtattttttgtagagatggggttttaccatgttggccaggctggtctcaaactcctgacctcagatgatccgcctgcctcagcctccaaaggtgttgggattacaggcgtgagccactgcgccaggccccaacaatgctttaaaaaaaaaaaaaatgaagaaatgccttaaggggtaatgaaatgaatttcccataaagtagaattcaaattcttctaatgagggatgatttccgggttccttggggctccacacacatggctttggtggacatgtgtctgctggcagatacagcgttctgaatacaaaccgtgtctccattctacctgttatggactgagttgcatagctctaaccctcaatgtggctgtatttagagatggggcctttaaaggggtaattcaggttaaatgaggtaatagtgtggggccttaatccagtatggctggtgtcctcataagaagaggagaagacaccagggttgactgtgctcagagaaaagaccatgtgaggatacagccagaaggctgccatctacacaccatggagagagacctcaggagaaacgaagcctgctgacaccttaatcttggccttccagcctccagactgtgagatcacacatttctgtggtttaagtcactcagtctgtgatcatttcttatggcagtctgagctgaccaatacaccaccccttctactcttgcatcccctactaagctagtactattctcaatttattcttacgggaacagccttatattatcagtagtttgaagagctaaccatatccttaattaaaaataagtgagagagtcacttaaaatcttgatgtatagtttatggtaaaagaacggttatttatgtttggagattaccacattctacagtgtctgctgtggatacgtatcttgtgttgtccatttcaagcttctcagctattctgcaagtaaagatcatctcagaggcccatgatggttataatcaaatccagaaacaatacttttgagtctgtatttgccacctgaaaggagtgtgagtaaaattgaattcctggtcctctcagaactcatggaattcctttcctcgggagaaaaccagattatttttgtaattaaaatagctgtatagctgtagacagaaaagaaaataaaaaagagaggcagggaaaactttccattattgattttatcatgctgctgttttagaaaaaaaaaagaagccaggatatagaactactagtttgttcctacagtatgctttgtaccctcagttgaaatattgcagcagttagattatttgatggaaatgggtggcttattcagaagtctggttttcaacatggtgtgaattaaggttagtaggtctgtaccatccccaaacccacctgcctggctttaccataacagctgaagttcctgtcaccagcatcctctgtgcaacctgctatcatgatacagacctgggagagtaacttattattgggaatctccttaattaaaaatcaacacttgtcagaggaaggaagaaatcaggactgtgaggccaacttctatagcagaggaatccaagtacaacccaattctgaaatgattcttgtgtggccttgggcaaatagcctgttttcatttccttaaaataaaaacacaaattagagatgatctcttcttgtctagttcagttctaagattccagaaatcaaaggcaagtgtttttctgtttgtttgtgttttaccttccctctcagagttctttattttttatttttattttatttttattttattttttgagacagagtgttgctcttgttgcccaggctggagtgcagtggcatgagctcagctcactgcaaccttcacctcctgggttcaagcgattctcctgcttcagcttcctgagtagctgggattacaggcactggccaccacacccagataattttttttttttgtatttttagtagagatggagtttcaccacaatggccaggctggtctcaaactcctaacctcagatgatctgcccaccttggcctcccaaaatgttgggattgcaggagtgagccattgtgcctggctagcattctttaaaaaaaaaaaaaaaaatcaactttgattttagattcagaagctatatgttcaggtttgttgcctgggtatatagtgttatgctgaggtttgtagtacaattgatactttcacccaaatactgaatatggcacccaataattttgcaacccttgtccccccaccacagttgtccccagtttctgtttttgccatccatctttatgtccatgagtacccagtgttcagctctcacttgtaagtgagaatacacagtgtttggctttctgttcctgggtgctaagatatggcctctggctgcatctatgtagctgcagaggacatgatttcatttttttatagctgcatagtatttcatgatgtatgtgtaccacattttctttatccagttcactgttgatgggcactgaggttgattccatgtttttactattctgaatcgtgctgggatgaaacctatgagtgcgtgtttctgtttttggtaggatgatctattttcttttggatatatatatatatatacccagtaatgggattgctaggttgaatggtagttctgttttaagttctttgagaaatctccaaactgctttccacagtggctcaacttatttacattcccaccaacagcgtataagcattctcttttctccacagcctcgtcagcatctgttcttttttgactttttaataatagccattctgactgtgtgagatggtagctctttgtggttttgatttgcatttctctgatgattagcaatgggaacattttttcatgtttgttggctgcttgtatgtcttcttttgaaaagtatctgttcatgtttttttgcccattttttaaatgggggtgatttgttttttacttgttgggttatttaagtcccttatagattctggatattaggacctttgtcagaaacatagtttgcaaatactttctcccattttgtagattgtccttctcagcattcttgattcaaattctagcatccatttaactacctatagaaacttagacaaatgacttaacatcttagttgtttcctcatctgaaaaaatgggattaatattaaataatataggcaaaagtacttatgtattatatggcacatagtaggccacaagcagctagctgttaccttttcttctgatcaaaaaatgtgaatttacatcttcatataatattggtcatttttatctgctttttggccatttggtttgggttatatatttaatacatggattcttaactgtatttcagaaatgttaaaatttgaaataatttattcttaggaaaagctggtacgcttgtgatctgctttatcttccttttattgtagccccaaacagagatttcaagcctgtattttgcccctacatctttgggactgctagctccttggctggatttgcatgctcatcaccctcccctctgctctggagcagggaggctcatcagcacagaaagttaaaatttgctgaagccatctgtcttttgttggaggaagcagcttagccataagttgtagctactgttttaacagatttgcaaatagttagggtgggtctggctcaggcccaagtaactgattgggctcatatgcactaatttaagatccactgccagaatgaaaacttcccttatatatcatcaggctctgttatttgcagggtgtcaattaaggtaactggatagaagatcaagaacacaaaggacaggaaggtgggacccatattttacatgtgctgggggagaggcatgattttgtggaaatctgttttattgtgttgaaatacttgtgtgtgttctgcctacttcatgctaataaagaattgaaccccagttatgtttagctatggagtgatgattaagagtgatgtcatttaccaacctgttttgttcaatttatgccaaacattccatcttaatatcatttatcattttctgacactatatgatgtagacagtggtatacaatggtaactagttttttatttacctgttacctgtcttttgtattcaaagttgtgctccagaaagtcaggggttatttttgattttgttcacagctatattcccagtgtgtagaacagttcctggcacatggtaggtgttcattaaatatttgctgaatggagacacctgatactctatgaagacaatgtagaacagtaacttagaaaagggattgccaaactaaggcccaaatccagctcaccacctgttttttttttttttttttttttttgagacagggtctcgccttgctctgtcacctagtctagagtagtgtggagtgatcatagttcattgcagtcttcaactcctgggctcaggtgatcctcccatctcggcttcccaagtagttgggaccacaggcacatgccaccatgcccagctaatttttaattttttaaaatagctctttgaaaaacaaagctaactcctaagcagtgtgcccagagtcaacctaatttgttattttttttttttcttgtagaatcagggtctcgccatgttgcccaggctggtctcaaattcctgggctcaagcgagcctcctgcctcagcctctcagatacagatacaggcatgaactactgccttggccctgctgttttaagtaaacttttattggaacaccaccacgcttgtttgtttacctactgtctatggctgcttttgcactatagctcagagttgagtcgttgcaacagaggccatatgatccatgaaacctaaaatgtcttctctgtagtcatttatagagtttgctgagccccaggataaagcatgggcattgggatccaccagacttggatttattttctggtcacttagtagctgtgagggcaagtgatttaaactaagattttggtttcctcatgtggaaaatggtaataacgattcctatctcattggatggttgtaagggttcaccaagatgaaacatcaggaaacattaactactaatatggagccatgtgtgctgggaatttcatttattggcgacctcttcattacgcaggatactttgtcatgtactgaacaaagggaggtgacggaggcctggccctttctctgtgtggcagctgaacagtacctgtagtttttctccactctgtcttctttgatcccattgccacatagttgtccttgctgtgtataggctaatttttaaaagtaaatgtagtttctagaaatattggttgttttgttataatagattattaaaaccataatttcagaagtaagaatatgatttgatttttcctgttaagttctgcttcacttaaaatgagaaaaaaatatgctagtttctacctgtggaggtacttgcataaatacattcctttaaaggggaccaaaacagtaaagcaataaatagaaataccatctactggtataattgctataaactaatgcaaaaatggggtgtatttaattatttattttaaaagttttatattgcttttgaatatttggaaaatacacaggaatataatgaaagtgattaaaaattacaaacattcccactacacagagaaaaaattgacttttaatacatctctcctacttaaagaactgagatgatagtgtaaaaataattttccatcacctcctttttaacttaatattacatatttgtccaaaggcttagaaacattttaaacatacttttttggtttttttaaaatcaactttttgttttgaggaatatctgccctgcagaaaagtgcaaaaaaatgctttggtaacacctgtatattcttcaatcgtcaattatttttatttgccatattaattttatctctctctacagtttattttgttgagccctaaagatgacttttaatggctgcacgtatttactcctgtgtatgtatcacagttaattattctcaggaatagattatttctctttttacctttttgtaccatttaaaattcagttcactgagcattcgtgctaagcattatacatacaagatctaactttaaaactataaccctaaggggcaggagttacagaagataggattaaagcttagagaatttaagtaacttgccaaagatcaaatagctaacaagtggaggggctaagacatgaatcctggtttactggacttagaactctgtgtttttaatcacttcatagtaatatctgtctgccatcttcttagatgttaactcttctacaaaaccttcctgactcccatctctccatacttcctttgctcctagaaccctggctgcttagatggatggtacgctatttcagtataacaacttcttttttttttcttttttttgagacggagtcttgctctgtcgcccaggctggtgtgtggtggtgcaatctaggctcactgcaatgtccacttcccaggttcaagagattctcctgcctcagcctcccaagtaactgggactacaggtgcccaccaccatgcccggctaatttttatatttttagtaaagaagggtttcaccatattggccaggctggtcttgaacttgtggcctcaagtgatccacctgcctcagcctcccaaagtgctgggattacaaatgtcactgggcccagccagtataacttctttacttttctttgtatgttattagaccacgagcacgttttgccctggatctgtgttagtcatcttttactcctactttctgacacatggtagttgcttagtgagtaattatcgaataagtaaatgaatggttgaaagcttcttaacacatattaccaaattgctctacataaatcttatactagtttaagttgatttggaggatttctgttactgaattcaccacctgccaacattgagtgttaggactcaaacagtatgttgtttgggccattttatgtccacaccactcttacaaatttctttatgggaaagaaatttttgtcccattttgttaaataaaattttaaaaatgaaagcttgttttttaataaaatatatatacattgaagaaaatttgttaaattgggagccatagagaacaaaattaccaggaattccactattctgaagcttttaaataaaaaccctgctgctgttttcctatttaaaaataaaccatatgttatctttctttctttcaataataattacttggagtattttcctatgcattagtgggcctttgaaaaccaaaatgtcaaaggctgaataatgttcgtctcacgaaaaaaagtatatttattatcaaaacagtattctagaattgtaaacatagctatggggaacagtttaggacataaatatttgtgcatattactagacactgaatattttaaatgaaagtatttcaaatatgcagaaaagtttaggtattagtgaaacaaatagccaaaggtcaactatacagatatttacagctatccaataactttccatgtaggctaggaactccttctacaaataaagtgatcagaaagaaatagatgtttaccatttgaggaaatgtttctatcttggtagctcctagtttatgttaaatgggtgctagatttactaatttctgttaatgcagttcaagctgtctgagatctattgtatttacacaatacaatagattttttatttgatttgatttctttttatttgatttctttggggacactcatttaaaacaacttttcttgactatagctttaagagctgtcacagctgcagatacagctgcaattttttttagttttaactagaaactcatcatttactcttccttgaacacagctggatatgttcttttttcctggttggtggcactgttatacagctattcatatgactatatgttgctgcatacaaactgggtaaaatcattatgaattattggatgtaatttttatcatcttatgctattttgggggttatatattgctttcactgccactaatttcagtaagagaaaagtgtgtaaatcataatgacagagctaactacaattcttgtcaaaattgttggcttattcttaggatccattggttttatgctctacaaattagaggatctaatttgtagtctgcattccaatactgacgtttttagtgtgctgcctacttgaacattcatgtaaaacattacaggaagaaatgaaggctgggcacagtggcccacacctgtaatcccagcacttcgggaggccaaggcaggcagatcacctgaggtcaggagtttgagaccagcctggccaacatggtgaaaccctatctctactaaaaatacaaaaattagccggacgcagtggcgtgcacctgtagtctcagctactcgggaggctgtggctggagaatcacttgaacttgggaggcggaggttgcagtgagccaagatcacagcattgtactccagcctgggtgacagaacgagactccgtctcaaaaaaaaaaaagagtacataaacacccatccctgaagaatatcatctcatccccttgtgaaaaaaaaaatctcatctcctttccaaaaaataccatctcattgtcttgccaatcaattccaaagagctcaaaaaaacaattaacaaagttagtatagttcccctttttgttcaaaagaggaaagatttgctaactctgacacacatgggaagagcttatgaaatattttattggtttttgctctattgttcattgctattgcatataaacataagattatatatataatttgtgcattataaatgtacctcattcatgcataaatacatgcttcatacattaaacatgtatttttcccccatgcttagatccagtttattccagaaaaaaagcaaaattttcttcaaagatcaaaagcaactattagtagatggaaaacttttaaatttttgcctccaattcttttttttcttgagctatgtatgaggaaatctatagctcagactgtgtctggtgttagtatgtatcaagctctttagccagaaggaggagcaaggcaagtgaaccacatcccttggcacttagttccttcttactttccctatatgagagagtacatgcactcctgagcaaggagactgcagggcggggatctctagaatccccggaggaccaggggctgcatagcatttacttcatcttacagagttaagtctgagatgacagaagggacttatctagggcccacagctagtaaattataatgtcaagatcaaatcctggttttctcacccttatgggtaatatttaatgtcattgttccctttattacactacttttttcaccctagggtgacagctctcacaaagttcggtcctggaacaatatgtttgataattctatactaacaggatcatatactaatggtactaaaacttgattttttttttcttcccaggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtttgctttttctttaaaaatcaggccatttctaaaaagcaggaaaagaatatctttatacaaaggaacttctgcttagacaattattatgacttacttaaaatgatgaccttgatgtgttatatagtagtggaatctaagcaaagatggtactttctaccagctatcagtggatgggaaacttttaaatttttgctttcaattctttttttttttttcttgagctatgtgtgaagaagtctatagctcagactatgtctggggtttgtgcgcatcaagctctttagctagaagaaagatcaaggcaaagggaaccacatccattctcatattagttacgttacaagtagcttgttagaatgatgaaaaatactttcctttttatgtgtgggcaatgtcaggctgaatctgaatatatagaattataagataaatttccgaaaccgtctttagaaacagaagcagaactctatgactatatccatagcacagtaatctgtttaatcatctcttacaaaatgatgccatgtgtggaccgcatttgggattctgaaaacgtgatgtgccttagtcatctttagaatcaggaaattgacaatggtgattggaatgtgaactatcgcttcttcgtttgctaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaaggttactaatttatacgctgtgattttaaatttgtagttatgtgaggaaggttacagtccagagtaaagggtctcctagtgtaaattttttcctccttctcctcctcctcctcctcctcctcttcccccttctcctcctccccctcctcctcctccccctcctcctcttcccccttctcctcctcccccttctcctcctcccccttctcctcctcccccttctcctcctcccccttctcctcctcctctttgtgcaaaggatgctgtagggaaaaattaagcaacctgttagtcatctaatttgttagcgtaggtgcaatctatctcaagagttactttttaagatgtctgtgtttacattcttgcctgaaacttgcagagcattttctccaaatagtattttttatgataaaggcggcaagttattttaacatcctttcttatactaaatcagagtttctcagtctcagcactattgacactttaggccagacaattctttgttgaggacacaccttggacattgaaggatgctgagcagcatcctgacctccacccactagatgccagtagcactccatcccccaaactgtgagaaccaaaaacatgtattttcagatattcccagatgtcccccagggagcaaaatcgcccaggtttaaggcaactcaattgattatatgctcatatttgaagtagacagaacattttaatgttgcttattgttagtcctctgaaatatttcagatttttgcttagaagaacaaagccagattacagcacaagccattctgcaagactcaccgaagatgtccttgctgatgatcgggatgactatgatttcttgatgcaaacgtccacggtatgaggttgcagcttttgtcgtttatttctatctgtcactcattatgttttacatctccagtaatacataccgattcatcatacttagtaacattatttttaaaatgtctgtttctgtttttggatatattttggggactgaaagtttgaaaaaagtttacgtattatgatggatattatgcaatacaagagttattttagaaaaaatatttgtaatggcatgcataatcttaattttgctctgtttcttgacaaaattttaaattgcccttgaatttttcaactacatttgattttcttcatcttactgaattgtctgaagatcaatcatcataatttgtgagaggtcaagctttgctcccttccattttaaattctcaaagctacttctcctaaaatgctacattgaaaaagtatttagttgtgttcattgtagagtgatcccatatttgagtttgatgttcacatgttctgaactatttcaaaatgagtttaggccaggtgcagtggcttaaacctgtaatcccagtactttgggagttagaggtggatggatcatctgaggtcaagagttcaagaccagcctggccaacatggtgaaacgctgtctctattaaaaatataaacattagtggagtgtggaggtgggcacctgtaatcccagctactagggaggctgaggcaggagaattgcttgaacccaggagacagaggttgcagtgagccgacacggtgtcactgcactccagcctgggtgacagagtaagactctgtctcaaaaaaaaaaaaagtgagcttaaagttcaaaatgttatgtgtcagagaaaggaaaggccaagaacatgcaaaaaaggtgggtgacgagtataaaaacccaaacattggccaggtgcggtgactcgcgcctgtaatcccagaactttgggaggctgaggcaggtggatcacctgaggtcaggagttcgagaacagcctggctaacatggtgaaaccccgtctttactaaaaatataaaaattaactgggtgtcgttgtgcacacctgtagtcccagctactcgggaggctgaggcaggagaatctcttgaacctgggaggcagaggcttcagtgagctgagatcacaccactacaccccagcctgggtgacagagtgagagtctatctcaaaaaaaaaaaaaaaaagtgaacatagatttgcatacatgtataagcttgaagaatttgaagcttccctatgcttaatggattcgtggttttattacatacatacactgtatatgtgcacatatatatgtatgtgtgtatattacacacatctagcacacacatatatgctgaccagcataaaaagacttaaatcatttagcatgtttgctcagatcacatcttttctctctttcctgttatttcttatttaattcaggatctctggtaaaagacgtttcttagtttgtagtgttagtcctttgtgcctacaatattttcattcacccaaacggttttaaaccaagaagtgaattcttaagtcattcacagacttagacacagttaggattgcaaatccaagttttgttttgtttagttttactttgccaatatttggttctgctatcttcacagtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaaggttagttttcctcaattttttgcaagaatgacatgtgaaaaaaatattggtgaacctagctattccttttccttgtattttgtgaccaaggtatttctatttataggaagaatataatcaagccattaatgtcaatgtcgtttttgttattcatacaaaccagttaaggaatctaaatgtgttaaatgtgcaaacattgtacagtaagagcagtgcagccttttggggtaatgatcatatattccttcaggtaacatgactaacagcttgggttaccaatacttagcctttgttttagggttgagagatgggtgaatgtgcggcttttaaccaatgacttgatatagatttcgggaactggctatgtggtggggagaaaactgtgaagacaatgtgggctggtagtttagaccaggtggacgcatttgaactcggactgaggagaagtgggttctttcctcagctttgccattgactcgctgtgtggctttgggtaagtcagttacactttctgtgccatctttttttcatttgtaaaacaaaccaaactcaaaccaaaccttcaaaaaagtgaagaaggctatcttccttgcagaataagacaagagaagatctgaccattggcttctaccttttgtgcccatgcatcctctctgatctgctgtgacaggtctccgaaagagtcctttataacgttgcttttcttctatacttgcaccatcattttttgggaaactcactttcctgccctcgggttgtaacatatgaagcataatggacttagcattttcaatgggagcccagcaaaaatctctaatgaagagctctttacataagtttggaacaaaaaaaccacatgtctccaggaatattttttgggggccatgcttaattttcagggatggcaacagtataagtaaagaactcaatatagggatgggataactgaaagatgattttgttggaggaaatggaagatagggaagggtcattggattttatgtagatagtgtgaagaaatgcagcctacatttgattactcaaaaactgatttatcccagcctttttgttctttcccttctgcttgcctggctttagccttttttgctggttttgttaatatgtttactgtacagtggcaaagaaagagaatgctgataaggctcaaattacttaactttgttaccatctctagtaaaagctttagggaaggtgaaaatcaggtggcatttgtggttaatatcactgggtttttttttttttttttttttttttttttttttttttttttttttgcatattctagttaaatctgtctctcagatcactgggaattgtccagaaaggggcaaaattttagccaaattttaagtatatcaaatcactgaaggcttatgtagaatttgcctaaggactttgatagtgtctggaaataaatgcttctcatttcagaacaagtggtaaaacaaaacaaaacaaaaaaaagctaaaaaaaatccatgagatgaaaattacaaatttggatgatttttaaatagttaaacttttttgaacccagaaaaaggtctagtttggtttgagtttttggagagaaggtgcaggtcagttcttacttggttccaacttgttgacctgtcttcattaggtgtgaaatgtagagacttataagacctgattcagaacgtccactgcagtcaatggagttttgctcagaatcacagaatcgggcctattgtgcacctctcccattacagcatgagcttgttgcttgcgcagcataatttagttagtttgcaagatatacctgctttctcttttatctgtggttgtacaaagataaaaatgttcttttgaaattcagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtacgcggtcagtgatgatatcagtcttctagggaggaagacttctttcccccattaaaggaaaacacagtttgtaagatcaaaaagtaaaatagacacatgtacatgtgcccctggtctgaaaatcagccgagcagacctgcccctagcaagccctcctcatagctgtcccagccactgcactcctgtgacctgagaaacaggtctcaccccaacaaagctgcacaatcaccaccacaaatgcctgtagcgagaccactgaggcacttgcagatgctgctgacataaattacagctgaagaatctgcacagatactacactaccgcatccacccagaaccaaaaccagtgtatcctacccaaccggtaccctagaacccatctacaggaaaagctatttcctacaaaagctacttcataaagttggaagaagctactgttttaccagatgaacagatatcaaaggaacacaagaaacacgcgaatggaaggaaacatgactcctccaaaggaacacaataattctctagtaacagatccccctccccaaaataaatttataggatgcctgaaaagaaattcaaaataatgatcttaagggaactcagtgagatacaataaaatgcagatacttcaacaagattaggaaaccaattcatgatctgaatgagatattcaatgaagaaatacatatagtagaaaagaactaaacagaaatcttgtaactcaagaattcaataaatgaaataaaatatacaactgagggtttcaacaacagactagatcaagcataagaaagactttatgaacttgaagacaggtcttttgaaataacccatccagagggagaaaaagaaataaaaataagaaagaaggaaaaaagcctatagaacttatgggatgccactgagcaatggagaaaggcacagaaaacgtttaacaaaataatgactaataactttccacatctttggaaagatatggacatccagatccaggaagctcaaaggatctcaagagaatcaacccagaaaagtcctttccaaggcacattataatcaaactgtcaaatatcaaagaaaaagaatcctaagagtaatgagagaatagcaccaagtcatatatacttggatttccatttgactatcagcaagtttctcagcagaaaccttgaaggctagggaaatgagatatattcaatgtgctgaaagaacaactgtcagccaagaatactatgtctagcaaagctatccttcagaaatgaaggaaaaatagagtactccacagataagcaaaagcagaatgaattcaccacctctggacctgccttagaagaaatgcgtaaggcagtgctaaagctggaagcaaaaggatggtaattactatcatgaaaacatgtaaaagtataaaacccattcgtagaagtaaattttaaatcaaactcagaatactgcagtactgaaatggtgctatgccaaatctttcagacctctagtactctagtatgaaggttaaaagtcaaaattgtcaaaagtaactacagctacaagtagttgttaaggaacatacaatatagagagatgtaaattaaggcatcagaaatataaattgtgaggggagggtaaaagtccagagtattttttttttttttgagacagagtcttgctctgttgccaggtaatggtgggatcttggctcactgcaacctctgccttctgggttcaagcaattctcatgcctcagcctcctgagtagctgggattataggcatgcaccaccacacccaggtaatttttgtatttttaatagagatggggtttcacgatgttggccaggatggtctcgatctcctgaccttgtgatccgctcacctcggcctcccaaagtgctgggattacagacatgagccaccatgcctggccagtccagagtatttttatgcaaccaaatgtatcagcttaagatggtctattataactacaatattgtttgtcttagtttcatagtaaccacaaagaaaaaattgcagcagtcacactaatgagaaagggaaaggtatcaaagcttagcaccacaaaaaggtatcaaaccacaaaggtaagcaagagagcaagaaagaaatgaaggatctagaaaacaaccaacaaaatattaggaataattccttacctatcaataataaccttgaatgtaaatgaattaaattgcttagttaaaatatatagagtggctgcatggataaaaagcaagactcaactatatgctgcccactagagattcacttcacctttaaggacagacatagcctgaaagtgaagggatggaaaaagattttcaatgcaaatggaaactgagagtgagcagaagtagccacacttagataaaatagacttaattcaaaaaatgtaaaaaagagtcaaagaaggtcattaatagaaaaggatcagttaagaagatataacaattgtgaatttatatgcattcaacactggagcatccaaatatatgaagtatgttttatctaaagggagagataggcttcaatgcaacaatagtagggaagttcaacaccccactttcaacaacagcagataatccagacagaaattcagcaaggaaacagcagatttaaactgcactctagaccaaagggacatactagacatttacagaacattctgtgcaacagatgtatagctgaagaatacacattattctcaactgctcatgtggcattctccaggacagatcatatgttaggccacaaaataaatctttaaaaatttaagatgatatcgtatatattttctgatcacactagtataaaactagaaatcaatactgagaggaactgaggaaactttacgaatacatagacattaaacaacatacccctgaataaccagtgggtaaatgaagatgttaaaaaagaaattaaaaattttcttgagacaaacaaaaatggcgacacaacataccaaaagctatgggatacagcagaggcagttctaagagggaagtttacagtattaaatgcctacatttaagaagtaaaaaataaaccacctaatattgcacctccaaaaaccacaaatacaagaacaaactaaaccccaaattaatagaagtaaataaataataaaaattggaacaataacgaaacagagactaaacaatacaaaagatcaatgatacgaagagttggttttttgaaaagacaaaatcagtaaacctttagctagacaaagaaagagatgactcaaataaataaaatccacattgaaaagaagacattacaacctataccacagaaatacaaaggataatgagaaaatattatgaaaaattgtatgccaacaaattggataacctagaagaaatggataaattcctagatgtatacaacctaccaagactgacttatgaagaaatagaaaatctgagcagattaatagtgagtgaggaaattgtatcaataatgaaaagtctctatcaaagaaaagcccaggactaaatgggggaaaagttgaaagcttttttttctaaggtctggaacaagacaaagatgcccactttcaccacttctgttcaacataatactagaagtgctagccagagaatttggcaagaaaaagaaataaaaggcatccaaattggaaaagaagtcatcaaattgtctcagtttgtagatgacatgatcctatatataaaaatacctttaaaagtttactaaaaaactgttaaaactaatacattcagtaaatttgcaggatacaaaatcagcatacaaaaatcagtatttctttgcactagtagtgaatgctctgagaaaaaaaatcaagatacaatctcagttacaatagctttaaaaatcagttatcggctgggcgcagtgactcatgcctgtaatcccagcactttgggaggccgaggcgggtggatcatctgaggtcaggagttctagaccagcctggccaaaatggtgaaacctcgtctctactaaaaatacaaaaaaattagccgggcatggtggcaggcacctgtaatcccacctactggggaggctgaggcaggagaatcacttgaacccaggaggcagaggttgcagtgagctgagctccagcctgggtgacagagtgagactccatctcaaaaaaaaaaaaaaaaaaaaaatcagttatctaggaatacatttaacaaaggaggtgtaagatctctacactgcaatctataaaacattggtgaaataaatttaagaggacagaaataaatggaaagatatctcatgctgttggattggatggattggaagaattaatattattaaaatgtccatagtacaaaaagtaattacagattcagtgaagtccctatcaaaataccaatgacattattattctattatagaaatagaaaaaataattctaaatttcttatgaaatcacaaaagaccccaagcagccaaagcaatcttgagcaaaaagaataaagctggaaacatcacactaactgagtttaaaatacacaaagccatagtaaccaaaacactacctgacttgaaactatactacaaagctatggtaaccaaaacagacatatagaccaataaaacagaacagagaacccagaaaaaaaaacacctatccatatccaactaattttcaacaaaggtgccaagaacacacattggggaaaggacagtttcttcaataaatggtacagggaaaattgaatatccacatgcagaagaatgaaattggacccctatttttcaccatatacaaaaatcaactcaaagtggattaaagacttaatgtaggaccttaaactatgaaagtactggaagaaaacatgggggaaacacttcatgacattggactgggtaaggattttttggacgagacctcaaaagcacaggcaacaaaagcaaaaatagacaagtgggattatatcaaactaaaaatcctctgcacagccaaggaaacaattaacagagtgaaaagacaatctacagaatgggacaaaatatttgtaaactatacatctgataagggatcaatatccagaatatataaggaacacaaacaacaatagtaaaaacaatctgatttaaaagggggcaaaagaccttaataaacatttctcaaaagaaggcatacaaatggccaacagacatatgaaaacatgctcaacatcactaatcatcagcaaagtgcaaatcaaaaccacaatattaccttattccagttaaaatggctattatcaaaaagacaaaagataataagcattggcaaggatgttgaggaagagggaaacccatacactgttggtgggaatgtaaatgaatatacccattatgaaaaacagtatggaggttcctcaacaaattaagaatagtactaccatatgatccagaattcctgggtatatatcccaaggaaaggaaatcagtgtgtggaaggaatatctgcacttctataattatcacagcactactcacaatagccaagatagggaatcagcctaagtgcccatcaatggattagtaagtgaagaaaatgtggtatatatacacagtggaatactatttggtcataaaaaaaatgagaacctgtcattcgcaccaatatgggtgagcctggaggatattgtgtttagtgaaataagccagacatagaaagaaaaatactgcattgcccactcatatgtagaatcgaaaaaagttaatgtcatggaagtagtgaatagaatagtggttatcagagactgggaagggtaggtgaaagtgggggagagggagcagatacccaatgggtatagagttaacattagaaaggaagaataagcgctggtgtcctattggacagtagggtgactatagtcaaccatcaggtattgtatatctcaaaatagctagaagagaggattttgtatgttctcaccacaaagaaatgaaaaatgttcaaagtgatagacatgctaattaccctgatttgatcattacacaatgtatgcaagtatcaaaacatcatgttacaccccattaaatatctacaatgtgtcaattaaaaaacagtaaattagaaattaaaagaaaatggaaaaagttagattaattatgtatgtttacttctgttaaataatgacaatgccttaagcccttcagagtaaacagagtatgttccccaagcagtgttcacatagtaatgaaatactctaattcttgaaggagcacatcaatcgatatgcaagaaaggaaaatctctgggctccttctgtaaagtattcctttgttgttataaagaaaaactttttcccttgtcttgtttcattactaacattattaaattcattaaatgtatttcaggtggaaccgagtacaaaattatttcctgcggtttttgcacaagctacaagtcccaatgttttccagtttgagttgggaagaataaaggtaataaaacttattcctggtattgtatttgtattttttctattaggatatagcattgatttattctgaaatgaattcagtatattagtactgatatgaatcaaataaatcattctttcaagaaaagatagccatgcttgaaaatctctttcaggtcacaagggtaacaaaataattaaaaagtgtttctctttagttatcatatgtatattattcaataaaaggcctatagaaaaaaaaatgccgagattacacacattgcagcagtcattgaactgataggtgagctaatgaatggacttaaagatctgaaaccatgccacctacaatagtggtatgtatggaatactccagtaacataaatgaaagaacaactcagttggatgggttggatcagctaaagctcaaagaagaggtaacatttagtttgattactaactgtaaaatagaagctcttggggtacgtttattaggagaggtcattctgggcagaggatgagaagaagcaaaaatatgtaagagtgaacatgctgaaggttaaggaattcagtgtaaccgtaacaaaggatgccttccagaatgtggctggagattaagatggataaaaggtagaacaagtccaagttgaaaaggtcttgtgtgccatgtgaaaaggttagcatctattacatagacaagggaaatccattggaaatttgaagaaggggattgagcataatgaaacttgttttggaaaaatatgttgttattaatgtggaggtgggcaagaatgagaataatcagtagcaatgaggtgtcaataatttgatactgtctacatggaagacagtgattagagccatggaagtcagaatgaaaaatgataaatgtgaaaacattctagagaagaaatgaatacgcgaaggcccgtggtgggtgatgacatgatgtgatttctgcccagtgctctgaatgtcaaagtgaagaaattcaatgaaggacgggtaaacggcgggagtaactatgactctcttaaggtagccaaatgcctagtcatctaattagtgacgttcatgaatggatgaacgagattcccactgtccctacctactatccagcgaaaccacagccaagggaacgggcttggtggaatccgcggggaaagaagaccctgttgagcttgactctagtctggcacggtgaagagccatgagaagtgtagaataagtgggaggcccctggtgcccccctgtcccagcaaggggacagagtggggcaaggccagaggtgaaataccactactctgattgtttattcactgaccccgtgaggtggccccaaggggctcttgcttctggcgccaagtgcccggccacatgcacatgccaaattgtaaagaccatcgatgctaggaagaaactgcgtcaactaatgagcaaaataaccagctgacatcataatgacaggatcaaattcacacataacaatattaaccttaaatgtaaatgggctaaatgctccaattaaaaaacacagactggcaaattggataaagagtcaagacccatcagtgctgtattcaggagacccatctcatgtgcagagacacacatatgctcaaaataaagggatggaggaagatctaccaagcaaatggaaaacaaaggcagggattgcaatcctagtctctgataaaacagactttaaaccaacaaagatcaaaagagacaaacaaggccattacataatggtaaagggatcaattcaacaagaaaagctaactatcctaaatatatatgcacccaatacaggagcacccagattcataaagcaagtccttagagacgtacaaagagacttagactcccacacaataataatgggagactttaacaccccactgtcaacattagacatatcaacgagacagaaagttaacaaggatatctaggaattgaactcagctctgcaccaagcggacctaatagacatctacagaactctccaccccaaatcaacagaatatacattcttctcatcaccacatcgcacttactccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggacactgaacaacctgctcctgaatgactatggggtacataacaaaatgaaggcagaaataaagatgttctttgaaaccaacgagaacaaagacacaacataccagaatctctgggacacatttaaagcagtgtgtagagggaaacttatagcactaatgcccacaagagagagcaggaaagatctaaaattgacaccctaacatcgcaattcaaagaactagagaagcaagagcaaacacattcaaaggctagcggaaggcaagaaataactaagatccgagcagaactgaaggagatagagacacaaaaaacccttcaaaaaatcaatgaatccaggagctggttttttgaaaagatcaacaaaattggtagaccactaccaagactaataaagaagaaaagagagaagaatcaaatagatgcaataaaaaatgacaaaggggatatcaccatcaatcccacagaaatacaaactaccatcagagaatactataaacacctctatgcaaataaactagaaaatctagaagaaatggataaattcctcgacacatacaccctcccaagactaaaccaggaagaagttgaatccctgaatagaccaataacaggctctgacattgaggcaataattaatagcctaccaaccaaaaaaagtccaggaccagacagattcacagccgaattctaccagaggtacaaggaggagctggtaccattccttctgaaactattccaatcaatagaaaaagagggaatcctccctaactcattttatgaggccagcatcatcctgataccaaagcctggcagagacacaaccaaaaaaaagaactttagaccaatatctctgatgaacatcgatgcaaaaatcctcaataaaatactggcaaacggaatccagcaacacatcaaaaagcttatccaccatgataaagtgggcttcatccctgggatgcaaggctggttcaacatacacaaattaataaacgtaatccagcatataaacagaaccaacgacaaaaaccacatgattatctcaacagatgcagaaaaggcctttgacaaaattcaacagcccttcatgctaaaaactctcaataaattaggtattgatgggacgtatctcaaattaataagagctatttatgacaaacccacagccaatatcatactgaatgggcaaaaactggaagcattccctttgaaaactggcacaagtggccttctctccccactcctattcaacatagtgttgaaagttctggccagagcaatcaggcaaggaaaagaaataaagggtattcaattaggaaaagaggaagtcaaattgtccctgtttgcagatgacataattgtatatttagaaaaccccatcatctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttccaagagaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactatactacaaggctacagtaaccaaaacagcatggtactggtaccaaaacagagatacagaccaatggaacagaacagagccctcagaaacaacaccacacatctacaaccatctgatctttgacaaacctgacaaaaacaagaaatggggaaacgattccctatttaataaatggtgctgggaaaactggctagccatatgtagaaagctgaaactggatcccttccttacaccttatacaaaaattcatccaaggtggattaaagacttaaatgttcgacctaaaaccataaaaaccctagaagaaaacctaggcaataccattcaggacataggcgtgggcaaggacttcatgtctaaaacaccaaaagcaatggcaacaaaaactaaaattgacaaatgggatctaattaaactaaagagcttctgcacagcaaaagaaactaccatcagagtcaacaggaaacctacagaatgggagaaaatttttgcatttttgcaatcttctcatctgacaaagggctaatatccagaatctacaaagaactcaaacaaatttacaagaaaaaaacaaacaaccccatcaaaaagtggacaaaggatatgaacagacacttctcaaaagaagtcatttatgcagccaacagacacgaaaaaatgctcatcatcaatggccatcagagaaatgcaatcaaaaccacaatgagataccatctcacaccagttagaatggtgatcattaaaaagacaggaaacaacaggtgctggagaagatgtggagaaataggaacactttcacactgttggtgggactgtaaactagttcaaccattgtggaagacagtgtggcgattcctcaaggatctagaactagaaataccatttgacctagccatcccattactgggtatatacccaaaggattataaatcatgctgttataaagacacatgcacacgtatgtttattgtggcattatttacaatatcaaagacttggaaccaacccaaatgtccatcagtgttagactggattaagaaaatgtggcacatatacaccacggaatactatccagccacgaaaaatgatgagttcatgtcctttgtagggacatggatgaagctggaaaccacaattctcagcaaactatcacaaggacaaaaaaccacacaccgcatgttcttactcacaggtgggaattgaacaatgaaaacacttggacacaggaagaggaacatcacacaccggggcctgttgtggggttgggggagggagggagggatagcattaggagatatacctaatgtaaatgacgcgttaatgggtgcagcacaccaacatggcacatgtatacatatgtaacaaacctgcacattgtgcacatgtaccctagaagttaaagtataataaaaaaaagaataggatttaacaatgaattggactaatagaatttgtagatgaatggaattcaggatctcaaggagactgagaatgaatgattgatttaaaattttagtttggacaatttgaccatgctaatcaaaaagtagaagagcttttcgaaattcaggaaaaaaggttgaacttaattttgcaattgtaaagttgaggttccaggcacacattggagtgaatagagtagatagttttattaggctggcttggtgaccttggacatctttcttaaattatttgagctcagtttctgcatctataaaatggggttcacagtatccgttttatggagttaatataactaaacatcttgagcagtgctttatacatggtatacagcaaatttatatactcaataaatttacatacaatatacatacgtatgcatacctatatacacatatgtatacaccattgtgctaaaaagagctatgctggagattaaaattttcatcatcaagaaatcagttgtaattcatctttgagtgtgaatggaatatttgagggcagatgtagagagtgggaagagatggctgaggagagagcctggttgtatcaactaaaaaagaggaacctatgagataggctgagggcagaactctcaagaatgttggagaagaactgaaagagacattttagtagacgccaagcgaggatggagttttctaaacaggagtggctaacagcggatgccgtagatggactcatacaactcggagtaaaggaattcctggcttttgttaatgaggagggctttggtggccttgccagaagaatttaagcaaaacaatgggagaggggctggtctcagtggctcatgcttgtaatcccagcactttgggaggaaggaggaatcacttgagcccagaagtttgaaaccagcttgggcaacatagtgagaccccatctctacaaaaaataaaaaattattttaggcagatgtggtggtgcacgcctttagtcccagatcctccagaggctgaggtgggaggatcacttgagagtgcagacatggaggctgctgtgagccgtgattgcgctgctgcactccagcctgggtgacagagggagaccttgtctcaattattatattaaaaaatgatgagaggagccatgtgacagtgaattcaagattggaaatgagagaaaggaggcagcaagttcagactgacctgttttttttttttttttttttttttacaaaattggacaaggagttgtagtttctcagaagcctgactgatatattcagtcatctattgactattgacttctactgacattttcattggccgactaatagctatcacaaattgaatgcatccatactggactgcttgctctcttctcttcttttcctttcttctttctctcttcttctcttctccctctccctccctccttccctccctcccttccttccttccttgtccctgtcccttttctttcttgctgacagtctcactctgtcacccaggctagagtgcactgatgtgatctcagctcactacaacctctctctctctctttttctctttctctctccttccctccctcccttccttcctgccctcctatcttccttgtccccatcccttttctttcttactgacagtctcactctgtcacccaggctagagtgcagtgatgtgatctcagctcactacaacctctctctctctctttttttctttctctctccttgcttccctccctccatccctccctccccccttctccccttccccccttcccttttctttctttctgacagagtctcacttgtcacccaggctggagtgcagtgacacgatctcagctcactgcaacctccgcctcccaggttcaagcaattctcccacctcagcctcctgagtatttgggactacaggaacatgccaccatttttgtttttttttacaggcgaatttttgtatttttagcagtgggccaggctggtcttgtactcctgacctcaagtgatccacctgcctcggcctcccaaagtgctgggattacaggcgtgagccatggtgcctagcccagtctttctttaaatgttgctttctcaatgatgcccattctgacaaccccatttaaaattgctgcccttgattctggttcccccattctagctttctgtcccccaaacccccaggcccatgacatctcttttaaaataccatttaattcatttaatttacttattgattttatttcatactttcagtgagaaaaatggaagctatatgagggcaggggttttgttagttttattcattagcatatcatcagtatttaaaccagtacttggtttttccccgcctattgttagagggcaataggaaagcagtttgaggatgaagtagtctacagcatgcagttgagggggctctagaggagaagaagagatagaagataatgcagaaatatgagataatggttttcttatggtcccataagaggcaggcatcggtgttgtcaagatcatagataaatgaagaaacttttggcaaagcagagacctctctttctttgacaccagacagaaagaattaaggatggctgaagatgatactggaggtggaggagaaataagtaggtttgttaatgcctaacatattctgttttcttattcggtagtcaggtttatctgttgagctttatctggaatacttctggctagaggaagtgtcttaaggacgagttgggtgacagagaacagatattgagagagagagccagggggatgtgacatatctgtcattcaggaagtttggcactgaaagtccctaaagacttgccagctttcccggaggtcccagcctggtaaagaaatataaaggatatatgggtatgcttggccttctctctgtgccattcagtatatgggaaagacacatcccgaaacctgtttgactgcccggaaggtgtaggtattctctctcataatgtatttcctggtttgtcctttcagaaacttttcaacccaatttctatgatttcttgtgttgactttgcttgactcatagggttatcttactttccctgtctctgtcctgtgcagaattctagtcattactttgtgaaccccaagggatgttctacatttattctttttctgcctccccatccgctagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacaggtcagccccagtgaatccctgacattctgattgggacgcttgggattagcctgctgcccggggcttccggtagtggtgcggggcaggggtggttctaaagaaacaagatgaaatttacaaagatctaaattctttaggcaatggagtcattattctgcgtattctaagtttaagtttatttctcaaccattctgttactgaaaaaaattattctgtagttgaagatgccacatgatggtttcttcattcactcttgcgttacttacaatgacaatggcgaataaaaattcagacaagtgcaactgcaatccgacttatgacttagcagagtactgtaatagagaatagtgagatattagagatggaatcataagaatcacttatgattcctatgttcaacccttcattttatagatgtaaaaaactgatccaagagatattaatgaaagaaaattgggaaaatactgggagtgtcttcgaaacaagtttatatgcattctaggcagtaataatagtaacataaagtataataagtactcaaaggtatttgagtagctttgtttatgattttctgtttttccatatgatagccaattaaattgcagagatttcatttaagcagccttcttatcaataaggagctaagtttctaagttttgggccaagatttccctcccaaaatgccactgaaatgttgaatcacaaactgagtaaaaacaagtcatgaaagtaatgcacaaacatatttgtatgttttaagtctttaatctgaaaataattattgaagccaggtccatttttatatctttagatgttcttggcattttttattttaatatctttaaaatttaacctatgctttggaaaacagtttgtcagttcctcaaaaaataaaattatagcgttaacatgtgatctagcaattctactcctcgtatatacccaagagaaattaaaatatgtccacacaaaaacttgtacatgaatattcatagaagcattatgaacaatagtaaaagaaagggaaccccaaatgttcaccagcttatgagtcaataaacaaaatgtgatatatccatataatattatttggcaataaaaatgattgaagtactgatatatgctacaaaatgcaagaactttgaagacattatattaagtgaaagaaaccagtcacggaagtatattaagtgaaagaatcctactagtgtgggattttatttaattgaaaagtccataatagacaaatctttagaaacgaaaagtagattagtagttacctagggctaggagcggaacaggactgctaatgggtactaaattccttttgggatgataaaagtgttctaaactcaacttatagttatagttacacaactccattaatatacataaactattaaattatgtattttaagtaggtaaattgtatagcatgtaaattacagttcaacaaagatattttaaaacaaaagaaaatcaaagaaaaattaatctggctagttaattctttttatgtattacatatgtatttacattttttacatgaggtaattagatatctttcataatgtactcttgagatggttcagtttgattttaattttgtattctttttttttgtgagaagagttttatcataatttttcatctgatgatgttttttaagaaaataccgaacaaccaaaacaaacacaacatttgggaaggaattcttgtttatgaaggaaaacgttgtgtctctactgagcatggaattttaacattataatttaacattttggcatgctatcatcgaaaaccaacataacaccttgtctcagtagtttatattaattgcctgtgatagatgtgtatgtatgtgaatggataatgtaaactctcactaaagatcataaaggatttgaggcagttttccaaatgatatggaacatgaatgtataaaaatgtgtcactggcatcaggccatagaaaatatatggataggaaaataaaactgaggctaagagtgacacacagtcatttataccacaccgattggtagagttggggcccacattaatttcattcttcctagcagccaaagaaaaatatgatgagtttcaaaatccaaattccaaaaaaggaagtcttaactagcatggttgagaagaatctgatgccccaataacatgacaaatcattaatattttaaagtgtgcaatggtggtagatttatgtcagtgtgtactttgtttctccttaacacatgtcacagtttataatttaatttactccattttggtcagcgggggtggtttactccctcaattgaatataagctccctgggggcaggaatcatgtctatattattcaccattgtatcatcagtgcgcagtgctaatacataataggcactcagtgatatttgatgaacaattgaatgacaatgacatatgaaagaaatttctccactagagacttttttgttgttgtttctttatttatctattgttttgaggtggagtctcaccattgcccagtctggagtacagtggcgcgatctcggctcattgccacagatccttgatacaatggaggaggaaggaggtgctagatgaatgtcaaattctatgtagaagaaaatttgtagaacatctagaaatgattaaaagtactatgcagccattaaacatgtcatagaaaattaaaagaagacacaggttgggtgtcccaaatccaaaaatctgaaattcgaaatgctccaaaatcggaaacattttgagcaccaacataatgctcaaaggaaatggggtatttcacatttcagactttcagattcaggatgctcaaccggtaagtataatgcaaacatttcaaagtctgaataaagtcccaaatccaaacaattctggtcccaagcatttcagattagggatgttcaacctgcagtgtctattcccataacttttttccttcaaatttacagtgcatactgatttctcctctgattcagattttaaaaaatcattcatttctaatcttactaccactctcctcccttctacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcaggtaatcagaacaagagacttgagtgaatttcagaattgctaagcattaaggtattagaacatgcctttgtttctttctctgtgtgtgtgtttatttctttgcattcctgtgtaatggtagttcttcataaaattaactaacttcctattcttttccctcttattcattagccatctcctcttgtttcccagatgctttttaccttcattacattggaatacctgaaatacaagccatcaaatacccctttccacccatatttccactcttaccaaccttagaatacttgtttaccagtagatgcacccattgtcacatagcaaggttttactttcccctagtatgcttttgttttgttcttttgagacagggtctcactcagtcacccaggctggagtgcagtggtggtgcaatcatagctcactgcagcctagaactcctgggctcaagccatcctcccacctcagcttctacagcagctgggactgtaggtatgccaccatgcccagttaatttttttttatttttagtcgaaatgaggtctcgctctattgcccatgctggtgtcaaactcctggactcaagtgttcctcactcctcatgctcccaaaatgctaggattacaagtgtaagccactgcacccagccaccttagtatgtttttaaggaatcagacacactggctgtctttatgctcctcaagatgtctaaagggtcctttattaatgtctcctctgtttattaaagtcaattggatgtttgcatcgctgacctgcttttttgctcctcgttcctttagtcagcgttgactgaagccttactctgggtatgcacttaggggaaacacaagtgaaccctgcctttcagaatctcacagcctctaaggaaatatacactcatttatgcattaaaaaatcttattgctaattgcattaaatactctgaaggcaaagaatggattactaaaagaaagaacatttagactggattactgttagaaagatgagggagaagacccctcagagattttgacttttaagctgagttcagatttaagagttgtgctcagcagttacaagaaaaaggaacaaggcagggtgttctaggagctttccatgcaaaacaaatagcccagcaaaggtcctgaggcaggaaaaggccagtgtggctgctggtaggaaaatcgataagggaggaaagagagtgtgatctagtgtctggttagtcaggaggctttcttgctggtccaaactctaggagaccatgctcagaggagggtggggcaaaggagatggagaaaaggggttggacactgtgactacttcagagacagcactgatagaaatggttatattgtagatggtgacacagagggttttaaggtcctctttgacactgtcatgtatttatatcacaattggtattgagtgtatagatttttttaaaaatttggcagagcattctctcttagaaatgtttctaccaacatactcactcagttataaatccttttggttttcagtaggagaaagacccagctaatcactgaatgaatgagcattcaccacttaattgtcttaagtttagatttctagaattggtacagcagttcaatgatctcatccataacccagatcttaatatttttctgctctgtgatcctcagcctgtggttttcttcctaaaatgctcaccttattctttctgcagtaatcatgtcatcacccagttacactcattttgaaagaagggaactctagtctcttatcactgatggaataactttcccagaagacccttagcaaactttcccttatatatttcattggccattgcacctgtggctgaaagggaggctgggagggtaagtgtattagttcgttctcacactgctaataaagacatacctgagactgagtaatttataaagggaaaaggtttaatggactcacagttccacatggctggggaggcctcacaatcctggcgaaaggcaaatgaggagcaaagtcacatcttacatggtggcaggcaagagggcatgtgcaggggaacttccatttataaaaccatcagatcttgtgagacttattcactaccacgagaacagcatgggggaagacaccctcatgattcagttatctccacccagccccgcccttgacatgtgggggttattacaattcaaggtgagatttcatggggaaagaaccagaccatatcagttaacatccactaaagggacatttgtttgccatttttgcttatacaaattatgtttcatctcctgggaccgagcacattgctgcctatacaaaatcaggattctgtttctaagagagaagagtaggcaactaaggatgtttaccacagattatgatttcatacacattattaaaggatttagaaattaaatttggtgtctttttaatggtctcttagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacaggtacagaaatgaaatgaaaattcttcgtatttatgttggcttttagtcattcaggatctctgccttgcaaaattatataactcacacgtcttgttttccttgttctgtttaaagtcttcaagttgatttagttagtattcttagtttcaccaaaagaatttctttggttagtttacacaaaagagggacttattagaagatatcaggtatatcaccgactctttgagaaggccaagatatgccagagtctgaagttcttcaaataggagcaaatttcaaccacaaatgggtcttcatcatcttccactcataggaatttttgattcctaggactcgatgctagaggctttccatttgtgcctaccatagaagaaacacatgtctcttccaccttgcttgccggaagactgattacctgcttgtggtttcttcctttcattgcttacccccaaagtcaggtctcctgagggtacaacagaacaaagggaacctgcctatatcagagaatgggctagttgggggatgtaaattttctggaatctacctcagagtgggcctcagagtgtgggaagttactggcgtagggatggtgttaaacaatgtaattcacagatgtcttttttgatttcttacccttaccattttcttctctatccagggtagctcagaatgaaagtgtttatagggactaattacagaatttttttttttctcaccagaatgtaatttctttgaggaaagggatgtggaattttcttaattgttataaacagcatttattgagcagagaacaggtccagcctcttccagattaactctgttaaactactgttgggaaacttctgcttctggaaagatggagtacatgtgcttttcccgattcttccttttaagtacaactaaaaccctggacattacaaagaagacaacataagaaggctctgaaagatagagagaagaagagaggttggctacagaactcaggacccaaggaacaacatggtggtgagttccctggattttctttttgcctcatctatcccagatttgaagctaaagaagacgacaaccaggaaacaccaatgggcatagacaagaaaagctgcaacaaaagcctcctctttctagataaaggatcagggaaggggcagcttagcaagacagaaatgtgttagataataactgcactactgaagccaaaaaccacagaaaaaactgttccccacccacactgggcacaggctgagtggggaaccttgacttccactctcaccaggctgtaacaaggtgtcccagtagaggacagagctgggactttatccccgctgagtagtaacaaggcccatttcttccaaagtatcagtagaggttatggaaggagaagtagcaagacactcttacctttctagcaaggttcacatcagtacaggtctaatgaggaaccagaactttttaccactgcccaacagtaacagggtcccttccctcctccagatgtccaagaaggctgagtgggaaaatggacttcgcctcccacctggcagcaataagataccctaagcccttctcctgctggatggggtcagaggaaaccaggtgaaacagagttaaaaataagacccagagctcctagcataatcctcaaaatgttgagatttcaattaaaaatcatgtgtgtgaagaaccaaggaaaacttgaatgaaaaaaccaatcaataagcaccaacactgagataacaaagatgttaaaattatctgatgaagttttgaaagcaatcgccctgtaattccttcaaaatggaaaagaaatagaaagcctcaacggcagagaaacaaaatatatggcaaagaaccaaatggaaattttaaatctgaaaaatataatcactgaaattttaaaactcaatgaataggcttaaaagcagaatgaagggagaagaaggaacaatcagtgaactgaagagagggtgatatcaactaccccatctgaagaaaagatgaagatgaatataacaaaagatctaacatttgtgatgttggagtctcagaggataggagaaagagggtgaactgaagaaaataatgctgaaaacttttcaagttcagtaaaagatatgaagtgagagattcaagaagatgagtacattccgtataggataaacataaatctttaccgagacacatcatagtcaaatttctgaaaaaattaaagacggagtctttaaagaaatgacactacctacagggggagaaacaatttgagtgacagcagatttctcattagaaagtatggagggcagaaggaagtggcacagcaattttcaaatgctgaaagaagagacgatcacctcagagttctatgtactttgaaaatactcttaaggaacgaaggggaaatcaagacattctcaaatgacaggaagttgtaagaatttgactacagcagacctaccctaaaagaatgctaaaggaagttctttaaatataaggaaaatgaaaaatgaaggaaatttggaaaattcagaaaggaagaaattaacactgggtaatgttgtaatatggtgaatgcagtgcatttttattctctggagttttctaatttatgattgatggttgaagcaaaaatcataaaactgatgtgtttctaaatatatgtatagggaatatttaaaaattataaacagaggagaataaaggaacagaaagggagataaggtttctatccttcactcaaactgaagtctactggtgttgacattgtaccatctggtgcaccgtcaataccagtagactgtatgttaggtatgtatataaaataatactcagagcaagcactagaaaagctgtacaaagagatacactgagaagtaccacagataaaataggattctaaatattgttcaagtaatgcatagcatagcaagtcagtaaaaataaatcagaacaaacggaaccacaggtgaaatgacagactgaagtcatagcatatcaataatctaaatataccaattacaagaaattggcagagtgaatttataaaactcaatctaactatatgcttgctatgagaaactcacttcaaatataataatgtatacagattaaaagggaaaagttaaaggaatatgtattattaaaatattaatcaaaataaagcaggagtagctatgttacataaagttgacttcagagcacagaaaattaccaaggagataaggatcatacataatggtcagtccaccaagaagataaatatatatgaattaaacaacaaagcaaaatatgtgaagccaaaactgatagaactgaaaggagaaatagacaaatccaaaattatcttgcagaattcaagactcctctctcagttgatagaacagctgaacagaaaaatcagctatgacacggaaaaactccacactatcatcaaataatagatctaccaaggtttgtagactactccacccaacgacaaggtacacactcttttcaagtgttcatgaaacatttgctaagatggaacatatcctgggccataaaataacctcaagacatttttaaaagttgaaatcatacacatttttttatcacattgttatcaaattagaaagcagtaacagaaaggtaactggaaaatctccaaactcttagagatactaaacaacacacttctaaataatctatggtttgaggaagtatggggagaaatttaaagattcattaaactaaaagaaattggacacatcacatttgaaaatttttgccacagctaaagcaaggccaagagggaaatttctaacactcaatgcttacatttaaaaagcggaaaccactcagatcaataacctgacctgccacttcaagaattttgaaaacaaagagtaaaataaacctaaagcaagcagaaagaagtcactaatgtagataataacagaaagtaatgaaactgaaaacaggacaatagaaaaaatggatccaaaagctggtttttaaaaaatagcaataaagttgacaaacctctaaaacaactgaaaaagaaaaagagaagatacaaattacccataccaggaatgaaactacttatcatggcacaccctgctgacgtcaggtgataacatgggatttttttcttctcacctttgaaataacgataagtagatgagctgatgaatatgttaattatcttgatttaatctttctacaatgtatacatatatcgaaacatcacatggtacctcataaatacatacaattaatatttaccaattaaatatgttttaaaggatcgtatgggaatacatgcatacatactatatgattccatttatgtaacattcttgcaatgacaaaaccatagagatggaaaacaaatttgtggttgccacgacttaaggatgaggggcagacagagggatgtgggtgtgctcatgaaaaggtaacaggagggatctttgagataaaggaattatcctctattttgactgcactaatgttgctatcctggttatgagattgtactacagttttgcaaagtgttaccaatcgggaaactgcataaagcgtacttgaagtctctctgtattatttcttacaatagcatataagtctataattatatcaaaataaacgtttagggaaaaaaaatcacataaatgccaaaaagaaaatctaaaatagtttcttaaaggaaaattatgggaaagcatctttctcttccgaatttataaatttaatagtattgttcaaacataaatggtaaagtttcccgcagtttaactgaaccattaatgttagcagcgcgtagttatcccttataaagattaaccatgccgaatatgaaaattcaaaacccagaatactccaaaatccaaaacattttgagcactgaaatgataccacaagtggaaaattctacacgtaaatacttagtacaaagtttatttcatgcacaaaattatttaaaatattttataaaatttccttcaggctatgtgtgtaaggtgtgtatgaaacatagatgaatttcatttttagacttgggttctattctcaaaatagctcatgtgtatgcagatggagctggtcctctctatctgtgggttctgcatctatggattcaaccaactgtatattgaaaatattcagaaaaattccacaaagttccaaagcacaaaacttgaatttgctgtgcaccaagtactatgtctaatccacttaaatgaagtgatatgtcagcactgccttgggtattataagtaatttagagatgatttaaaatatatgagaggatatacataggttatatgcaatttctgtgccatttcatatagaagacttgattgtctgtggcttttcatctctatggagggtcctggaaccaatactccatggatactaaaggatgattgtattccaaactctgaaaaagaaatcctagatctgaaacacttccggccccaagcatttcagataagggatactcaaacctgtgttacttttcaattatatttttccttcttatttgtgtctgtgttcttctcaaaaagagttcttgtaaatattcaatgaatgttcaatagagatgttagctagaaaataatggaaatttaggataagcatgatacaatactttttaaaaatagcatttagatctcttagttatgaattcttaaagtatacaagagtctgacatattgtggacttgagaaagaggaagaaacgttatatgactattttgcagcttgttaagctatggatgatttgatttattctgcggtactggttggattgtgtgatggacacctgtggaggaataatttatgaacaatcagagattttgagcatttttgcttttgtggtagttgtgcctttctttgtttctttctttctttctttctttctttttttttttttttttttttttttgagacaaagtctcactgtgtcgccgcccaggctggagtgtagtggcacaatctcggctcactgcaacctccacctcccaggttcaaacaattctactgcctcagcctcctgagtagctgggactacaggcatgcaccaccacacccaactaatttttgtatctttagtagagatgggttttcaccatgttggccaggctggtctcaaaatcctgacctcgtgatctgcccacctcagcctcccagagtgctgggattacaggcatgagccactccgcccggccctgctgtgccattcttgaattcacctttcttttcttcctccttcttcctctttcttgtttttcaaactttcagatcaatatgcttctcaattttaaggatgacaaaagtgaatgtccatgtccagaagaaattcgtgaccaactattggatttccatgaagatttgatgacacattgtggtaaggtctttttgattaaaagcttttattaattgtatgtttttaatccatatatcctgagacgaaattaagtgtatatgcgaatattttcacgaatacacacgatacctgttagaaagttatataaaaacatttattattatggcaaaatggcaaaataactgtccctatgtggggagtcctgagggatagagaaatcagagaggcagttaaactgagcagaagatgaccaaaattctttctctctttttcctctttccattagtggcaggaaatgggaagggggacatgtggccaggtgcctctggcagggaggttaaggttggtttagtcaatgggtacaaagtttcggttatacaagatgaatgaattctggagatccatggcacaacagggtgcttctagttcacaatactgtattgtgcacttaaaattctgttaagagggtagatgtcatgttaagtattcttaaaacaacaacaaacaaacaaaaccccccaaaacaaagaagtgctaagaaacttagaggtgatggatttatgtctgttcctggtggtggtgatggtttcacagatggatgcatgtgtccaagctcatattgcatagataaaatatgtacagttttgtttatagtaacctcaatgaagctgttttttcctcatgtaagaaagaaatttgatcacaaacagttgtatttaaagcagttgagggtgtactttctagaaaatgtagactatatcttttgaaattagtgaatgcctatggaaaccctacattaagttgttatgtcagtaatccaaatctgttaagggaagtctcccctccttttattctaagaactttaaaaatggaattgattaggtattctggacgtgtgtgtgtttttattcctttatgcagtggtgtggataaggtctgatgattcaatgaaagaaaatgaaccagctgtttttaaagttatagataaaaataatgccactggtttaaccggtggttatcttattttaatgaagataataaaaacaccactttgcatattaatttggtttatgaatgaagtaccactaaatgactcccagaaaattatactacatgtgtgtgtacatgtatgtgtgtgtatatatatatatttctacaaatatcccttgtagaaatgtgtatgtatgtgtgtgtatatatatatttttttttttctacaagtatccctgtatttctagtatccctacaaatacagggatactagaattctagtatccctacaaatacagggatactttaaaactttagaattactgcttcagatataaagcattccctggtttagggtacctaattatgcctgttctctctgtttctcaactaaccaaaatactgctaaaatttttggaggcaagagaggagaattaaagtctgtggggcatggtgtaggcagggctggactgtaagtctaggcagacagtatctgaagtccgagatgcccaagggttagcccaaatagcagaattgatctttgcccctaagagagtctttttggtctctactcagtgttatattttgttctgggtgacagccctgagcccacaggaatagaacaaaaagagagaggaagaaaagaggctgaccagtgaatgttatttatgagggctggtaagcaacattgcttaacttaatgttagatgtttttgacattgttctaagttgtgcatgaaagaaattacaaggcctcagaattatttgcccaagtgtattctttaaatatttttttctgcctctctgtttttttatactaggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctgtaagcagtatgagagtgcactggcagaatgacccaactgctgacacttaactcatcctttgaacgaatgttttactggatgagccagtgagataattgagtttgcaacttccaagaatcagactcttaagtagatgcctgtagctcccagaaataaacagcagcatcagtctatgtgtatagcaacagactgagaggtagcagcatgataaagatggatggtctccatagagaactagaaatttaggtattttatcagagaccataaagagaaagttaaaaggaagtatagtaatttagccttcatatctaaatatgaggtcgattttcaaatattattgcatcaaattaaacttttttcttaaaatttaaacagatattgtctttatattttggttctgaaatatttcctcaactgttgtatacttctggttgatccatatcctatttcagaataataagcacccttgggctgtgagtgccttgggcacagcactctgagtaggtctgagggatccagcctactttttacttcacttctaagactgtattgattttaagatgcagcaatggtttgttaatagctttccctgaaataaaaaaaaataaacttacgaaaacttttacagcacttttttttgacttacaacagaaaacctttattcatacagttacttctaaatttatttttcagtgtcacaatcacaaatttgagtcaagttttctttaaaatcagagttcagtgtttctttcttttctttttctttttctttttctttttttttttttttttttttttttttttttgagacagtctcgctccatcacccaggctggagtgcagtggtgcattttcggcttactgcaacctctgcttccctgtctcagcctcctgagtagctggaattacaggcatgcaccaagacgcctgattagtttttatatttttagtagagactgagttttaccatgatggccaggctggtgttgaactcctggtctcaagcaatccatccacctcagattcccaagtgctgggattataggagtgagccactgtgcatggccagagttcaacgtttcttatgaatcactttctattattatcaagtttatgatcttgagtggttaaaatgacagtgtggttttcagatataggggaatatattggcattttatttgcattttgtatttggttaaaaatggtagtttttgtttttgcttaaataatttctagatgaaagtaaaacagcctaatttgaaagtcagccagcatattaatactaggattaagtgcctcatcgtgcataaattggtcaccccacttaattttggtaatttcactgtttatttgaaaagatttggacttttctattgcttttacatttactatgtttcatgttacattgcaaagtaattttctgtgtatgtagtaacttttcgctttaatataaattcacaatcaaatccttttgaagacattttaaatgacaaatatggatacaactttaagtgaaaacataattatacgtagtcactagtgcaaatgactcaactgaggagacagttggataagcatacctttttgaatgtccgtgaccgaactttataaggataaatgatgtcaggccttctgggaagaaaataatagaacaaaacaaataaaagtagtaggacaccttatattaattgccataccttcaattacatatgaattgccaatggtaattttgaaaaagtgatataactgtagcttatttaattataagaatgatttttaaagaaaggtttgtgttttttatctttgcatgattgtaactgatctgtattgaaatatgtatcatccaatgaaggttattttcttcaaagaatatctagagccttttcaagcctggtacaaatagaaataccaatttgggggtacaggatatggacttgaaatgtccaactgatttgtcttctcttatttttcttttaaaaaatatccataatgactttgcagccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattagggtaaattatttaactactacaaccctttgtctcgtaaatgttttctaattgttatacctatagagcagtacattaactacattgataaaaatatattgtctggattatacgattattatactaaatagcttttcttttttttatttattattatcatactttaagttttatggtacatgtgcacaatgtgcaggttagttacatatgtatacatgtgccatgctggtgcgctgcacccactaactcgtcatttagcattaggtatatctcctaatgctatccctcccccctccccccaccccacaacagtccccagagtctgatgttccccttcctgtgtccatgtgttcacattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttagagatagaaacaaaagctaagttagaaagttgctcagtaatgaaacaagactaattttacagtgtggcacacagccaatatctttcagtgtttttttttaagtctcatagtaatgtacaataatatataaaaacataggacagtaaaaacacattgatccataggtctgtgtggtgtttaatacattaaaaaaataaaaaaacacattgaaatccaaggtgggtagttggaaatatgaacaggaaatgataaggaagcttgtctttatctattgggccttggaaaaagaaggggtagggggaacaaattttctgagaattcagcatcatgagcttgcatttcatgtggatttgggggttaaagttaacaccccatattcaagagtgaggataaaacaaagatatttcagaatatttacttacagtccctcattggaagaccttctaaaatttttatgctaaatgttaatatatacattagggagaagaaaacggaattcagagaaaaagaatgggatgcaacacgtttttttgagtatactactgatttatacatgtataaatctaagcaatcattaataataagcttatatagttcggggatttgaaaataagatggaaaaattgcctattgagtagtgttcgctactcaggtgatggtacaaccaaagcccaggctgtttttttgtggtacagcaaaagcccaggctccaccacgacacaatatatgcacgcaggaaatctgtatttgcaccccctaaatatttaaaatatttttaaaaataattaaagaaaaaataagatggaatcaaaatcataacaaagataaaaattatattaagctctatgatgttcattaagaacaatacctaaacataaaaatgtagaattctggaagataggatgttaaacagtgattagaagacaaatatttagcagaaaaaaaagctgatgtagttacatagatatcaggcaaaagaggagataataaaggtaactgctacatgaataaaatagaccaaaagaaacaataaaattgatcaaagaaacttagagttaattctttgaaaaaaacgaataaaatggaataccaagtttttctttgacagaactcaaatacaatcctgagggaagaaaacaagtgtataatgatacagactgtttcatatcatttctatacattttaactcagaaaacaatattgcatattgctcatggacctattaagtatttaaaattataaaaatggatgaaaggttctattaaaaattcataattgttgcacactaaaaataaatatactaatgggacagagagggaaagcaaaaaagccaattgagaaaagcaaatattagagtctttataattgtatgagcataggtcttatttgagtactaatatttaaatctaacccgaggaagcctctcataagaggttatcttaattaaccaaatgaaaaagaaagccttccagaaaatggagatcatattctttcttaacacacaacagtaatatgtgccattaaaaagtaaatcattcattagtgataaaactcaaaatgatgttaaaaagcaaaatgcttctttttgtggtattcaaaatatttaacacagagagattcttagtaaatgacagcctgactgctatttaatttacctaaaactaaaagcaaatgagattttaaaatcaagttacttcattcaaagatttgaattaatgagacaataaaaagaaaaagctgcccttgtttaccttagtttgttctggcatgaaataagtcagacccatattagccttgggcatcaagttttttttctgacctatgctatctaaaagccctgttcattaaaaataataaatgcaaaaatcatactatcccactttcttgatatagccagagtaactaaagttttgcatatgactaaatgaataggtgagtaattcagttaaaggaaactaatttgaagagaagtttcaattttctcataggctgtatgttctattcttgctctagatctaacaagaaaatgttttatagaaaagactcttggcatcgatttgatttatgttaaaatagaaatcaacagagctctttatttgcagtgaatgatactttctcctgaacattatgacccttaggaataccttgacacacatattacaagaatatgtaatgcagtaatgataatacgagacattttaggtatcacctaacaccgtttcttgaaactggatgtccgttttaatgagttagattacttgtacctggacttcatgtatactcagtttctcttggagaatatgaatccttttaagtatttgtcagaatgataatatgaatgcaataagaaataacactattgtaataatatacacaaatactgaatgtaatactaacaacagcatatataaatactagcaacagcatatatatgaaaagcagagatacttatatatgaagaatttttatataaacatggtataacactaattcatatttttatccagaagaaggttggacacatggttggatatccataaaattaggaatgatgtgtccaaagtatatttcattttaactgtttacatttttactatgtttattacaatggaaaagaatagacattcgtcaaccaattttggtaaattatcaatatttttgaggaaaacaattacattcattaatttttgtggcttattaaatactgtgattgcttttacttttcaactcacataaattatttctaaaagatttatgaggaacttggttaactatttagatgttgctctgagctttaccccatacgtccattgtcctttctagggatattatgaataacaaagtgttttaccagcaccctaatctcatgagggcactggggatgcacgagactgtgatggaggtcatggtgaacgtccttggaggtggagagtccaaggtaacgtctttgattcctgagatgctatttagtatcatctcctggagtatatagattgatatagaatgcagattttttttttttttttttttttttttttttttggagacagaggctcactctgtcgcccaggctggagtgcagtgcacgatctcggctcactgcaagctccgcctcccgggttcacgccattctcctgcctcagcctcccgaggagctgggattagaggcgcccgccacctcgcccggctaatttttttgtgtttttagtagagacggggtttcactgtgttagccaggatggtctcgatctcctgacctcgtgatccgcccgccttggcctcccctcccgaagtgctgggattacaggcgtgagccaccgcgcccagcccagattgtagattcttaatgagaatttcttaaatcctcttaggatgactgtttttaaagaagactttttgaaaaaaacacacaaaccttagggagttgaacgtactactagtttttttttccttgattttgataaaaatttcctgtcttatactgtgtaatttttggcctcctaaattattctcttttaggggatatttagaaactgaagtatctcatttaggggatatttagaaacttagaaacataaaaattactctatgtgttaatttattttaaaattttgaattataattcagttctcatcacgttaccagtccatggcacaagcatgttcttcagactccaccatcctccatgacacagacattggttggtttcacttaatttccaatccagattgagatttgatgataatactcttggatgtatttgttgtagaattctaaagtgaattctttttttttttttttttttttttgagacggagtctcagtctcttgcccaggctggagtgcagtggcgtgatctcagctcactgcaacctccgcctcccaggttcactacattctccttcctcagcctgccgagtggctgggactacaggcgcccaccaccattccctgctaatttttttggtatttttagtagaaatggggtttcgccatgttagccaggatggtcttgatctcctgacctcatgatcttcctgccttggcctcccaaagtgctgggattacaggcgtgagccaccacactgggcctaaagtgaacttttaagtgaccacaacttaatggtatcaaaaaccaaattagtagaatagtataataaaaaaaaactttatataatcagtataattttataacctctgatatgaaaatatgttttgatattttaaatcttaggatgtatttttcacaatactgaaataagcccatatttcatatgatcagtctgtttaccagttagacaggcttagaaggatatcataatatactgtactttattacagaagaactccagagagtatctggggtaaactatgataatatttggtctcaaggaagatgtgtttggtggggtcaaacatgcaggccttccagtccaggaaatcatctcatgaggtgcaaatcagggaggttgtaaatccctggaatcagtaattctactaatattaatactgataagaacatcctattatatgtgccacgtactgaactatatatttttcagaaatcagctcaatgaattcactcccctgccccttacctaaagcaagtattattatccatattattctaacagaatcaaagagattgcatcatttcccatggaagcacagctgatagcggtagtgaggcatcacaaatgaatctgcctttcacctttgagaatgcagtaataagtcaatttctgttctaacccatccatggtaatgaagtttctgaattagtgccaggcttgattttcattgactcagggacgaggcaaatcgtagtctgcacatttgaagatctttggtatctgaagtttggcacacacatggacacacggggattgacgatgtgattgagacctcaacgtatgaactcaattttataaaggtcgtttgctttcagcagctaatgacatgctttatctgtaggaaatcacctttcccaagatggtggccaactgttgccgttttctctgttacttctgtcgtataagtaggcagaatcaaaaagctatgtttgatcatctcagttatttactggaaaacagcagtgttggtcttggtaagtaaatgacttttatttcatctttaaggttgaaataatataatattacatttaaaaagcaaacgttttgttaaaaaatgtgcaatggacctgaatagacatttcacaaaagaagacagatagttggccaataggtatatgaaaaaatactcgacatcactcatcatcagcaaagtgcaaattgaaaccacagtgagctatcacctcacacctgttagaatgcctattattgaaaagacaaaacataataagtgttggcgagggtgtggggaaaagggaacccttatacatgttggtgggaatgtaaacacagccattttagaaaacattaaggagattcctcaaaaaattaaaaatagaactaccatatgatctaacagttttacttctgggtatatatatccaagggaaatgaataatcagtatgtcgaagagatacgtgtacttccatggtcattgcagcattattcacaatagctgagatatggaatcaacctaagtgttcatcagtggatgaatggataggaaaaatgtggtacatattcacaatggaatgctgtttggccttaaaaaaagagggaatcctgtcattttcaacaacatggatgaacctggaggatattacattacatgaaataagctacgtgtagaaagacaaaaaccacatgatctcactttcatgtggactctaaaatcaaagtcgaactcatagaaacagagagtagaatgaggttaccaggtgtaggggggagtggttggggagatgttcaaggatacaaaatttcagttagatagaaggaataagttcaaaagctctattatacagcatggtgactatagttaataacaatgtataatattcttgaaaatcgctgccagagtagattttgagtgttttcaccacacaaaagtgtatgtgaggtaatatgtatgttaactagctcaattgagtcattccacaaagtatacatatatttcaaaacatgtacacaatatatacaatttttatttgtcaattcaaaatacgtaaaattaaactttaatgtaaatcaatgtagattaatacactatggatggtgtttagaaattaaattttaagaggtagtatatttttgtatggagtttatagttacagcacgatccaggttatatttcatcttcatttgaattaatagcctccccagctatgagaggttcaacaccactggatgtggctgcagcttcggtgatggataataatgaactagcattagctctgcgtgagccggatctagaaaaggtgagcaatgttcctgccctgtgtgtttgtctgaattatgctttttcacggttttctcaatattttaaatataagtaaggttggtgcagaagtcattgtggttttgcaatgtgacattatggccaaaaccgcaattaattttgcaccaacacaatatgttctagtgctattagaattaaagtacattataatttacattgcacactatataatgttatatattacattgtatataattctactatacattatattgtagttagaagttatgaagaacaatacatttgaaaaaatgaattttctctgatgagaaacatttttctatggaaggagaaccaacgttctgtatctgtattcttatgtgtttttttcttttcgtgatatctgctgccacttttgacttaatcatacacttcagtttttaaaaaggttattttgacatctcatatgtacattttatatcacatatactttattccagcacaaagcatcagcgatatagtaaagccgtgcactctaaggatactaagccacacatgtgtattaccagcatttagagaaactttccctgtattgtagttgcaatagcattccaagtagtcacctgattttttttccttgctcacctggcatctgttcttcccttatcagccaaagtgaccctcttaaaaagatcatgccaatcctccatccagtactccccaaaggctttctatctcactcccagtaaaaatcaaagatgttgcaatagctcctacatcatctgttcctacataccagcctgatttcatctcctacagctttcccgcactctctcttctttgcttcagccacccttgtccccttgctgtagctggaacacgccaactgtgctcagcctcagggcctctgcacctgctagtccaaccatctgcagtatccttacccaagataccatcgtggctctttgtaggcattctttcagtcaatgctccaaagtcaccctcttgatcagctcttccacatccatgctgtgtaaaactgaaaccttttctccacttccttaaactcttcctgtttcctttactgctttattttcaactattggaaatgtaaatatttgtatattctgtacacaaatatatactttcattttatttatatttatagaaacttatattttaaatatatattaagataattgtatgtaaaataaatatatttaatcaaactctatgtagttatgtatttttaaaaattcatcccctactataatgtcaagccagggaggtcagagtggtttttcctctgttgttaactgctttgtcctgcctttagagaacagtgtcagcactgggtagacacttagtgcatggctgttgaagacatgaaagagtgaaactcttccccaaatcctcctgacataccagtccaggatcatgaagtcttgcatctctgagacacctcaggacatgtttcccccgtatagtacttaaaatcttttaatctacacactcattaaaatggccaatactaatgcagttgataataccaaatgctgagaaggacaaggagcagctagaactctcttctacttctgttgtgatgagtaatggtacagccagtgtggaaagcagtttggcagttccttaacaaattaaacatacacctaccataaactatatgcctagcctttccactgctaacaatttacccagtagaaaggaaaatatatgtccacacaaagacttgggcatgaatgtttctaacagctttattcgtcatagccaaaaagtgcaaacaacttgaataccgaccatcaatgtattagttgataaataacactgtgatatacccatatacggtgaaatgtcatcccacaataaaaaagaatgaattgctgacatatgctacagtgtgaatgaatcccaaaatcatatgctgagcgaaagaagccaggcacagaaagatatatgctgcatggttatgtgtacaagtgtcctagaaaatgcaagctaaattgtagtgagagaaaaccgattgtctgggactaggtgtgtggggagaaagggactgcaaagggcccagggagctctgaggagtgacggccatgttctgcgtcttgattatggtgtgttctcacagatgtctacatctctcaaagctcattgaatttatacttcaaagagatgagtttattgcacattggttctcttgcttcactatagttgatataaaacatttttagctatattattatttatatttgaaactgatttaacttaagctggatataactcaatttgcttgataagttgctcctctgtcagtcttacttccattgataatgacttttctaaggatttcttttaaaattgaatttcttgtgaaatattgtagaggactaacattcgtataaaacaaaaatattttaagaggaaaggccaggcaaaaatatgttatgtgctaatttcatcaatactgaaaagtgggtcatcttatcaaaaatttcctgaacactgaaaccttggctaaaaaagtaaaagtaactgctcaaaataaggtgtttgctaaatgctgtgtgtctgatttgaaccaaggatgtttgactgtgatcttaggtttttctctacgtattttctcacacctgcttccccattaaattgatatatcattttggaaacaatttctctttaaaatatctttgcatctcatatagatcttttaatatcttgagtggattcagtttttacattgcaccagaggtcattagacatgtttgcaatttatgactttgatagataagggtctcaagttaaatgctattaaattcagaaacattcttctttcgtagttttacacataatcctgcagctcttggcccacccagacagacttggttgccctgtctgacaaggaattgcgggtggatttatacagcaggcactgtgggtgattgtgggtagatgaaaacagaaggcaccgcgggctgaggctgctgctttattgtctccaaagtgtttaaggagatggtgcaaataaaacagcaactggttctagtccgtgagtcttgagccctgggcagatatgtttgtggcatttattaaaaagaatgtctgcttagagagagctgaaaaaaaaaaagcttatagtaggatcataaatatttttattatgatgccattttatgacgatatttaaatatttctaaagtctaaggttttactaaagggagttcaagtagattatcatgagagcaaaaagaatttgcaaaaatgcatttgtttaaaagcatcctttaaggatgtcatttattgtatccaatgtaagcatctaatgagttttcagccaagggataactctttgttaatcatgttgtttgcaggtagttcgttatttggctggttgtggactgcaaagttgccagatgctggtgtctaagggctatccagacattgggtggaacccagttgaaggagagagatatcttgactttcttagatttgctgtcttctgtaatggtaggacttgatttcttgaggtcttttgagttatcattaaaactgcatagagatataataaggattcatctcagcactttcatgaaggaagtattagtaaagaaatcacatattttataatcgataggggtttttcacagtaaccacttataatacaatatttgtttacatacttctttccttatttaaattaaaatttttaggcatctaagttctcctaaattttttattttgaattctaataatagtttggattatgacatcattctataataataacaagttagtgagaatcaatagtttatgcctccataatgctttactctgaaaatttttaatgcaagcaaaatttactgtgtctcatatacttaatgctagcaattaggattacattttggctttattagtatattgttgggttttagttattcttatacataggaaatgattagtataacatttatttgttcagaacttccatataatcatatttgtttacttatcttccccattctactttaggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacactgtaggtctaatatacacaccctcacgagtgatccatactacttgatgtgaaattttataaaatatattctgcatcctatgaattgtaatataacttgtggtacagaagatttctccctttgaaaatataatgtcttagatttggaagaatgaatggaatttggtgctggaataggtcgaatgaacaaagagagctgaagaagatggtgtagatttagcagagggaaatttaggttgtagaagatgcatcttatgaattttcctaggggagctagggcaaggtgggttgttgtaaatgatacgaagtgaacctttggggttagactggagtttagtgggaaggtagttagaatgagattttatgattagaaagagacctttcgcaaatgaaagggggacttgactaaactgttatggtggtaaaacctagaaaaggtttcattctgaggagtgtgatgctttgttgaggtacagaagacagatacgagaagcagtcactatcttacatttatctgtaggtatacgttgttaatactagagtccagtcatcgacataagtaaatccaggtgtgatgcttatctgtgtaggtgaatgtcctccagcggggtcatgcatccacactgctagtgcctctggtaaagatgtaacatagggctttattgaggcacatttctaaagaaaaaaaagagttagagggcacgcaatcctgcaaaccctttgtcttttacatataaactgggcatagatgttccatgtacaccatagccggatttgcagactgggagcactcctagagcaagaatgagcactccccaccacacacacacacaccatgctacatgcttatcagtttcccatgaaggaaccagggagctcttaggttctctcagtagtagaaaatgtatccagagacctctggcccaggaccacactagcaagggtacacctgagggcctcacggacacccttgcatgcccaggaatgaggctgtcattcaaagcctcactgtcactctgcagactgctgtattcagtggagacagctgtctgctgagttaccaaggagggaggatgtgagcctctagggccatccagatttggctctcatcagcaagagaacatgtaattatattttccctgcagagatggggagggagatatgttgagatatgttggattctttggcaggggttgcaggaggttgagtagttggtacagaggtaggtgagcaagtgcaataacatttataaagtacttgctctgggcaagcactgtactggatgccttacatgtgaccttgtatgccatctttgtcaccctttctctacatgtgtgccacttacagaaatagtctaagctcacacgtcctttgatcagttattttctttgttaatgcactcactaccactaggaaggaaaagaagccatcaaataagcagttcctccttttcccctcaaaggaatcttaatactaaaatttccacagatgtgttcttggtgttagaatctcaagtctgatctttaaccagttgttattctcccttaaaaacgtcaagctctacattataacatatatgaaacatatcagaaaaataatgtgttacctagtagtccctttcctcggagagatatgtaataaacatgaaatgtcagttatcccatttgctttctctttcttttgaaacattcatgaaagtgacacagaggaggaggaagatgacactatccacatggggaacgcgatcatgaccttctattcagctttgattgacctcttgggacgctgtgctcctgagatgcatgtgagtttctgggagttcaggagcagcaatcctgatttctctgtgttaagacatctatagctgtcaaagagcataacagcatccaaaaccaataatcttcatgctccattaaaaataatagctgcagtctaatcactgaacaagtgtttgtttagttggaaatgtctcgttggttgtaaaaattagtaatgggatttcagtgcaagtcattaatagagtacttaagttactcatatatctctgaaactcatacagcctcccacattttaagaagaaaagaacatattttctctatgcaatttcctcttatgttacagtgcatccagaaaacaactgctcctaccaaaagtcattttcttttgtgtatttagctctatgtgtttgccatcgttttaggggaaagtgagagggaaggtatagggggtggatattaagagctatttagaccatataaattagtgtctgtctgtctttctttctttctttctttctttctttctttctttctttctttctttctttctttttctttcttttctctctttttttttttaattgaggcaaggtcttgctctgtctcccaggctagagtgcagtggcatgatctcagctcactgcaatctatgcctcccaggttcaagtgattctcctgcctcagcctcctgagtagctgggactacaggcacatgccaccacgcccaactaatttttgtatttttagtagagacggggttttgccatgttggccaggctggcctggaactcctaacctcaagtgatccaactgcctcggcctcccaaagtgctgggcttacaggcgtgagccagcgtacccagcctagattagtattttctgaaactttttgacccaaatgaaattaaagtttcgtggaataatacttttactctgtaatacattctgatattttgttctttattttattgtagttgattctgtgttattctattatattcatttaaaaaaaaatcctggcccagggcccaaaacattcatttccagatcttttaatgggaaacaaacccagagtttgagagtttgaaacacattgattggtgctggggtagttaagaactgtaagtatatttctaaagtgggatgagcatgaagccagggctttcttacaaagcacctttttctctacccttattatctatatttcttttggttttggttgggttttttgtgtggtttaggtttttcatacccagaggttaaaacttccttgatgtactcttttgttgtgaacaaagaggagtcacaggatagagaaatgttagaatgttagaaaactggagtctgatttttataaaaacttaaactttgctgctagtaagattctttcatcttagtaaatggaaacagagactattaaaaatttctgtgctggaggtgattactgacaacaacaacaaaaatacttgctcacaatatttgttatttttcccatctcagaaaaaaacatcagcgaaacaaagagaaagtatactaataaatagaagttttcattctattatattaatgggggaaaactaagtgaaggaataggggaccaaccttggcatttctgaaatttatgcatcttcacaactattatttgaggcctcctgtgtgccagaaattgtgcttgagtttcacgccctgtaatgaggtaaacagatgcccatcccggctcttcagacctagtctgtcctgaagacttgctgagattcttgaccgtatgttcatccacagtcatcctggatacttcatgtcagtctaaaagaactgttaggatttatgttcgtcatttcctccacattatatatccagccttgggagaaatcagggtcgaagacagatggatatgcaattcatttcttagcacaaagcaagaaagaagctaatttggtcataaatattagtatatgttcagagtctaatgataattttctttgtattattgctcatgttattgataggtatttacatgtaattttggaaagtaaactttcataaacacgtcagattctcagtatatcttaacagtccccaaaaggataaaaactattattctaatggatgaaccaactggcctagaccatagtataaataacttggtgtatgctgaaatcactgaaaactgtttgagcaagtaaatattcgcaggtaagccagaaaactatttctgagagaggcataactttatgtatacactgatcagaaaattattttggacttggattccaatacttcagatttcctagacagaattgtaacattgatgtcacaaagttgttctaatgtttttttttcccctgtatagttgattcatgccgggaagggagaagccatcagaattaggtccattttgagatccctcattcccctgggagatttggtgggcgttatcagcatcgcttttcagatgccaacaatagccaaaggtaaggccaacttcaatttgtcctaattcagtaggatgttggatgacatcatgttctaaagaatgttttccgtactcaacatcccaacctctccacttcctaaattatgtgtatactacttaaattagtttttttaaaaaagctgtaaagtatatattttataattttttcctttttttttttgaattagagccttgctctgtagcccaggctggagtgcagtggcacaatcttggctcactgcaagctccgcctcccgggttcaagcaattctcctgcctcagcctcccaagtagctgggactacaggcgcccgtcaccatgcccggctaattttttttgtattttaagtagagatggggtttcaccgtgttagccaggatggtctcgatctcctgacctcgtgatccgcctgccttggcctcccaaagtgctgggattacaggtgtgagccaccgcatccagacttttttccattgtttttaaagctcattgtttttaaagctgtgtttgctttgggattttaattttcttttatatgacatttcagacagcttccagagaagcagaaacatgcactgctaccctccattgtcttatgtcctgccttgtgtcattggtcgcaagctcttctgtctttcttgaccttagttccttagttatgcattttgatagttttcattgtcactttcttgtaatgcttttctattaaaagcactgatgatagcttttgacttagagattttaaaatcccctctctgttaaaaagagtgtttgttgtttttttggttttttgttttttttgagatggagtctcactccgtcacccaggctggagtgcagtggcgcgatcttggctcactgcaatctctgcctcacaggttcaagcaatcctcctgcctcagcctcccaagtagcagggactacaggcatgtgtcaccacgttgggctaattttttgcattttttgtagagacagggtttcaccatgttagccaggatggtctcgacctcctgacctcacgatccgcctgcctcagcctcccaaagtgctgggtttacaggcatgaggcactgctcctagccaaaaagaagtgttcttttcatgagtaaggagaaaatgtttttcaagattaaagaagttattgaagacaactaaaataagtgttaaatcccaaattatactttgtttttactttatcaaatgtaaggtgttttttttcagttttcaatactttattggatatttatacataaatcatttacatgaaagacttctaattgtagaacaaaacataattaggggccaggcgtagtggctcatgcctgtaatcctagcactttgggaggccaaggcaggtggatcacctgaggtcaggagttcgagaccagcctggacaacatggcaaaaccccatctctactaaaaatacaaaagttaaacaagcatggtggtgggcatttgtaatcccagctactcaggaggccgaggcaggagaatcgcttgaacccggggcagtggggaggttgcagtgagccgagattgcaccacttcattccagcctgagtgaaagagcgaaactctgtctcaaacaaacaaacaaaaaacataattaggcaggaagtgcatgctatatatattccttttctttcattaattatgcccctagagaaggcaggctataatagctcaagtctagaatgaaaggggtcaccatatacctgaaggtagctcatcctgtttgccagtcatgattatgagaaagtaaagcttcatgtatgctaaccttacaaacccaaatctacaaggtggcaaaactaccataataattgaacgcccattatagctttaggcaaagctagaaattaaaaatcttccccgcctttggcttccccatttgagacagtttcttctccttgtgcatctgtagctcatcttcctttgctgtctctgtacctctcttctaactcattttcatttgcttaaggaaaatatcttttctttactctatactttgagccacaaaatagacactatcaggacaaagataataatagtaccagtgacatacagattaggaaatagggaagcattaaattttgtaataacataataacaaagaaccaagaacatagattgtaagagagcccaggggtcctttacagaatgggccccaaagtttccaggtacctcctcgtttcctccagtcatctgcctttagcagccttcaagagttttcaagttgctttctttccttttgtagttagttgtgctctaatatgttatttttcttcaaatatatgcagtatattgtctacatcgggagtcacagtggtttgtgtgtgtgtttgtgaattttgtatcagtcacaatgaaagttaacttttaacaacacaatccattggtatttgttagatctctgcttttttttttttgcttttttttttttgagacggagtctcactctgtcgcccaggctggaatgcagtggcgcagtcttggctcactgcaagctccgcctcccgggttcacgccattctcctgcttcagcctcccgagtagctgggactacaggcgcccgccactatgcccggctaattcttttgtatttttcgtagacacggggtttcaccatgttagccaggatggtctcgatctcctgacctcgtgatcggcacatctcggcctcccaaagtgctgggattacaggtgtgagccaccgtgcccggccaaatctctgcttttttcagccaggtgtggtggtgcacgcctgtagtcccagctactcaggagtctgaggcaggagaatcacttgaacctgggagacggaggttgcagtgagccacggccgtgccactgcactccagcttgggcagcagagcaagactctgtctcaaaaaaaaatttttttttttactgctttccttttgtggagaatgtagacagaaacctgtaggtttttatgtcaccatagctgtgcatttaactttatgtggctgtgcattcactgcagagcttcaaccaccaatatttctttctccttttcaatgacaactcaattggtctataagcatcaccaagtagcagtaataatggttattatacattccatatttagtatgtgaagtttgtctctaaagaatgatattttcccttctcaggattagctagggtcttcctcagacatttttatcatatttatttccaagctagagtatgcctcagaataataatgaaagaaggaggggttcagaaaacttgaggaacaagcacataatcttgcagctcttggcccagactgatttggccgccctgtctgaggcagtaattgtgggtggatgaatacagcaggcactgctggtaattgcgggtggatgtatacagcaggcactgcggggtgacactgctgctctgttgtctccagtgtgtttgaggagatggtgcaaataaaacagcaacttgagccaatccgtgagtcttgagttacaggcagatgcatttgtggcattcattagaaacaatgtctgcttggataagagcttaaaaagcaaagcatatagagcaggatcggtgagcttctccctttttccctaggcacagctacggtttaagataatagaacactgtacatttaaattcctttttaatgcgatttttaggagaattgaaattgaattttatatagatttttaattgaaaatcataatatactgatttgacactaaggttaagtcagctttggctggattttaaatccagttttagttggtttaaatacaactctgtcagttactaggtatgtgaccttggactagttacttctctaaaggctagttttcgtcattcattgaataagagtcatgatagcagcctcacagttgggttgtgggaattgtgtaagatcgtgtcagtaacattcctagtgcagtacccgacaacagcacaacacatcagaactattattcttataatgtaaggaaaggaatgtattagttatattgggtgttataattataaggaacgaatactaccaggcattatcctttcatctagtttcctttagaacattatttgtttgttttcatgattcacatataaaattttttcattgactatacgtggaaacagaaaagttgtcattttattcatcagtttattcaggatgattgtggtcatgtgtcttctttctctgagttcttatttctttgatgttgtatccatatgaaaatttctgtgatagtatttgtagaagagtacagtgtgtggtcagcaccagtttggcgtaattatcatgtggtcaaacaggaagtaaataaattcttcagtatttgaaattggcacataatcccatgatttctcatatcagcggtccccaattagggaacctacggagtgactataaggaattcactaatctctataggcataaagctttaagtgttgatagagaaagcaatatgacccttaaatgcacgttaaatgctattatgattaatgaaacatatttcatatgaaagccatactggttttatagtgtcatttcatcatttcgttattgttctaagacgtgaaaatgtaaatataccaagattatcacataaaggtagatgagctttattcatgtttaaaacaggctcacttagaaaagagtgaacatccccacttcacattttcacttttcatggatttcacttggagttttagaaagtagattttggatgcctgtttgtttctcctaagtatctaacaatgccatgtcttgtatcctgtatgcagttaacaagtggatgcctatataacagttaaatgaccttggctttacattcactgccttatttcctcagcaaactcccataatagcttgagggtagtcgaagaacagaaagccatttcattgaaaactgtgtttaaaatgtaagaagtctagaaagcagccatttgtaatctatcctgtatatgacacagccattgacaccaaaattcacttctctcttttagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggtgagattggagcgatggacttcctcctctcttgactcttcactctgtgccttatgatgttcttttttatatatccattcattaatttattgacaatgaatgtttattgagtacctgttatattttcaggtaagccatgggtaaacagaaaataaactaggctatgttctcaaggaattcactgaataaactgacaacctcaagaaacttcccactgaccaaaaagaatatgataagaattctgataaggtgctatatgggattcaataagaggttcacataactctaatttgggaggtcacagtgactcctgttaacctctgttcagtatcaacttccaaattggcctaaacaattatgcttctcaataaaagcaatgaaagaattaagatgatttaatggatattgttgagtcagtatcatcttggtatcttcgtttgttaaggtacaaatggattgaaggctgttctgtatattgggtggcccacatggagaatctgccattatcagcttaaatgttcttttctttgaaacactgtggaataagctgaagttctaaatgttattgtagtagttatgctactatacatatttaatacctactttcatgtactcattaattttatcaattaaatgtgcttttttgatttcaaagcacattaggacttgagccgacagtagccccttcatgaaatatatgagagcagaatcacaaaaatgaaatgaaaatttcttttttctttgttttgtgtattcacctgacgttgtggacctggatagtatgggcgataacatagtagtaatacagttatcctttggttattggtgctgatagacatgagaagaataaatatgaataataaagagaattcagaaagaatttacgcatatgagatctattgtgagaataagctcctctctttgcctagcaaaggaaaatactcacatctgtgatattattgtcttcttacattgatcctaccattgatatttaatgatagagtctgaacctgttaagctttttgaggagataggtgtcatttcattcatttttatctatttatgaacaatggatagttgattgtttttagtggtaaaaatcatatgaacccgacacttaaagatgtaactaaagaatacatttccatgtgtcatagtgctatcatcttccggatagtgaaattgtatgtccccatgttaatccctttgaagattatctactgccaaacacaaatggccttctactctctgattctttttcaggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtgggtgagtggataacaaattctattccggcttcttctttaaaaaacagaatttacaatgtggcctttgacaaattatttagaattttggaaacattttccataccacaaatttaattcattttaggtagtcccatatactgaggtatgagtcttctctgatcgcccttgctcccagtcaagttccagagtgttcctccaagcctccctagggtatccagctgttggatatagcttttgaccagttacagaatactattctggatgttgggagtggggagtaattgtgttgggagtccttggccactttaggtgagatgaatagatctccccttttgactgtgtttgatgatttaactcatcttctagaagagaaaagaaaaaagggacttcttaaatataaaatgtgatacagcataatattaaaccatatttatgtgtggcaacgatgaaggctgaatatttcctccaacctggaaaaccatttcctataagtagaagtgctagaatgtcttacaatgaaaaccagaaacgtatctccccctgatgaagttttgcctgtgaaagtgataatttctcaagcccctagaaagatcgtggctcatttgtaactgctcagggactcttgcaggtgcagccagcagcctggcagtccctgggggaagggcaagttttcacccatgggggagtgtctgggttgagaaccagatggcactgagggaagtggaaaatcagaagagtaattctttaacttccctaatctaagattctgtaaaattgaaccaaaatgcctatctcacagatattttctaagtattacatgaggtaaaacacttgctgttgcctgacacagtagatgttcactgtgtacattttctctcccttccttctctggcaaatttgctgtctcagcctttttttcctcctttctgttccaatattccctcttctttttcttcttaccatccattggaatgagggaagagacatttactaaagttaatggaggaaagtcttaggaaacagtggagtctgcatttgtgagtggttaggaaagaaaggaggagaacagaaacatcttctgtatcaaagaaggggtggtcttcagatctaggggatagagataagttgggaaatctaaccttatataaaataaagtaactaagtggttaatctttggacaaagaacatctaatgaataccatctgaagtgaggtatagattcaggtccttggctgatataatttattctaatgaatgatctacttagtttagaaacatttcttggcattatgaacattagctttgttccaacagacaactgagaccttctatgatgcagcacttactcagaagattagtatttgatgttccattattaaatgaacacgcaaagatgcctcttaaagtaagtataggaaatgtttgtagatatttgattactggcttctctgactttattttctatgacaacatatacatttcttagatacatcatgcttgacgctgggaaatttctcccaattattgaaatgggcatagaagttataggaatgtatacatcaacttgaaataaacaacttctataagattatagaaatcttaacattgatttccatggaaacaatggaaatagaaatcaattgaaaaaaaaggaccacaggccgggcgcggtggctcacgcctgtaatcccagcactttgggaggccaaggtgggcggatcacgaggttaggagatcgagaccatcctagctaacacggtgaaaccccgtctctataaaaaatacaaaaaattagccggacgtggtggtgggtgcctgtaggcccagttacgtggaaggctgaggcaggagaatggcgtgaacccgggaggtggagcttgcagtgagccgagatcgcaccactgactccagcctgggtgacagagcgagactccgtcaaaaaaagaaaaaaaggaccacagggaaaagataagccaagatactcttaagttggaaaacatggtaataggcctggcctaaaatattattagaaacctcgagagataaagacgaggctttaaagacaacattttctaagttaataatcacatgacaggttccaattgtcacttcatagggttcaaagataacctctctgtatatgcaattatagtttgtcacacagcatagaaaaatcactggtattttctctaactttattattctgttcaggatcaagtctcactctatcttactgagttgggaatgttttcttgtcctttaatatcataatctagactcagaatatagaatatagtgtttgcatcaaagttatatagtaatgtgatggatttttatagatgaccactctgcaatgccatctagtagcattattttttccccaatggctacccagtactagtgctgaagaagtatgagatataaagagtctatatggagctgttacagtaagcatccctggatatttagcaaaagtaatctttctctatgaaaattgactttggtttaataaatctggatacattagtgaattaggtaaaataaattatatccttgataaaaattctatttttatgtttttttgtcatcttcaatagtccttgtcttgcaaaattttttgatacaaatgagctggaaaattcgtgaaaaaagatacagtctcatgctgttacccttatgcaataaaactcttttacattagagatatgtcagtgttaagccaagcaaattagaactcaatatttcatcatttgtgactcctaaattgtgtggatgtatgtatgtgtccattttttttaactgaaagggaaagtaaatgagttgtaatattttaacagtaagacatgcagtccactttaataacagtaattcttataatttattttcttcgttagatataggaaagggtcaaaatatgtatagtcataagatcattttattaatttgacaaatatagatcaagaataaattatccaaagaactaccaaataattgaaagattctgtgcttgtccttgaccttccagtttagttctaaacaagcaatatgcataggtgaaaatgtaaggagcaacgtagacaatcagtaaagtaataaattgcatccataaccaccaaagaaatgtagacaaataagtgatcagagtagagcaattttggaacttcacttggagaagtaagttttgtggcaagccatagagaggcagagagggagcaaaaagaatcacagatgtatagttcctttattgtgcttctgggtcatcctgacatcagtcccttcattttacacacagattccaagatattaataacaattcattaaattattagtaaatgattaacgtagaactcagggatacatagacatccaaacaacctcataaagaatcctgttcaagatatagttacttgtaaaattgggcgtctggtcttcatattgcaatcagtgttaaatttgaaagagacatagtgtcttagccggggttctctagagggacagaactaataggatagatgtatatatgaaggggagtttattaaggagtattgactcacacgatcaccgggtgaagtcccacaataggccgtctgcaagctgaggggcaaggaagccagttcaagtcccaaaacctcaaaagtagggaagccaacagtgcagccttcagtctgtggccgaaggcccgtgagcccctggcaaagcactagtgtaaatccaagagtccagaagctgaaggacttggagtctgatgtttgagggcaggaagcacccagcacgggacaaagataaaggccagaagataaaggcaagtcaggttcttctgcctgcctttatcctagccgtgctggcagctgattagatggtgcccacccagattgagaatgggtcagcctctcccagtccactgactcaaatgttaatctcctttggcaaccccctcacagacacacccaggaacaatactttgcatccttaaattcaatcaagttgaccctcaatattaaccatcacgtgtagtatacacggtgatagtattctccaagataatttatatgggattgggcaatttcacttcagatgaccttataatgtagcattagagtgtgatatgaggagaaatgaaaaaaaaatataaaaggttttgatagctcattgcttttataattgttttcccacatagctgctgacaaatcattatgaaagatgctggaaatattactgcctgcctggagggtggggaaactttggtgctgcctcagaagaagaacttcatttatcaagaaagttgttctggggcatttttgatgccctgtctcaaaaggtaatttaatggtttgtgggtttgtttgtatcaataaaatggtatagagccacacattcttagtaagatagtattcctagttgaatactatctttgctaaccaagacacgtatggcttgattttttctcttttctcaacttcataacaaatgttgaaaatgcaacttatatttacttaatcattgtggtagcattttccttgtgatcataacactgtttctgaatataaaatggctaagcagttcaggaaattatgcacaaggttgataagtttccggtgcatttggactcaaactctccctagtcccatctccaatcttataaaggccaaagaaattatatccaatataaaaatacaaaacatgaaatcttatgtaattgtaatatcccagtgccctgctaaagtctccagctttgctgctatggagatttagataccgtcgctcaatgttgcattgcatatgtggcattgccttatagttgcaaaatttataatgaatagttcatatgttttcagatgactgacaggtgttgatcttagagaaaaggcagaacaacaagttttgtgtgttcatccttaaattaatcaaaattagtttcaattcccagattgacattattagatgattggagtagtataaccactaatttgctacataatagaagaaaatttgtctgcaattacatttggtagcaacactttaatgctttttcttaccgaatttcctttggtaaactgagtccttttaaaataatgtgtaagtattttttagaatcatttacaacatttatttaacattgaacatttaaagtgaaataaattattactattatttttcagaaaatctataaatataaatttaactgtcattaatatataaatagctcttcctataaatttttagcatgcatactttctatagaatttcttttccagctcagaattttatttttcaaagctttataatgcaacatggatcagttaaaatttctcactctctagaatgttatgctttatgtttttttatatgtagtcattataatgtacaggaattatctataactaactataaggaatgtagtccctattgactgaaattatgtttatctcttaacaatattttacacattgacaatattaaagtttacttcatttccagtgtgttggagagtcaaagattttattctccttaagctgaaacttcagtaaatctagctgcagcttcttttctgtttgatggggttttaggccctgtgtttcattttctggaaaaagaatgatcagagagttcagttagtccagggtaattcagattttcttctgcaaccttctgtcagccctgatgatcatgctgacaacttttgccatatagtaatttttttttttggtcctccatttttcccagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaagtatggactctttctattgcagcagatttttattgtaaatgatgtgtgaagtctgaaattgaataaggtactaaagtgaactttctctaatacatgccccctttgaattggtatccttttaataggggtccctttaatttataaaacgatagtaataataataatgattatactaatatcagaaatagataagatgtaccttctaggatactcttaacacaatcaagactctgtacatggaatatctataatagaattaagaaagtatgtcagttatatttttagttgaaaaattaccctaaatgtttattaataacgacaatcaacctctatataacatcttttacttaggatgtacccagcatgcactgcaaagctgtttctgcgagtagcaagggaatcccttcacccatcactacatctcagcaaggcccagggttaacagctgatgttcagcatgataaaacgcagcacaagatggaagggaatatcaaatgagaatttttatggaaaattccaattgttctacaaataggatgtttgggaacttcaggtgttcgacgtctgagcattttgttgttgtcgttactgtttttaagtaggaccatggttctccatgtgcaaggaaagctgcctcttcatgccaccttatcttactgattctatggtgactcagcaagatcagttttagcaaggtagacacttggtagttattatccacggcttctgaatttgcttgggagttcaactttgaggcttctgagtggcccccagctgatttagcttccataaccagatcagaatttcaacctgagtggtatgccattagtttgataatgccttaaatttgcatgtttggtctttgatgacagtcctgtgagaaaagaccctttcccccatcccccagtatttggcttatatgattgatcttttgtatctcttccgaagtaagtaaaccaaactatcacatattcacattcctacatgggtaagtttgtggtttgctaacatatgatctcatctgagatttttaaatatcagaacaatatcatggttttggtgttggttgattaaatccaattaattaataagtgtgggcatggatattaatttacctaggcttgcccctttggggacttcttaacagatacaggtttatgtggtgatatcagtgatttctagacgattacgattttttatatattgcttcttaagtatgtgtatgtcttatagttcaattactgttaactgctggaaaacaacagcaaaccatcttatactagattttatgtagaattgtattctcaaagttaatactttaataagatatatttattaatgaatagaattatgtatgtatgtatatatatttaattttccattcatagatacgttttaagccttagatttatcatcagacttggtcatcatttgcatgtcctcaacatcaaggaattaaatattcatttaaacacaaaaggagtcaagattaaatattatcaaaaagcaggagttaattattttccctatagttaataccagtaacatttacagtgttatttgtggaccatgtatatttaaaaattttaacacatcactactaaatttagtgcttgttttttcttttttgtgtaatctattgtcctaatctttgaatgtattttaattatttcaatttatatatttaataataattgttattatagttttataatatgtaatttgttatgttagcacataaaatatgaatcaatataagatgagcagatagaacattatctgcttgacttttcttatattgttgtgaaaatagaaaaatgtaattctaaaaaaagaagtcgtgtttaacagttaaaattgaatgagatataagcattcataagctgtgagtaaattattaatatgatttcctgtaaattctgtgaaaatcaagctcttttgtctttacttttctcatagtattacaattcctgagaaattggaatacttcattaacaaatatgcagaacactcccatgacaaatggtcaatggacaaggtaaaaagagtattacattctaattcagtagtcattattaatgactggtcactgttcaaatatttctgaccatgacagttttctgttttaaaatgagaacttgatctaaattaggaaaaaatacttaattacaattagcttatataataatataatatttagctagctctatcattaacacaaatatgatacccttatgaataagcactattttaagctttcaaaagatctattcattaaattataaatatagtttctataacatatattgtttatcagagtaaaaaagcaacaatcaccaagagcttcaggaggaaatgatgactccgggttcagaattcaccttttaaggaaactttggttttatatgtaggtttttttggtttattttttgagtcctgctctgctgcccaggctggagtgcagtggtgtgatcatacctcactgcagcctggaactaccgggctcgagcaatcctcctgcctcaaccgcctgagtagttgggactacaggtgcacaccaccataccttgctaattgttaatattttttatagagatgagatcttgctatgttgcccaggctggtctccaactgttgttggcctcaagcagttgttcagccagcctcagcctcccaaactgctgagattacaggcatgagccaccatgcctggccaggttttatatgtagttctatatcagataaaatcttgaaaattcttaatcaggatttaacaattatttaccttttctattcttctgttgtatttcttactaccaactagatctgcagtttactaaaaatagattacatcggccaggtgatttttttgtgtgttttcaagaaaaacaacagaaatgagaaaactaaagtagctgcatctatgagataatttctacatattataagttttctaaaggaaatcttatgcctacaggttcatgtttaagttgagcttagtctaaacttgacagaggataaagtaggttcatcagaggagttgagttgagatagttcaagaactaaaatacttctatattggtttggcgaaatgaaaatcagacaccaaaggttgcttccagaggatgtgtatgctacgtaacaaataaagatcatcatgctggagatgtcatgttgagtttcaaactctgccctggccagccagtctttcggtccctctaagaaacccttttttgttggttttgataagtatctggttcttcattcagtaattgatttactaggtaagtcagtaaggatctatcttatataaaaactctgctaaatactgagtgggtggagttggtgatggagaggaatattacaggaaggttttccagtctaattactcagattctgtaggcagacaagaaattatatagggaaatggtgatatgtacagatgggcaaaataatatggaatgaatgtgttgagagaaaatttgatgaaagaatgggtaaaacaggtggcattattcagagaagacgctgagatgcatactctagttttcctatttaaaatgcatgttttgtatttacacttcataggtggggtcccaagatgggtcagaataaatatccttgggaccatgcatccctctagcctcctcctgtgggaatgcttattggcacaattataagaccttggtctgtttaaggaagatcaagtgcttctaatctctagataaaagacttgttccagatgattactgaaaatacatcatgcaatatgtccatgtaacaaaactgcacatttactccctgaatctgaaatttaaaataaaagaaaatagcattgaatatctttatagtgacttatgctggataaaatttcaatcttaacccttaccttagttcattttaggtttattttatcaaacacgcacttaaacacctgcatatctacaatctctaaaattaacacgtgtaaaacaatttttaatgtttgcctttttttaagttggcaaatggatggatttatggagaaatatattcagactcttctaaggttcagccattaatgaagccatataagctattgtctgaaaaggtaaggattttttgtttgttttagtttgtaaagtttttattcttttgaaaaatgtgttttttggttatattttttatattaaaatgtcttctttattttaaatttcacattttttcttccaaaggtcccgtttaaaaaaaaaaccttcttatattttgtcttttcctctcaattcttaatttctgtcagcctttctgtgtttattctcttctctccttaacatttttcttttcctttttggtttttattcctctcccatatttttaagtactttaaaaaatcttcttatcatgcttaagagtttcttgatgagtgatgacaaagtaataatgtgcttattatgtatagattttcatatattttacttctttgggaaagaaatgagtatcttgacaaatgaagtgaaaaggatttcacttcattgtgagtcacatgtatattacataagctgtcccttttttctgtgtaaggtcctaggaaccgggttgctaaaggaaattgaccttggtgctatataatgaacaaagcgaggatccctcttactaacattagtaaaactagatctctgctcacactctgcttttcagaattttactttcctttttatatttttaaataagctatgctcatcaaatttttaaaaagtgaaggcagtctattttagagcaaagcgttacttaacatttttatttacattcataatatatctgttgtttcttgttttttcttctctaggaaaaagaaatttatcgctggccaatcaaagaatctttaaaaactatgctggcttggggctggagaattgaaagaactcgggagggagacagcatggccctttacaaccggactcgtcgtatttctcagacaagccaggtaagaattcatcacggtgatgaatcaactgtttatgttatggattaaataattttttaaatttaattattgagtttttctaaagaataatctgaaaattctgaagagtcacaaaatttagaagggagagaaaaaagctatatatatattttttttagtttcaaaggaggttaaatgatgattaagttactggactttatgtacaagccttccttttcctggctagtatagaagaagtaaccagttgtaggacatggatgaagctggaaaccatcattctcagcaaactaacacaggaacagaaaaccaaacaccgcatgttctcactcataagtggaagctgaacaatgaaaacacatggacagaggaaggggaacatcacacaccggggcctgtcagggagtggggggctaggggagggatagcattaagagaaatacctaatgtagatgacgggttgatgggtgcagcaaaccattgtggcacgtgtatacctatgtaacaaacctgcacgttctgcacatgtaccccagaacttaaagtataataaaaaatttaaaagaagaagaagaagtaaccagttgtaaggtcctgaagttttcctaatgaaaacagtacatcatgttcgtttgctacagctagtttgtctatagggctttcttctcatttccagtgggatctgagggttgattcttaggaaagagtagggtgttcagacagtcatgatccagatttagaaggcacaagggcgctcctgtctgcagagggaaggtatacagccacacaggcagagcaagaattcacagaagatgttgctgctggaccatgtcaagggagttcgacaaacaagcaaggctctacccataggtcttcggtgctcaaggtggcaagagtaaggcacagccttgatgtggaaaagctagagttcagggaggacaccaaataccacccgttaacatttagtcacgaggtcatgtgagctgcttacctttgaccccctcatttctcctgggagctaaatctgtcattattcttttcctgacccctcagctcactatgtatgtggtttacaccaaatattgtttattattgctatttacacaaatatcatttttgaaaaaaaaatgagggtctaacagcatgtgcttcacatgctccatatttgaaatatacttttaaataaatttgaccttggtcaaattttaattttaaataaattgagttctgatttgggcatactttacattcaattgtctttgggatgtatcatatatggatggaagctataaaagtgtattttatctatttttttgtctgtgtacttttctaagtagattagcttttattttaatctgtttcaacaaatgctgagcacaaactgcgtactagataataagaatacaaagatagcaagacaattctaatcctaaaagtcataaaatagtgttagataaggtcaagttaaatctactacaacatggtatggtaagggtgggactagtggtatgaataaggcactacacagtatagagaaagggatgtttttttttttaattattctgtcaggtagataagaaataagaaattactacaaatggaggtgactttaggcttcatgaaaaataaggtagattctcccactgcccttaataacaaaaattatgtactctaatttaaaatcatgtatattttatatcactcctctttctctttctcctttttgttctaatagtaagcccttaatagaccctattaacccgtgaaaccatctctcatgtcttagtgattttcacggtgacatgtgatttttgaaattcattcttaaatttcatatgcgatttcaaaatattaggcgatgcttgtgccagaggcacagtttatgagataagaggaagggctatggaatttcaccacttgggcttaaatcctggtagtgctactttctaaagatgtacctttgtgtacttgatctctgtttgcctcattaagtgtgaattcttattgttactattgttatgtcaatatttctgtggagggcatttgttgagagcatctcattagtggtaaatgaaagagtatatttgtgtttgtagcactttggcctgtaggtgggaaagaaagaatatttctataagcctcagaaatggggagcaatatacaccaaaggccacaagtctatttataacttgccattattttcacccaaaggttctttaagcataaaccaatattatttgaaatattaacatagattgtcgtttctccgttacttgccttatagcattttcttttttgactgtcatcttgttaaacctcttcgtctttttttatgttactgatttcctatgtgattataaagcaattttctatcatgtataaactcttctgactaaaggaacactttttatagcatcattttataaaaggaatacaaatggatgagtgaagatcatgtgtagatgtgattctgagcctgaattcctcagctttttttcactggggcttagcactccctcagggacacacaagtggcccatggttaacggcagtatctggcacagccaagcctggggtgacattctggtctcacccatgagtacctagctggtatcgtgagcttgggtaaactggttaacctctgtatgctgcagttttctcatttttaaaatgaagctggtatgagcatcggctttgaaagaatgttgtgagtgttctggttatgatgcttgtcaatcacttaaaagaataactggcatatatttcaatataggtgagccataatttttgtcgttatcatcgttatgtggatcaataacctgatgaatgtcctttgtttaccatgaataccacaggaagacatgaatcctgatttcaggaaatttactgtccacttagggttttataatttgcatatgtaagacaaacttaaggacatgaataataccagtatcaacttgacagaatatacaatagagtatataagggctgatcaaagttacaagaagctgattggagaggggttaactgggtgggttttgaccccctccttggtagggatactaaagaaaacagcaaaaaacatttctgacaatttcaggcatatcccacaggttttcaacaattatttactcccaaattccaatttcttaccttgtatctgtttttcagtactacacatgtaggacaaaaactatttaaaacaaatgaaaaataagcttataacccggaaggggaatggagattagaatgaaacttttggaatgtgtttcttatctagaactaaaatacaagataggatagaggaatggtgcattcattccttcaacagatacttattgagcacctattatgtatgctgcattgttctaagcttttcaaatagatcagtgatgaaatggaaaaaaatctctgctgtcaaggagcttacattctaatgggggaaataaacaacatacttgaaactgggcaaatttcaaaagaaagaggttcaatggactcacagttccacgtggctgcggaggcctcacactcatggtggaaggtaacaggcacatctcacatggtggtagacgagaagaatgaggaaccaagtgagaggggtttccccttatgaaaccaccagatcttgtgagacttattcactaccacaagaacagtatggaggaaaatgcccctatgattcagttatctcccactgggtacccccgacaatatgagggaattatgggagctacaattcaagaggagatttgggtggggacatagacataataatggatgaaggggagtaacccgagatggttgccatggattctagcttgtgtccccaaatcaatagctgtgttaggtgaggtaaagaccataggagtgctggggacagcaaggagagaataatgactttgattttatatgttgtggtgggcaaaattatgactcccaaatatgttcacccactcctcactacaactgtatgggaactatggtgttgatagcagttatggtggtagtagtgataatgatagtatactaacaatgagaatagccatttactaaaattcctgatccatttctttgtgtcaggcactttgctaaggattttacatccattacctagtttcataccaacctttgaggctggtggcctatttagcatattaaaagaaaaactccaggccgggcatggtggctcacacctgtaatcccagcactttgggaggccgaggcgggtggatcacaaggtcaggagtttgagaccatcctgcccaatatggtgaaaccccgtctctactaaaaatatgaaaattagctggtgacagagatgcgtgcctgtaatcccagctactcgggaggctgaggcaggagaatcgcttgaacctgggaggcagaggttgcagcgagtcaagatcgtgccactgcactccagcctggtgacagagcgagactctgtctcaaaaaaaaaaaaaaaaaaaaaaggaaaacttcagacaaattaaatttaacagagtttaattgaacaaagaaccagtggcagtccctgaaaccaggacaggttcagtgagagtttggggctgccctgcggctggataatgtttatagataaaacgggatgctcaaaaaacagcagtgaggtacagagaaagctggattcattccaccatggtgtttgccttctttgaacaaggtttgaacagtgtcctcatggtgaaaggcacagaagccagggtgctgtcaaaactgacccgtaagttaagtatcgctcatgagcctgttattagttatagcatatgtaacactcacttttatttcacaagcatgataatgagctatattttcattttgtttttagtttgctttttgggcatttttaatgagagaatatacataattatggaaaatatcaagatatagttttagatttataagcaggaaccagagctcatttctgtggtacactttcacataacatgccattgggtggaaggaggtaagtgcccaggatggttagtgaaacttccttaaaattgataaagaggtatatttcattttttaaaagctttaattcagaaattaaagaagtctcttcctcgaggatttccaagtgcattgctgaatactatatgatatactatgataatttaaaagttggttatactttatcctaacatttgacccatcaagacatttgtaaatattgacgtctttgattaactcttgcttgcgtgaggaagagtaaatttcattgcagccaatttggatttgtaagaaactcaaaaatgtaatgatcctctgcataagataatgtttcagaattttggattcattgcacaatacatcaaattccgataggcaattttcagaattatcaatcataaatcattttcagacacccaaatataattttaatgtgcgagatgtgtttacaacatcattttgtatagaaacttgccagttttatctaaggaaacactatgtttggaaatttgtgccatatttttaaagtataagttaagtctctcttcacaaggtttttaatgaggcactgttttttcacacaaatgatctaggtttctgtggacgctgcccatggttacagtccccgggccattgacatgagcaatgttacactatctagagacctgcatgtaagtactattaacttttaaaaatagtctccaaatttaatttttaagaagcataatgtaatgctttcctgcatatatttggcagcatggtttatttgaatgtggcgatctataatggatccatggaatttatagattatatactctaattttttaatgctatcaaaattgatagctgggtgtggtggcacgtgcctatagtcccagctacttgggaagctgaggcaggagaatcgcttggacctgggaggcagaggttgcagtgagctgagatcacaccactgcactccagcctgagtgacagagtgagactccctctcaaagaaaaaaaaaaaagttgatacaactttttctagggtgtttcagccgtataacatattttcctttaatagccatttaaaaatctctatgttaaatagttgtgtgtgagaagaaagtaaatagttaataatgctctgtgcaagggccaccttcttttaagtttttccagagacattgattgcatttgcttgctccattcatagtctcatctgttcttttttgtcaccaaggaacctactttgaaatagcagatttgaaagtaagataaaatttattgccttgagacataaagttaataggtcaatatggtgttcaaataacatattagcattgttggtaactgtattgttccaagagaaataaggaccgtaaatataaaatttacatattgttaaattgtttggtttgccatttgttattgctcccatatgaacgtattaaaatgacacagtaaacttgaaaatcaaatgtagaaagaatccgggaggtaatcttatcaaaacccaaaaggtcacagaaagattaacttggctagtctaaggtctctcacctagtttggacagagattgatttagaaatcaaatctttgactgtccatctaacattctccatattcaagttgcataaggtttaggtcatttttaaggctttggaaattaaaacaagaacttgtaaatacaaatagtttttctgaagtccatagctattttggtttcattattgaattaatgtcttcaaacattatgaataacaatgaccattttcatttgctgtttagttactgtataatattgcaaatccttacaattctctgggattcacattctaaagaagagtgtttgatatcttttaaatgtatcatagcactaatactgtatgagttattcctttacggtatctaatattatatattagaaagcaatattatccttttttacttattgaaacgataaatatttttgttcatttaaggctatggcagaaatgatggctgaaaactaccataatatatgggcaaagaaaaagaaaatggagttggagtccaaaggtaatattttctaaaaacgtttattaaaaaataatctgagctcaattccatgagtgtatggatgaagtcgtcttcagcacaacagcttattataactttttaaaatcagaacggtttaattgtgcctgtaacagattgaagttggaaatgctgtaatttcctagtggctagtatatattttcttgtgtctcagaattttgacagctttcttttacccattttagcttacagacttctgtacttctcatcctgatatctgagttgttctatgaatgacttagacttccctccctgactctcttccccaacttaaatatctcctatctcacccctttttatttcctatctcagcctcttttgtctggtccagctatgttactgtctcttacatgcttttgcttgcacttttcccgtttttttattcaaatactaaatgaactaatgttctcttagttatttctcaagtcttttaaaatttatttgcatattttcttcagtttaacgtatgctatgctgatgatatctttcaacattatttatttgccgttagtctatacacatattgtttataatgtggtgtctgtgtgtgtgcgcgcatatgcgctgtcgttaatgacttcctatatggttttctttcccctgataggaatatactattttcgagctcagggccacaacatttatttcttttgtaatccttattgtatagttacaggtgccaataaagcttctactttttatttatttgactaggtgaaaatgtagaaggggagaagattttgaaagtggggatatttcatggtgaaaggtaaagctgtgatatggaaggatggtacctggcaccaagcactaggaaacagagtaacacaaattaggattggtcacagagaggaaaagagaagattccacattttattttttattttttttattttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgtccttaatccatttaaccctgagtggacacaatacatgtttcagagagcacagggttgggggtaaggtcacagatcaacaggatcccaaggcagaagaatttttcttagtacagaacaaaatgaaaagtctcccatgtatacttctttctacacagacacggcaaccatctgatttctcaatcttttccccacctttcccccctctctattccacaaaaccgccattgtcatcatggcccgttctcaatgagctgttgggtacacctcccagacggggtggtggcctggcagaggggctcctcacttcccagtaggggcggccgggcagaggcgcccctcacctcccggacggggcggctggccgggcggggggctgaccccccccacctccctcccgcacggggcggctgccgggcggaggggctcctcacttctcagacggggcagttgccaggcagagggtctcctcacttctcagacggggcggccgggcagagacgctcctcacatcccagacggggcggcagggcagaggcggtccccacatctcagaggatgggcggccgggcagagacgctcctcacttcctagatgtgatggcggctgggaagaggcgctcctcacttcctagatgggatggcggccgggcagagacgctcctcactttccagactgggcagccaggcagaggggctcctcacatcccagatgatgggcggccaggcagagacgctcctcacttcccagacggggtggcggccgggcagaggctgcaatctcggcattttgggaggccaaggcaggcggctgggaggtggaggttgtagcgagccgagatcacgccactgcactccagcctgggcaccattgagcactgagtgaacgagactccgtctgcaatcctggcacctccagaggccgaggctggcggatcacttgcggttaggggctggagaccggcctggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagctgtacagtccagcttcggctcggcatcagagggagaccgtggggagagggagactgtggggagagggagactggagagggagagggagagggagagggagacgggagagggagagggagagggagaagattccacatttttaattgcctatttcaaaatgctgctcagggataatatgcctgtattctaaaaccaccccataaatgtttgttaaatgaatgattaattcattgtttggctcatggatgcatggatgaatggatggatggcaaatgagtcatagagttttgttttgtgaaattcttgacagggtattgcccacataactggtaaacaaaatcactgcttattacatgagcagattacatgaaaaaatgtctgttcctttttttaaactatgtttaagtcactgtggtacagttaaattaaaaataataagcagctatcttattacaggttgattatcccttatccaaaatgtttggaaccaaaactgtttgaaagttgagatttttttctgattttttaaatatttgcatatacttactggttcagcatcccaaatcccaaatccaaaagcttaaatgctccaataagtgtttcctttgagcatcatgtagatactcaaaaagtttctgattttggaacatttggatttcagatttttagattagacctattcaacctatatgcttttctaaataagcatgatagaaaatcatcattatttaaatttctgagccagatcgatattttctttaagtcataccactcgtaaatggcacatccatacttctgcatacaacttgtactggctcaaatttgtattctgtagttgggaaactaacctagtggcagcagactaagtggtgaggtaggggaaattagtcctcgcagtctttaattctcttactgcatgtatggatctcatttttaaagaggaactagtttagaaccaaaatggcagaccagtaggaaacgtgttgaactatacagtcaggatcctggcttttaggttattgagattagcaaaccagagaaatgagtcttgggcatagaagataggttacagactgtggccagtttcagagcagaaacgacatgtgtctttttttcaaagttgttttctcactcagagacattaatagtggggaggatccttatagccaacagttgtaggcagttgcatcctgccagctctactcccactgccgataagaggtaggtgggaggaatctgtcaccacctgatgtcttggtgcctgggtgtgtgtgtgtgtgtgcgtgtgtgtgtgtgtgtgtgcgtgtgagagagagagaaatagaaataagaagtcagaaacactaaaagaatcagggccaaagctgcacagttttgttttcacccattctcttctcttttatcatccctgcatctgtgcagagaagatgaatctgctttagggaaatcaggagaaaaatgcctcctttgcttgccttagtcatctgatcctcagtgctcttttggaatctagaaaagtctgagggaaaatcagatgccataaggagttaatagaaataaaggagtgtaagtccaaaaagtatgattagtgcccccaaattagtaaaaaatgttattttcccactgccacttcaagtattttgtaccatggtcatctgttgttaagccacagacagcccactgctgtcaagcatttttttactgtttagtatgaatgggttcatgagtccgtgctggtatgtttggtaatatcctcagagttactgctcactcatttacctctccatgtagctgatttccttcagcacaagatgtctacacccatatcataaatgggaaagttgagggtggaggagcaacgtaaatgtccacggtcacactgctagttagaggcacagtgctagttcagtcacctggcaggctttcagatcccttcgccatctagttcaatgaaggtcgaagagggtgagaagagtttcagagttagtgggtactttgcattcttaggatttttaaattatagacctctttaaagcatctttctctttctctccccacttcccccacagtaacttattggtatgcggccccaaaatcactgattacaaattaagttgccaaattaatagcattctctgggactaaatgcagtgatggagttcaaactaggtgatggttgattaaattagggtgatggaattcaatccttgattttaaaaagatttttgcttttatttttaactgatacataattgtctatatgaggtacagtgtgatatttgcatacatgtatacaatgtgtaatgatcaaatcagggtaattagccaacccatcacctcaaacatttatatttctttgtgttgggagcattcaaaaactgctcttgtagctatttgaaaatatataataaattgttgttaattatagtatccttataaagtgtcctgtttaattatatctttgattaggacaaaagtcaaatttggtttctactaaacttagtaacatattctataccctctgctgttcacaagtgtttgttattattgtcttctgacaactgtttgtgcttgatattattaatatactgtgaagtacctgaattccttattatggttagtatttgttagcttggtagttcttgaccagcaccttccatgtatgatagcacagtgtcacctaatggtattaaagttcagtgggcgattgcatgtctgtagatggcgctttcagtcaaagccagcactagggaagcagacatttcctcctttgcttgcttatttattgtgtagggctaattcaacatttgtgattgttgcagtagctcctggctaaactatattggaaactgatttcatagggttatgttgttacaattcaaacaatatttattctcaattattcttcctggaattcccttagcagttgtatttcagggtagttgagcctctcacacaatatatattaccacacatgttttacgaatgttagatgtgaggcataccatgctattcggtttgctgctgttttaatagcattctttgtatcagatctttacatctgaaattaacagtttaatttttttataatttttgcaaaattttaaccaaaatttttacataatttataattttagaaaggtttttctccctattagtttttttaaatttacatattttctagaatttttaaatctgaaagaaagactacttttagtaagtattatcaggataagtatactaggaatctagactcttgctaaaatgtacttgcccacgtggtttaaagtcaagtattagacacttaagagtgatccacttttaatgtagcacatctacatatggttttgtgtatttataaataatgtgactatgaagtactctctgatctgagagatataatacaaattccatatttaagactttttctcttctctctgtgcgacagcagatgaagcataacccctgaaacatgccttataacttttctaaatccagctaagtatgatttagcatttgtttctactctccacattcagaattgctttgaacgcagaagagaatacagctgcttccctctcattggcgagtgcagatattattgtcacttagtattacaaatgcatgcatgttcatgttttaactgcctcttagaaggcatatgcacagtctttctgtgagtagtttttctgaattaattgaaacattaaaggcagtagaggcagaagagtcttatatgctctatgtattattaaaggatatggaaagttttatagtgtggtccaattatatatctgtgtctcatctcagattcttttcaaattactatgctgtgttcttgtcctgacatactcttaggaggaggaaaccatcctctgctggtgccctatgatacactgacagccaaagagaaagccaaggatagagaaaaagcacaggacatcctcaagttcttgcagatcaatggatatgctgtatccaggtaaaagtacacataccctaagtacacactcttttcacaagagtgaatatttaaatatctccatcatatttaaagctgaaaatgaattcaatgatctgtttacacttttgaggtactgtttaatatgtttaaaatacacacatcagaaacattaacacccctagctgtgtaccatataactgagttccttttgctacatatattaaatcagcatccatcatttaggcaaaatccccaggcaaaaaatcacactctgtttttgtaaatgcaacacttcgttgcatagtaagagagtcactcactgaagctttatatcatatgcaaaatattctttataggttaaatcttactttttctttgagctacaataacattagaaaaacttcaaaatttatatatatagataaacatatatgtatgtatatacacatatatatatacacacacacaattttaccttctaagaggctttgtacaaattgctttcccattttcatttttgctcttccagaggatttaaggacctggaactggacacgccttctattgagaaacgatttgcctatagtttcctccaacaactcattcgctatgtggatgaagcccatcagtatatcctggagtttggtaggtaccatagtcccattgctaatagcccagtgtttgttgtttttaatgtttacaacatcaggatatagaacaacacaggctgctgagctatttgtgatggtataaacccatctattcatcctactactaagtagagttcaacggtcaatggatgaacaagttcttggggagtgggtaaaatctgtgaacttttaaaaatctaacatataagttattccccttataatgtttattggcatttatttgttttcattttgaaagatacattggaaggacatcagaatttgaaggtagagttaaatctcgcctatgaaatcagttgctctactcataagaaaaacttccaaaactatggattttcaaaatttctaaacactatagaggtcttgagtttagcctttgcagggaaacacgttaatactagagtaactgctgtgcagaatactttattattgctcttagggtacaatgaaagacctcttccccgtctggcccagtgctgtctcaaaatttttaaaacctcattctttaagtcttagattcagcacagatgatgaaagcagcctccggtcacttctgttattttgtggtcctcccacattgttgaattaaaattcgacttgttaatttcttaccttaatgtcagagcaccttccagccactgcgtagtaatacgatgtaaggaattccagtttgttcccttttgaaaatagtgtgcttttctggtggttattcatttattttcattttcgttctcgacgttttctctttgtttttaacactcactccttttgtcattcaacacctttcctctgggaccattcatcttggatcccttagctgctgtttgtcttaggatgtaaatctagtttctgccatagcatcagattaaagtttgtagaaattagagctctggtattttcttctttctggcctcttgtatcctaaatgtgattaaagattttccaattgagcatctttctcataaacaattgacttctctttcagcctgcctctacagttcaaatactatattattgctctctttgagcccttctttttcttaaaagcttacactacaagctaatttataatctgtaatctctctatgactcatataactaacaatttttaaaaatatgattcctgacttatcctgatacgtagccaaattaatctgaattaatgaaatttaaccgaagaacaaaaatgaggtaggggtgaattattgaagcttttacacacaaagctaaatattgcaatttctgatctacatttgaaaggatccgatatgcgtagcaactccaatatccagtcttgtttttggagaaacaagggacaggagagaaagaaagagtcatcatttggagaaaggaacaagaaagtcatttgttttttactttcacattggagaacacaaacaccaatatgaagggaagaaatgtatttaggtattattcacagtttattcaaatttctgaataaactacctactacagttttcttgtatgggggtggggagaatcttgctccagggtacatctacccacttgacacatttcattctatccacagggtagagggccttataaacagagcacaggagagaaagtaggctacaatgacagagcccagccaaataacctttttcacaactcctgatgttgtgtgtaccgttttcagatggcttggccagggcaaattaggtacaagaactctgttagaggagcagatagagctgtgattgtcaatatcgtgtttattttaatttccatctttcattgttatcgcaagtgaaactgctatattgccttctccctttatccttcactttggagattttgcagcatatctctaatgtagccattcctagacctaagttaattgtggtagtaaaaatatgcatatgcctttttctaattgttgtataataccgtagattgtaatctctccacatctttttcacattttgcacagaagcattttttttaaatgtagtaaaagacatttcctatttaattcattgaaatatgagcagatttggctgtgttcaaaattttctcttgacataacttcatatgagaaagtctcttatatgaatccagccattttgcataatgtgcttaagagagattcaaatgccaaagtgccatgcaaatgaaatttgcaagtgttaaaaaaccataattttcttttacttgttcatggggagagcattctgatattgcaaaataattgcataagtttcctataaattatattgtatttttgtctaaaatttgataaactattatctcaagttattattattatattattttgcaaaataacttcttcaagcaaaagtcagcttggctcttgaatatctggaagctctgcttacaaattttactaaaacctgatagctctccaatatgttctgcatgccatcgttgttattatagttgattattacctcgtctattaatatatgcatgaaccttttccatatgcatgaaggaggtgagaaaggccaccttctaagctaaatgaattaggttaatcaattcttgaccttggtaaaccatggggaaaacttgggtgtttttgcttcacttatgaaaattatcttttgacataggtcaaaatttctttatgctttagtggaatgctaatttgccaacctaatattaaaattgctgtcctcctcctcatcccagatcctgacttcctgcagttttttagtttgtgtcttaaattgagaagctttaactttcggtcacacgaagaggcaatctttattattagaggccagggttaatatctagccaattatgtttattcaatttacactcactgtcctcttccccagtgagcttcttttcttaaaggctactgaaaatgtgggacttttactctattctattccattttcccctctctatgtcaataagatctcaaagctacacaaatgtgtttgtgtctctaaccacaactatgggctgtcctcaatagctttttaaatttagatttgggtattaaacatccttttatttttaatgacactgccaaagtttgcctttatatttttggttggctttttacattcagtttagcgggataatacatttagcaatgctttctaacctttgcattatggatgaatatcttgcaatgtttccagtgcagcatttacctaaaaactcttcaaatctacagatggtggcagcagaggcaaaggagaacatttcccttatgaacaagaaatcaagttctttgcaaaagtacagtatacaatctatcttgtttttgcttcaatatgtttgtttacataccctactcattagatcgttgcccttttcagaacatacttgtctacaaatgtgtattttactgcacgtaaatattctgtggcatgaaaataactgcatgaatcatcttcccagcattcttggtcagactttaactctgcattccctaccgcattccttcttcaaatgacttcattctatctgaggtttaattaggtctgcattttttttgttttatcatatgatatggaataaaaaatatctatttcttaacatttggatattgttatgatttaaaatttctagttgagaatttcttttataaataggaaagtctgagttaattcataaataggcacattataagaacatttagtacagaatattgtgggaccttagtcctgctcattttatggaagatcagagaggataaattgtttatatacaaaatatatcccattggtattatttattttgtttcataagcatttatcaggaatttgctatattactggaaaattcatcacttttttcagccaaaaagggatggacatgaagagttgtaaagtctccgaatgatttaatgcatttacttagtatttactgtgtgtctagtgtgggtcaggcattagggtatggcccagggatggccatgaatatacaaatgcccctgggtaagctttcttgtttaggacaccttgcagtgagcctgaagacctaattactgctgtctgcttccttttaaagtacttgcattcagcgattacagataatttgctataaatacaacttttgtggactttaaaatagcatgctttttgattgatgaatatttgacttgtagtatgttttcaaaattgtgttctttactgtaaaacacatttctgttgtcttttcttcccattcaatatagcactcagagtctgttccaatcatttgaagatccaaagtttgtcctggggtgcacatagttagcgattcatgaattgatagatccatatatatatctccggtctctgtgagattgtaatctttcttgatagccaattatcagaatgctgtattcgcagcctctaattttccctttaaaatacattcttgtgttgcccgtatactcagcacccccggtgcatctgtttacagatgcttaatgtggcttaatttctactaagtctataattcattcgtttaccatattgagtacctactatgttccagtcactaaattcaagcaatgtcccaattgtcaaggaagagcaataaaaactggtgtagtccccattatatatagctgtgctctaccacatggtaggaaaaagaagtatgtttagatagacatgagtttgaatactggtagtgccgatcttgttcttgctatgggcccgtcacagtccttagcactagggattcagtgacaaacagaagagaccagttaatagttctggaggccaggaaagggctataatgggaaacaaacccagaaatgtttcttgtttttgtgtaactcataggctcctggaaagagagactttaatccaaagtcccacgcatacaatgtaaaattgcaaatgatgttatcagagctcagaatgtgggactttatctagttgagatcagcaaagacttagccggcaaattgccactgagttgagatctacaggaggaccagagtgaataggatatggagtatgggaagagcacgccagacagagggaatggcgtgtacgaggccaggtgatgtgagtggacagagtgaggaggaggaattggcccaaggccagcaggatgaaacatgcgtagaaatggaaagtgcactttaagaaaggccaggttaaaagaatattgtgtaggcaactaagtagcaatgtgaccttcggtaagtcacacatttctatgtctccatttaatacccataatgcagggatgatggcatctaccctacagagcagttgctattatcagttgcaatgttcacacatagtagagactcaacatatggtagttatggattattttggggtctgctgggcactgaactatgttatatgaaaacattgagaatatttcattttgagaaaatagtgagaataattccaaactgttgcaagtttgctctgttcaccataatcacatcctgccactgtggctggagacggtagagtgagatttaagagaggcatactatgacgtgcctggcatggacataaggagacctgttgcatgtgaacagaactctgactgctccaaagcctcagctcccattcatcccctgaaagattccactacgtagatctgtcttcttttcctttctttcaggtcgttcttcctttaattgatcagtatttcaaaaaccatcgtttatacttcttatctgcagcaagcagacctctctgctctggaggacatgcttccaacaaagagaaagaaatggtgactaggtaaacagctataaaaataagcactgttgtatgacttaggtgtatatgcagttgcaaagaaaacctgaggaccttgaagtggggctgtacggagagtatctgcccatttccctggtccgtgtcttcatggaaacaaatactagacaaaaacagtttctacaagtttggatatgtgttctagatgttgagtttctttatattttgctgctaagtgtaatggtggatagaaggataaaatatcactcatttcacaatctacacatagaggccggatatgcatcaccctattagtatttgtgataaatggtacttttgacattagtttctttaatgtttccacaaatctgatatttttgccagcatttattgttcagaagaaaaccccacatatacaaatttaatttaaaaataatgaccaatgttggaagaaaatgaagtaaagatacctataaaatttctgaagctttcccctcttaacaatgctttctcatttctgtttaaaccaaagggttctttatggactcagttgtgattctgctggggatatcaggtccttttactcaaacttctgctagaatttaatatacatgagaatcaattacagagcaagtttacttctctaatattacattgcccaaaagtccataccaagcttttagattgtatcggaacaaaatttctataaaagtgaatacacagtataaagcagaacactggagaaaatacagactttccttggacttgacgtcgatgctgtgctgaaaggcagtacggtctccacctattagacagagtgagatgagattgcatacagcctccgtgagagggtggagaagtggaaagattcctgcactacgtaacactggggaatgcagctggagtggaattgtcagttcatctctttcacttattgtctattttaccaagtagcaagtggccagtcatgtgatatgggattgcaacagtataaaacatgtcctcaaacttcttcaaatgataattttcctataaaattgattatagttaaaataacagcaggaatccatcccagcggcgtgctttgtttccacaaattgctgccacatggagagaggcaatgcagttactttccaagatgtgaatttccaccccttcccacttgaacatggccttccttcccaccttcactgggagggagagcagctcctccctcatcatttcataagcaccacatccagtactctgggccagtatccccctgtggattgtgagtgcacgcaagtagctagaatatctcaaggcaccaagttacccttaaacgtcgtgaaattgaggacacgttgaagtctcctactcctccctgggtctgttagcctttttaaataggaactttgttctcagagggtgttgttaatctagctatcacttagttacataaagataaaatcagaaaatagagaaaaattcaaataaatcaatgcaaattctgctattttcctcctctcctgtcttgtgttttattatctccattcagtttcagccttacccttagaactattcactgagcccatactatgcatatatcgaagcatccaattgtgtgttttgggtatatatgatctgtatttgttaattatacctctataaagctggaaaaatttcatggaactatacaccaaaaaagaaaattggcccatttaccttggccaattctgtatccctcatagaataaatcagaggtacatcgctattttgtgctagcctcagttgatgtccctttggggctctagactaaccctagaccacccctctctctaatgacactgcaccagaatatctttaattatagtcatgcaccacataacaacatttcaattaattttggaccacatgtatgatagtggccccatactatatttttactaatttttttagatatgtttagatatacaaataccattttgttacagttgcctacagtattcggtacagtaacatgctgcacaagtatgtagcctggagcaataggctataccatttaggtttgtgtaagtacattctatgatgtacttatatcatggtcttatgggaataacagtgaaattgcctaatgaggtatttctcagactgaatccccatcattaaatgatgcatgactgtatttcatcttcagtttttcttctactaatagaaaaagcgttggtaaattttacttctcccattggtatttcccaaaaaaaggagcatgtgccatttaaaattccaacacatagaaaatgaggtgcataataaaagtaacttatgttattacagtactttagtgccaaacatagctagaatttaacctcagagagaaagaaaatcatagaggaaaatatgaataaggaaatgataaatgatggtgcatgtctgtacaaaatgctgtgcagtcattaacattatgatggagatgagtataatactttcggaaaatgatcatgataaaatataaaatatatgctcaaatagtattaacttttaaagggaacttaatttgtatgtatagaaaaatattggtagggtataaactcaatagatagaaaactggccctgccactatgaataaataagcatgtcttcattcgcatgataaacactatgataatggttttaagtgtttaacagacgtgagtagcaatagttgtgtgggtttgagttaacttttccacaattaaaaccaatgtttccatgagatgtttagatacttcctggcacaagaaattattatatactgagcatttgctgtatcgaaggtcagtactgtcgtgtctggagtatactttgcagtagctaaatacgtgaatatgagtatagccctagtgaaagccaggcagtaagatgggattcaaagtaaagtaagaccaccttgggtggatatagaggggcgagagatttatggaaatcaagccagtcaaagttgatcttgaacaacttgtaggtcagagattaacaaaggaacatattttctaaatgtagataactacataaataaaatgtagaagctggtaatttaggggaaaggtaggttatatagatggtaatggatattaactgtcagaatcaggaattttcttcttaaaattctatcacaatttttttaacctaattcattaatactaagaagctattaaagctttttatgtgaaagaatgatcagagcttccctctgagaaatacagtctggcagcaaaggtatgattgatgagagtgggagagttgggaggccatggcaggcacctggaggccaagacagcaacccaggctatagtgttggaagtgctgcctcaaataggtggtgctgcccactgatccatttagcaggtgggtctttttcttcttcttcttcttttgaggtagagtctcactctgtcgcccaggctggagtccagtggcatgatctcggctcactgcaacctccgcctcccaggttcaagcaattctcctgcctcagcctcctgagtagctgggattacaggcacccaccaccatgcccggctaattttttttttttattatttttagtagagatagggtttcaccatgttggccaggctggtcttgaactcctgacctcaggtgatccgcccacttctgcctcccaaagtgctgggattacaagcatgaaccaccgtgcccggcctcgttcagatatttctgaatgccacctatgtacggcaagctgtctgaggcctgaagataaacacacacacacacaataacacagttcctaactttaataaatttagaactacagccaagtagacacgtacatatagagctaactctacaggaagttgtgatgagtgtcagtggagacatctacagagtgctgggaatatagaagagatgtaaacagcagctggggtgagaaacagggaagagagaaagtcaacatgacttggcgatgagtaatatggcaagtagaaaaaggtccaacttggtgctgaaatttcaactctgggtagttggaacattgttggtatcatgaatagaaacaacatatttcagaaaaagaatcgtttcgaagaagaggttacatttggtcaggtatttatcggagtataaggtacccgcaggtcattcagttggagaaatccagcagattggaaatattagcatgtggggttaattgagagattagagcaagaaatgacatatttggggattatctgaacacatatatatatatatataatgcttgaagctccgaggaagtagataaaactgaaggagagtagagaaagaggcaaaaggttttgaataccctggagaattattacatttacagggtttttggaaataggtctttgaagaacatcaagaatggttaattagagagaaaaaaaaaaatactgtaaacaaaatccaaggaaggtaagagtttcacgatttaagtaataaacaatgccaagtactgttgacagaactccaaaaaagaaaaggttattatctttgctcattaggggcattggtgagctgcaaaggagtgttttagtacaagacaatgagtaaatgctgaagaagtagatgccttataaattctggagaatgttggaaatgaggggaagcagagaaaggggacaacagtattatagaaaatattttttagagaaaatataggctaaagcttataataattaatccttatagtttctatgaataccatgccctaaaagtggattgcacaggaggggaaagagttacaatttgccctctttgaggaccttgccttctgtatctgtatttctctctggtggcacatgtggtgaggaatcagcagagattgtcaagtcctttttctctgacagattttcaggcattacatataatttgataaatgagacatagagcagtctgccattatagcaaaacatcctaggtttggattaattgagtaagacctaatcctagcattataaattctggatcatcaagaatatctcagaatgtttcactctggatactagagaggaataggtaaaatacatgacttaaaatagattggagtacagggatccaaagtatgtacaattctaaactgaattattctctttagaaaaaggcagaccctgtctgagttagcacacacagctgtcagccataaagctcagtagataagggcacgtggacaaagtttctcctgttttattgtcttaaaattatagcacaaagataaataaggcaggtcaagggcctcatgactaatcttatgtctagtagccacttgaatagatcattgttttaaaaatattttgttctgataagaaattccccaaaacctcagattcactcagacatttgtagatgaacattttcttggaaaactacaaaataccctacataattttcatcaatacatgaatccacattgttacagaagtgaggggtgatggccaaaacttactgtaaaagaggtcaacctcacaaacgttaccttctctgcttccctctcttcccatcctgccactgatcagccaagccactttcatggtattccatggctggtctgtatccctagtcctggggagctgcacgtttgatcacagctgttaatgcagagttttgcaagagaacatagtcagtgaggacttagctgttctcgttattgggaaaaatcaagctgagtgtgggtggtactatacacatggatcttcaaggttagattttctggggtgagtgctggctgggtagagcctgtgctctctgagagctgagaagagcgtgagtagatttgaaaataatgtcacttgtattggtagagatttgcaaatggcccctgagagcatctgggtatggacctcttgcagcctgggttgggagctgtacaggagggctggatgtcagaacgctgacctacttattttattgagtttatttagtttaatgagtttattcttggaagaaactcattctgagctgagttttgagggacgagtagatgggaggatagcatggaaatgagtgaagggtatttctcaaaatagggacctgtgaggatcccacccagctgaggcttggtgaaaagaaaggacaaacagcagggatctcccaggttcaagtgtctgatctgagagttagtggataccagcgttgtcaggctgaatgctgaatgtgggcagccattatttggaatggctcattgctaattgccatgaaggactcaaagacacaggaacctgctctggagcagataagaaatatactgaacttataggtatccagagactttaagttatcacatctgtaatgctttcctctgagtgattatcagttgctcaaattctgttcctactttactgtattcaaattcactggatgcttacgttacgtaaggagtgtgatcaaggttggggacgaaggagatttcaaataataaaacatattaaaacttaaagtaacattgtatgcccgaagcaccatacgtctgttgtaaaataaaataatgtccatatatatattttttaaatccagagtttcagtggtacatttgggcagataaaaccaaattttttcctggtggtttttcagtagttatatccttatggggttcatatagattgcttttatattaattagctttgctttcaattttttttggtttcttataatatgtgcttttttaaccatgtttgttaaagagatgcactcaaagactctttctttaatacctttactccacattctgctcagagaattgattctttctgcgtgacatcatgttgcttttttccggctcatatatcagctgtttttttttcttttttcttcttcttttttttttttttttttaatttccccctgtcttttctaccttcccttcccccttcccttttctcttttgtttttcttttgtcttcagcctattctgcaaacttggagttcttgtcaggcataggatttcactatttggtaaggagacccttgaaaaaatacaagcatggccatcacttggttttctttgccatttttgcactgtgttgtgtgctgctatgttgcatggatgcatgtttgcatggctgcatgcatggtcgttgcaggccaagataaggtcctcgaggttgttcataaatagcattatgtatggtgaaattgaggactctatcttttttacactagtccaaagcataactgaaagtaaaaagactattattaaagagcaaatgaatgaaaatggcaggctgtgccgtattttatctcaggggtaaaaacaaaacaaagccaggcccttggatttgtgtttggttacctctgacagattaaataatgagctgttataaatcaaaattttaaactgcacttattttttttaatgctcttgactacagatttgcatgtcttctgcattccaaacattggaacgtcatagtcaagacactgaagccaaggagcttcggagcttcacttggcaagagtggcttttctagcaccactcactccagggtcagtttctgtttgtttctgagaattcacctagctggagtccatgttccagagcacctgcttccggacagccatgcagggtgggcactcactttccgcagattttccctgccgtggggctttagaatctttagtggctggtggaatttgtgtttcacactttcctgcatccgattttataaactgccgaagaaaatgtgaaccctttgctctctaggttttgagacagtgttggagtaattttagtaataaaacattgaatgtattgctagaggtattataagttcaattctatttacaggacaagctaaggattaaaaaaattaagtcatttctacaaagtcacagttaaactgaggaacgggtatatatatatacatatatatatatacacacacacacatatgcacaaataagttcttcacattacactttttgagaaataatagtttctggatatagtaggttattgctatatttggtttctagtattatatccaagatttggtgctcttaaatttagtaatgaaaatttatatttcattaaaattgcctgagtttttacattaatatttcagttatttaaaatcaatggggcagttatctttagaataatttctagttcactgacttttgtttaacttctcttcaacagagaaatattttcatgggcttattcaggcaggattttcatacactctttaaccttctcagaataacagtggattcaaatattctccatttgtcttcagcaagtgctatctaattatacatatcagctgcccttttgcggtcttattaatgagcataataatactttctatggtgctatttctaacttcctgcttattgtatatccttcttttcctgttatacctcatataatttcctttaaaatttttttgaggtattccatacctgaactacaaaatcctaagaacaacttggctaggtgtggtggctcatgcctgtatcccagcactttgggatgtcgtggtgagagaatcacttgaggacaggagttcaagaccagctggggcaacatagcaagaccttggctctacaaaaaataaaaataaaaaattagccaggtgcagtggtgcacacctatagtcttagctacacaggacgctgagatggatggatcacttgagcccaggaatctgaggtagcagtgagctatgatcacaccactgtactctcatctaggaaacagagcaaaaccctgtctctaatacaagcaaataaaaagaacaacttgatgaaaatgtatatgcatatacaaccatttaatcatagctcaagccaagacatagaacgtttccaacatgccaggagcctcccctgtgtcatttttcaaattataaccatctccagaggaactatatgtagactccattctatggattcttttcagctgttcttgaaattccatttttgttgaatatatcatttaagtttggttattgaagataaatgtataatacagtttgtcatgcttgttaggggtgaaaaactagaccttaacattagttccttccctgtgtggtcctagtatttcaattagacattgtggtttcatcccttagccttttaatactattatttttatttttaaggggaatttattggagacctggtatgttttctttatatctcaaagcgcatttttgcacatttttatattattaaagtgtatgttattgtttcaaatttgctttgatatttgcctataaaatataaacttcaacatggctttattaatcaaacatctagtacagatttgccaaattattagaatctttaagtctttttttttttttttgaaagagtttcactcttgttgcccaccaagctggagtgcaatggtgagatctcatctcactgcaacctccgcctcccaggttcaagcaattttcctgcctcagcctcccaagtagctgggattacaggcacacgccaccacacacggctaatttttagtagaaacggggtttcaccatgttggccaggctggtctcgaactcctgacttcaggtgatctgcccacctcggtctgccaaagtgctgggattacaagtgtgagccaccgtgcctggccaaatcttttaagtcttaagcatttaagcttcacatattatgggtattggtatagtatttaaatgtcacatattatgggctgtagatgctaatatgacatcctagagagaatagtgggtttggaatcagaaaacctagttgtaagtcctatttttctaacttaacagctgaatgatttggacaagggacttaaattctctgaacctgcattttttcattgttaaagtgggctaaaatacctaataaacctagagatcaattttttgtgaaataattcatgttaaagtgctatgtaaagtgtaaccttatagttttcacatataagatgtttctagtcttattaaaattattagattttattaacttatctaaagcttattatactttatttacataaattacatactaaactagtagacttagccctttaaaatacacacacagggccaggcacagtggctcacgcctggaatcccagcactttgggaggccaaggcggacagatcacttgagctcgggagttcaagaccagcctgggaaacatggcgagaccccatctcgactaagaatacaaaaaattagccatgtctggtggcatacacctttggtcccagctactcaggaggctggggtgggaggattgcttgagcctggagggcagaggttgcagtgagccaacattgcacaccacacacacaaaaatacacacagtaaagcctttataatacacccatttccagaatgaatcagaagtgttataacccaactatttactttttgatttatcagctatgccagtgtggatttttccaaacagagagacccagtagcatatatgcagtgcttgtttgtatatggtcatattaatctattctttttcagtctacttttatcattttcttgcattttggcaggaaatacattgattatcaatgggattacaagcgtgagccaccacgcccggccaaatctctaagtcttaagcatttaagcttcacatattccctgtactgtcttgtatttcctgtactatcttggtttaaagattttttcatgacctaaacctaagagtaaattaagacagaattgaaagttgaggttgacaagaaaatacttgagttttgtgatgatcagagaaggtaaggatgtagaaagatacatgttaaccttaaatatgtcagaaagtggagacaggacaggagcattaaaaaaaaatgaagagacaaaatacatgttctggtggtagtaattgtggtgagcagagtttgatgggtaatggaatatttattctaggttggctgccacattgtaattatatctccaaacctcgcctgtggttgaaatatttttctgacatatgaaatgaggattctcaaaactttggcttttatattttttgttatctactttaaaatatttcttctgcattgatggacactatacaggaattaagataatagtgtttttatgcctaatctattatttttgagacatttaaaccattttatgttatgtttaaaaagctaaggtttttaaaaaggaagacaagcggtattacccatagaattctgatgaatcaattagaataatttatggaatgaaaaagaaagaaaatagcttcttgtctaaatataggcttccctgtttgaattctgaaatgcttgctagtgattataagttggtgcacataacgaattttggaaatccaggtaggacataaataggacgtaggcaggttgacaagtgatatccttatcatttgccattttcaaggaccagtgttgactaaagaaacagtgctttgattcccagagttacccctgacttttgctgcctagaaattctgattactattttcaaggcagttagaggatacattagcccttctattacagtctgttagaatctttcaatcatttttagaggaagcagcatctgataactaagagtccaacagtaataatgatggtggcacaggtggtgcttatcagagtgccttaaaggctttctttttacatgtgaaaataaatcaaatgccttgatgatactcattttatgcattcattcaataaacatgtattgtatgtctgccacgtgaaaggcattcactcaagatgtgaggataggaaaatgaagattgatttctctttccactccggaacccagaccaatatgcaaacatctttcgcttgtactattgcaggagcatactgaccattctctctgaatcccctcctgcttctctcaactgtgttccacgatgatcttatcaaatcttctcaaaacacacttctctgattacactcctgcatattcagtggcttcccatgcctttagggtagaaagcacgtttcttaacctagccacattagtgtttcaccgtccattccccatgggccactccgtcctcgtgtcccagcccagtctctcctcctccctatgcttcttcagcttccttggccttctctctgcctcttgaatgtgttagattcctttctgcccagggtttttgcacatgctgtaattatcgcctgagtaaaggaccctcacacataattactcatctcctcaatccttcacactcataacaaactatccatccttcagacttcaatccaaatattactgtctcaagaaaggcttccctgacctccttgataatactccgtcctgctactattataatagtctctggtgccgtgtacttttcctccatgtcactgatggtatgcctaccagattaatatctctcttctctcgcataaactctcagctctgtgaggtcttcctgttgcactctcagtgcctggcaggaagtctggcacacagtaaatattttatgaatatatgatgaatgaatgaatgaatgagccacccaggtccggccttcaagaagcctatagtctaatagagaaggtagataagtacgcagacacttactatgagacaagtgctaagaacgtggaaattttcttacattcacgaatgacacagctttcctttgtttattttgcttaagagattattaagaaaaatgtagtacctaattatcctacaattggtgagaatcatgttttttttttttttctcttattccttaagaggtccatgaaaacacttaggccacttacagtgaatagaaaataacacataattaatgacccttaaaataataagatcatgaaactcaaccaacaatgatcctttcagttccaggaactatttgaaaaggcaggcatgaaatatttgtcacttataggccttttctactttccagttttctggtgcctttttaacatcctagtgagacattgaatgacctggacactcctcagagttagtggagaatttgtgaattaatcacataggtacatctaggaatacctgatgttattacaaaaagccagcattttgtaatacaatgagcataatactgacctagaacccaatgtataacatcattaatacaactccaatattagctacaggagtattaaacaagataaatattattatgtgtttaacatgaaacagtagctgttgttaaaatattcagtttttttctaggtgagtatgcctgacttataccagtagataaatcttaatgttacgtttggaagagttttaaaagtagatactaaataaagtaatacaatggagcctatcaactcttatttctacctaatcaataaattagtggattaagtttatgttgatacttctaatatctctcccaaaaaacactgacgtctttaaatgatgatttctgtcttatctcagaagttattatattagaaaattaatatgtttgtgttatctctaacaaggctcagattgtgcttgtgtttggtaggacacatataataaaagaaaaattggccgggtgcggtggctcacgcctgtaatcccagcactctgggaggctgaggcgggcggatcacaaggtcaggggatcgagaccatcctggctaacaaggtgaaaccccgtctctgctaaaaatacaaaaaattagccgggcgtggtggcaggcgcctgtagtcccagctactcgggaggctgaggcaggagaatggcgtgaacccaggaggtggagtttgcagtgagccgagatcatgccagtgcactccagcctgggcgacacggcgagactccctctcaaaaaaaaaaaaaaaaagaaaaattacttaaagtactcagaatcactgcagatagaagcatatttgaggattcagtgtgccattaagttgagaatgtaatggttcaatcatgcgcaatctgtaactattttcttatccttgttattcgtagctggaggatcattgagatctttctctaatttaaaaattctgtagtactatgacaatatgcatggcaaaaacaactatttcctggatttaacttattatatatactgtaaaaaatcctatttttttagagaagttcagaaatattggaattagatgcctataatgaaagtaataaagtatacatagcattagatcaacatagtattagagcgatacagataattctttcagttgaacatagcattataggagaatttcctggctttgaaaaatgaatagaatatgtagttattcaaaatgtgtcctcggtttgactgaaactcctcaccaaattagggaaccaataattttactctgttcaatatcacagactttagaaataacaaagtcattgacactctgcaatttctctctattccctcataattgtgagagaaatttgtaagttctggcacagtggtatttcacattgttaatagaattctgccaagattaatcatttcttcagagaaaagaatacaatattagaaaagtagagaaaaataaaaagtacaatgactgctatcactgtttccagaagagagagaagtcaacattctgtgaattctcagcatatcagattataaaacagaactggcatatgatatgtcaaatttaacattgagaattcctgagttatagaaactttatttaaaaaaacaatttgggattaatatgcaaaaattatttatagttatattatgtaatttgttgtttttattatttagagagtcatatatgagagttgttataatttgtttaaaacccaatgttgtccctattgttattagacccaggtgtaagttattattttaattatgtactttttatgtttacgtacaccttgatgcactgatataaatacacaatcttaaggacaaataggcaatctatcattgtttccctgagtgctcagaggtgatgagaggtgtgtatctgaggacaagggaaatagctgggtccttgaaatactgtgagttgaaaagtatcaatcttttggttttttcaccacccagagcaatgaatcaattatgtaaacttaagtacataaaaatccagttgccacctgaaagttttatcatcttacaaaactctgctggcccttcctgttcttcctgataacgtgattgacatttctgattatggtaatctggatagctttaagaaggacaatatttaagtcattattttattgaaaagccttaccacatgctttacctcttcaagactcacattattttaggcttcttacacatgctaatgggattgacacttttgcctggtctacaaattaaaatattgaagactctactttttctgccttcttagagtccctttcccattttttacatagaggtgtttctatttaaagttgtgctgtgtctaaaaggggtctaccaagatgtaaaaatgtgtggagttcagtttattcctttagcaatcacagaaatttcatattcccaatacacagtttcagtcaacccacagaatttgtctggctcctggtgctgtttcctactcttcttacatcccagagacagtccacaaatattttaagggcctgctgtatgtcagacactattctaggtgcagggaacaaagcaaacaaaaatcccagcctgccaggcttatattaatagaagtttaaagtatccctggccacccctcatggaaaagggcacaggaaaactcagtaccaagtacaaacactgataatctataataagagcagattggaagggaaagggacagacaactgagtgtttaggaaaaatgaaggacctgcctctctgatttggggctgattaatagtggcataggactcatatacgttgcactggatctcttcctcctcatgggccttctctttcccattgtctatactgcatctttcttatcttctctgcctccaaacactggaggccctaggccttttttcttcttacttatattcatgctggctagtttcattgagacccacgatgtttagaattaaatgtatgtttacaatgcccaagtgtatagctctggcttagatctcttccctgcactgcagacttttttttttttttcaatcaattgcctattctacatctttacccgaattactaataggcccatcacacttaatatgtgcaaagcaagggtcaggaccccatcccccacccccgccgcatccccttcctcccacagtctgcttcttctcgttctctttctacaccattcagtggtgccgcctttcacctaattactcaggcagaaaaccttagagttatccttgactgctttcccgctcacctcacattcaatccataagtaaatccttcaaatatatattctcaagttcttcaccactgatatcctaatctgaattcaccatcatcagtgaactgattccgttcctgcagtaggtccctaattatcttccacttttgctcttccagaatttcccacatagggaattaattctttgaaaatataaatcgtatcatatcccatcctgctcaaaacctaagaatgtcttcctaccgcactgaaaatccaagggcttgctctaaccaagctctagaacctgacctctcccaacctctccaactcatactctgcttctttcctcttgctctgactcccttagccacttgaccctctttgcttggaacaccaggttcattttttgcctcagagcctttgcatgggctcttccctgtacctggatctccttctcagatacatggatggtttatttcttcatgtcattccaacctctgctcaaatgccgcctccaggaaggactcatgagcactatccctgttattctacccagtttctgtaggtgtgtgtgtgtgtgtatatatatatagtatatatatataatatatatttatataatatataattgcatattatatattatgttatatattatataattatatcatatataattatataatatatatttatgtaaatatatattatatgatatataatatatttatagaaatatatattatataatataattatatataatctttttgtatataacaaatattttttatatatatttaactgtggcctgctattatgttatatgctgatattttgctaaatgattttttttttttttgcttactgattcgttatctatatccccctttaaaatgcaagtaccataaggactattttgttcattactggaaatttgagagtgcctggttttaatctttctttgttaagtgaattaatcatcaaatgaatacttctaagagttccaggagaagccccagagctggcatctgccaatggacaggaaaataaaaaatcctaccattctgctcattttgtcttcattattaccaggaattctgagacttgaagcacaagatgagggaatattttcatgaataactcagaatctcagtaataaataccttattttttcttatttgtatcatatcactaaactggcttgcccatgttctaatacaattattaatttcagtgtgtacttaggtcattcattttaggttactttttgtataaagaatataacatataccagtattacaaaaacttacattcagataatagttgtcaatctcaggacccaggagatgatagtgtgtgtgtgtgtgtgtgtgtgtgtgtgtgtgtgtgtgtgtgtgtaatgaggaactgatcatgtcaaactatattgtaagtggtcaaattattttgttaccttgaattcatcattttatttgctttctgtatccccattacgaagaaaaatatatgtaatgcttttatcactcatatttctgtacttccttgtaaaatatgccaatcaaaatgagtgaattttatattactttcaagaggagttactaccatctgaaaatctcagaggagtattatttaacttctttagtgtctgattttttttttacatgacgttttggtgctttttggtttttgccaaagaccaataacattcaaggaaattaatttaccttcatgcaatggaattcaggcaaattaattcatcttaatgcagtgggatgaaataagaaagcagaatttttggtgcaattagaatggaatgaaaatttttaaactttaagcccaccttatttcataaaggatatgagctgactttaaaagtttgtaaacaataagatttaaaaatacagtgagatgggagggagaggggattattgaaaacctcggttaaaactcttttagtctggtgcagtgcttttgaatgcttcttgggcatgtcagctatttgatgagacatgctttattgcttttctacttacatttgcataaccacttttaagcagaaaaactgcatgatttcaaacttgattattaaaaaaccttttaaaatattactgttgtgtcattgactaatttttctagcacaaatattggtagaaaagaagaacattgagaaattctcagggcaatttatacagcattttgtttcctctttaggcaatgatgcaacatcaattgtcaactgtcttcatattttgggtcagactttggatgcaaggtaaatggatacatttttacctaaataaattactataataatgatacatgtatatatataagaatattaagaaggacccagtgtctggattttattctttggatttgtaataaagtctttagtgtaggtgaaaagaaaaactttttaaaattaatacagtggcagcttatgtctatgatcatatatagattattatttaatgtcaggtaatttctgtagcagctaggaccataaaggagggttgaactggtaatgtatcacgcaggaaaaatggtaatctgacaactctagagatcttgttagcttccaggcgtgatatttgtgcttaacattcataataacatttggctttttaggaaacagagttttattctcattttacagatgaataaagtgatgtttaagattgcatactaagtgtgtaggtagacgaattcccatctgtgtgctttctactctgccctgtcaacttgaccagaaatctagcatgttgaccaaatacaaaatcagttcatttagcatgattgattcagccatacatttagtttatatctaggataaatctaaataaaagtttataaatgtctcctaaagagaatattccacaatactctttgattatccattcttgcgtttaagatttcatttaaggtcttttgtatgataaatgcagaaaggagacaccattacagaccttcacttcctactacaaatagtggcattaaggtatgaagttcagccttcggcggcttcattagaaaagacttgattgctacaccttaaaacacaaacattctgtatcatttgttgagttggtttagctggcatgaaattttttttgctactcattgcctcaggaaacattctagttttgttggatttcggattaactatactcactcagaagctgtgttttgttagttaaattggagaccgttagtgataagcatacagcattagcacagacttttgcagcaaggttttaataagttgactatgaaggcatttggaaaagataatttacagagcagtattgctgtaacttcaagtatattgaaaaaatttgttttagagttgattttaaaagttggttaccaggtgagtagagtaatggagaaataaacatcataagagaaccacaattcatttatatttcatttgttcctgttggaagatacgagtcctcccttatttactttctaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcttcattatttgaacatattggccagcatcagttcggagaagacctaatatgtatgtaaatttatatcttggagtttttttttttttaatcgaaataccctgtagtacaatcaaaaacagtaatagccacatctgggttactaaaacactgtttacatgttaaaatgccttttttattgcaaaacgttataggttgacatttgtgtgatagacaccattcttacagaaatagatctctgaattacatggacccacagagaggaccagtaaggtactggttatagaaaatgacttccacattgttgaagtttccaaatgatcactatttctacattgcctcttttcacataaacgttttaatgcagttgaaccatataacatgcaacagtaaatgttttcaaattatttctgagtcaatgtagattgtttctccaagcttgacaatgtaataatgtgaagacgactgagacaaagtctgtgtctaaataattggccttttagagtggctcaaatatcctctgtttagaggtttctgacagtttttagggaagctttaatcttctgttttgggctggcattcagtagttaataaaactatacacagaatgcccaagattacgtggaaaaaatacgcatgagctgtttgaactccccactgccctgctcaggacatgagcctttgttgagcagaatcaccaactcagactcgtgcattgtccattcctcaggtgatgggcacctctgtgcaaaaactgctgagttactcagtgggtgccacaactaccagtggcagaacgtttattttaaattttgttttaagaaagcatgcttagtccgggtgcagtggcgcatgcctgtaatcccagtactttgggaggctgaggtgggtggttcagctgaagtcaggagttcgagaccagcctggccagtatggtgaaaccccgtctctactaaaaatacaaaaattagctgggcatgatggtgcacacctgtaatcccagctactcgggaggctgagacaagataatcacttgaacctatgtggtggaggttgcagtgagccagtattgccactgcactccagcctgggtgacagagcaagactctatctcaaaaaaaaaaagcagatgtgccttttgtttagttatttttatttgtataaatttacgggtttcaagtacagttgtctgggcttttagggcatccatcacccaaataatgaacattgtgcccattaagtaatttctcgtcatccaccccctcctgccccctcacccttctgagtcttgtctattattctcctctctatgtccatgtgtacacatggtttagtacccacttataagtgaggacatgtgatatttgactttatgtgcctggcttgtttcactgaagataacaacccccagttccatccatgttgctgcaaaagacatgatttcattctttttatggatgaatagtatatagcctaaactgaatagtacatagcttaagctttctcaggacaatgtataaataagtgggtttttctttcaagtgagattctctttttccttagtggaagatgtccaggtgtcttgttatagaattctgactagcttatatgctttgggaaccagcaagagtatttacgtggagaggtaagaatgtttaaagtttaactttgtattaattgctgcttcaagttttataactatttatttcaagaatcttcatttcataacctgtttcctagttataaactaaaccggattgacctttgaaattccttggaagtaattagacaatctttaaacaaaataagaattgatataataaaggacaatggagttatgcaaagaaagtaaagcactaatggtaaagactacacttaatatgaagtttcagctgagtgtttgagtcttatgaaagcacctgctagtatcgtttctcattatatatcagaaattcaaagtaaacatgaatatgagcagttattaaacctagttttattttctcatgttctcaagtttcaggatggagtggtttgcagtgttaaatgatgtgaataggtaacataagaaaaggtatccccagtaaatttaaaataaagagatcactggcaactttagtaagaaatttctgtgaaccagagaagaaaaacagggaagtttttttaaaaggtcagaataaataaaaacatattctgatagaagatttaattatgaatagatataagttctcccaaaattaacctgtaattacagtacaatttcagtacagcaaattacagaaatttgctttttccaacttcacaaaatcattcaaaagtttatttcaaagaataaacccatgagactagccaacggaatttgcaggggaataaaagagtaatgaacaggtactcatttggcctaccaaatattaaaacctataaagctacagtagttaaaataggatgacagttgtacataaaaatagcaaattagatcaatggaaaaacataattgggtttactctgaacattttacatttcttaccttcattttaagtaaactcaattttcatattatttttatggttatgacctatattaaggaagtataataatttattgatatgtgactttatttttgacatgttggctgttttctgtttttcactaatatatataatgccagatctatgttcatagattccattgtatttttatgcttatttcccttagctgtattcttagaatttggaattataggtcaaagggtatgcctgtattacaggattacggtactcatttcactgttttcagaaaatcctttccatttacattctcaaattttagaagtgaatgctaatttcctcatttgttccttactcagattatcttttttttctttttagtgcttgtgtatgtgatagtgaaaatataggatccctatttatattttcaaatgcactttcctgattaccatctacttgctatttttttcatgtttaccttgtcatttgtgtttctttactttatgaattgccttttctcatcttgcatctatttttctattcatgtattgtcatgctgatttgtaataatgcttttgttcattaaaatgattaacctcttgcctatttctcctgtttttgtgagttttaccattttttacctttatatatatatagtgcttatatataaaatatatacataaaacatatatatatatataaaatatataaaaattatatacagatagcattttatgacatggtaatgttgaatttttatataatcaaattttatataattttgacataatcaatcaattatttcatgtatgtttcttccccttagttttattattctgataagtttagactacacatttagcagttagaatttcaaacatttatcctcctagacttttcatgcttccagttctttatatttaactttataatcctattgtttgtatcctaaatatttgttaaatgccagatactaggatacagaaataaacaagatacttctctactctcataggttttatatctggtagaggaaaccaaaccaaaacaaacaagcaaactgataaatattatagtggcaaggtatagtttgtcctatgaataatcacacaatttggagaacaaggtagtcgagaatgtgtcttttagaaggcgacttttgaagcttataacttttctctatgcaacagaaaacaggtagaagctatatgaggtaggtctgtgtctagtagcttctgttttctcaatgaagaatgccttgagtcctaagccagatgaaggctgagaaaagaagtgtggaaagctcaaggaaagtagagaatgtctagaatgatcatctctgagataagaagggaatttactagaaatatatctgaactttatttctcttgggtattatgtaggattcaaattaaatttttaaaatcatcaaccatttgtaaagtaatcatttattaactatttattttattccctgatttaaaataaaaccatcatgtaaagtaatgtatttactagattacatttagaatttctattctgttctattatttgattttttatgactaaatcaatatcatatagcctgaattgttagtatttttaaaaatattttaatatctggtttttcaaaccctctaattccttcttattgctgtagcttttgtttttgtcattgttgtttttgcctatatatttatctggacaaaattcgaggtcacttttttaggttctaaataatgttttggtttttggtggcttgttttttaagtcttttttgtgcaattaattttgcggttataaagtgattggggaaacaaaaaaaaattcaaaggtaaggaaaagacattttgaaaaaaatagatatttacaaaaagttacagtggaactttttctaaaatatctacaaatatagatattttaacataagtcatccaaaagaaaaattgatatttccagaatgccaacacaaattatcagaatcagtctgagaatcactaattgaaacagaattttaaagtgaattaatgaaataaaaggactagtccaatcagatatgaggaaataagttgacagataattttttgctaacagataatttagctttttttcaaatggtgaggatattgctattgaaagcatatgatgtttagcaatacagaaattggatttgggagttaattttattaggaccaatattatcattccttttaggttaaatttgctaattgtaatatgacttttttagttactcacttggaagaccttaaaacataagcattttccacttataggcaacgttctgcattaggagaatgtctagctgcctttgctggtgcttttcctgtagcatttttggaaactcatctggacaaacataatatttactccatctacaataccaagtcttcacgagaaagagcaggtaacacagaaacatgtgcagtgctttgagatatgaagctaaaacttgatatttatcatattgtccaatagtgatttttaatgagctctttcagtttactatatccaatcttgtttgttcttaaatgttattgtttggtattctatgtgatgtaccctgtgatagatgagggagatatgatacatatagggcagcaatcagaatatgtggtaattcaagagcaaggtgactgagcaggccccttggacagcgtgtatgtgtgttgattgtgagagctcctagaggtagagtcatcttgtgtggcagatgagggagtatcgcagcctagacgtaatcccaggtttctcttctgggtgactgactggataatgtccccaccaagttagggcatgctcaagataggctggagagaaaaagagaagtttaaatttagatccatcgtgttttagttgtgcttgagacatccaggatgagtcagaacagtttttaagaaacatggctttacagatattagcttatagcagaaagaatggccaaaattgtctagatgaacatgcaaaccaaaaaagagaagagaatcaaagatagattcctaaagataatcagcatttgaaagttcagcaagggctgggcgcagtggctcatgcctgtaatcccagcactttgggaggccgaagtgggtagatcacgaggtcaggagttcaagaccagcctgaccaacatagtgaaaccccgtctgtgctaaaaatacaaaaattagccgggcgtggtggtgtgtgcctgtaatcctggctactcaggaggctgaggcatgagaatcgcttgaactggggaggcagagtttgcagtgagccaagactgcgccactgcactccagcctggcaacagagcaagactctgtctcagcagcaacaacaaaaaaagttcagcaaggagaagagagtcagtaaggacactgacaacattcagagggagccaaaaaggctgggcacattgatgttaagaaagaagggagttttaggaaaagggaatttggtcctgggtatgaaatgccactgaacggttggaaagatgagttgtaaaagtgcaattttgctgcacagtgaaaagcagctttgttcctgaggacggagagtgcctggatagctaagtaatccaggaaagatttgagtatcttgctgggtaggaggtattacagggctgaaaatacaggtctgagcaaggcatcaggtatttggtggagccgtgagtgggggacttcaaaacttcctcgaaaacggggaatggaggccaaggtggagccagtcataaatggcttgtaggtcatgagagcagcaaagttagaggaggaaatatttgatactattgtttgctgtaaagtaggaggaatggctgttttctgggagtgatggtacagtaggaacttaggggaaagagagaagctttgaaatagctaccttgaaacacaggagaaggagccagttgcaggcatgccacgtcttgctaaattttgaagtccaaaatgaaatagttgcctgtggaaatccgccatatcatctcagtactttctttgaatatcatccatttttatatgtacttctccagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcaggtaagaactggaagaagacattgtacccctgaaatctgttttatttccaaaagaattttaaatacataaactagaattttcccatcacaatttttattaatattttctttactcaaaaatattagtatttgtcatgctattttttaatgtagataaaaacaggcattgggtatatgttaaatagttactacttttaagtaaacatttttctgacttgtcaatctctgtaagattaatcaataaacacagcagtaaaaactaatgattttatagccagagacaaaaataaaacattcaacttttagcaatccacttgtagccatctgttatatagagaatgtgaagagaagggagggtaaaccaaaaaaatgtagtctaatgtctacaattattgcattatttgtattgaaaagttagaagcaatctaagtacccaataaccagaatatggctaaataagttgtatacatctacatgccagaatattatgtcatattttgttttttgtttgtttgtttatgagatggagtttcactcttgttgcccaggcaagagtgcaatggtgagatcttggctcactgcaacctccgcctcccgggttcaagtgattctcctgcctcagcctcccgggtagctaggattacaggcatctgccaccatgcccagctaatttttttttttttttttttttttagtagagatggggtttcaccatgttcgccaggctggtctcgaactcctgacctcaggtgatccacccacctcggcctcccaaagtgctgggattacaggtgtgagccaccacgtctatgtcatctttaaatgttgaagtttcaacaatattttatgccctggaaatactcatattatgaagggaaaaatggagaatttttaaaacaatgaattcagaatgttatatgtataatatatatgtaaatgaatttatctactgatgaaaactccagaaaaatgcagcaatgacttattaatttgggtagatgattatggttgactttaacttttctcttgtatacttttccccagtgcatatatgttactttcagggggaaaaaagtcattttaaaaatggcccaatcaagtttagaactattattaacaactatggttattattaaataagagagcagtgttccatataatctaactcttccattgtgccaaggatggggatagttaaaatgagataactgtatatagtctcatatagtaattatgtagcagagcttgtccctattctaagggttaggggaaccttttccatttgggaattttatttcttgtgtgaaaatgatttccaaaatgagtgaaagtcttttttttcattctaaattagctatctattctaaaaacaaggaagatcgttgaattcaactcagtaaacatttttttaatggcagctatgcaattagaacttggactagaaaaatggctgaggcatgagctgtacccttaaggaagtcatgtgctggagaaggaggctttaattatgttacaattgtaattacaatctatcatcatgttaatgaatggttttacagagcagaatactaatgtctgtctttaaacagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacaggtatgatcaaaagtaatttagtaatttctccaattcggtcataacgtttcttggctcacatgtccttgttcaatcgcttcattcactattttgccatgagcttgttggtaattataattaactgtttataggcaagttaatttttggcttaaaattaaaacaccttaaaatcaaagttggccgtttcattctgattttgcatgtaaaagttaacagtttgacagttatgatgtttaaatttttttttaaatattacaacactgtgctgaaaccatcatgagctctgtggtcagtacatttaactttggggggatggttttttttttttaaattaactttaaggagtagctgagaaaccactttatttattatgtgatccagggcaaagtggctaaaggagcctaacccagaagcagaggagctcttccgcatggtggctgaagtgtttatctactggtcgaagtcccatgtgagtgtgaaaatattgatagatcacgcctactgtttgtaggcacctgcttacttgcctcctaggtttcatgtaacagttgaggagagagaataggttcccctgaggagtttgagggaatataaaccttcttctgagttttgcaatttatcctttaaaaaaatcacagggatttttaattgcactccataaacatattttaaatttgcccctaaattttggactaatattgacattgcataaagatgtactatttttactatctagctttccctatctcttggcattttgttctcttaatttgcagttctcagtttgagacgtgcttaaatagactagcaatttccaacaataacccacactcattttacttgtaaaggtactgcttccataaatttgttttatcttcacacactttacacctaaggaatttagtttggctcacattttagaatctgttgggttttaaaataaagcttctttctactgacaatcctgttgatagaatttctaaagtacgtatttggtgaattttcactattttgtgtattgcaagtggaactatgtatttttaaacctggaaaagattttaatcataacaatcgtatagtagtctatcattatttcagtaactagcagaatatagataaaagagcattgatgattatcctgaattattttaaaaatttagaatttttatatcaattataattctatgccactctgtaaatgagagacaaagaaaataaaaatttcaacctcagttttatcatctgagatatcttaccagtttacttaatcagactgttgtacaaatcaagttactttgaatacataatattttttaaatatgcatatttaatatttgggatgacaaatattatttattgcctacatctgaggagtctgtcaaacttaatagcaaactttatataaaaacatacattaaaaacataatcactcagaaaggatatatgaaataatggctgcttaacatgcaactttgtatcttcacaaagatacaaatttatttatcctgtgtaactcatgtttgggggatgcaatagatcatccaaggtattctgaaggaaaattcaaaatccactgtaaaaagataaatagattaggtatgtagatagatagatagataatgcatgcccggtgacaggtgggagcattgcttgagctcaggagttagaggctgcagtgccctatcattgcacagctgcatcccagcctgggtgacagagccagaccctgtccctaaatacatacatgaatgaatgtataaataaatgaattccagaagaaatcagtccattttgagctgccaaaaaacaaagatgaatttttgctttttgcctgttgttttccctgttgggttacttcacttagaatgcctcatgggaaaatagggggagcccaggaaaaaattactaaaaactgcatatttttatttgaagaactgaaactcttcagtttcctcgatcattaaaatgccgaagaagcgtctttagatttaggtacaagactaaagtttggaacaagagtatttatcataatcagtatgttttcagatgaatgtctaatcatactttcaagaataagcaaaaatatctgaatatgtacttttgaatctcatgggcatatattaatataaacataaattggctaatgtgttatgtttttccccaaatatttaaagataaattgattttgccagtctttttatgttcccaaattaaaagggaataaataatgatatggtattttaaaaacaggtaaaaaatctgacagaatagaaagttacgtcatagttctatgtgtcctcggaaagtctatgttaatctcaggaatcagtatatgcctttcaccagctaaccaggcgtttgaatattcattctactccttggtaaacatgtgatcttgcaatgaaattttctgaatcttagttttcccatctttgcaatgtgcatattcatatctagttcacagaattcttgcttctagccaagtaccctcattagatactcaagaaatacttgtatccttttttgataattcttatatatcaaattaatacttatctctgtaaaaacttgcaggttctgtgtaacctctaattacaaagacttctttaagtggttttaactgaaatttcctttgcaacttctcagaatttcaaaagagaagagcagaacttcgttgtacagaatgaaatcaacaatatgtctttccttattactgataccaagtcaaagatgtcaaaggtattactataaactgtttcactgttctggaaaatatctgaatgtgactttcatgaattgactttttttttttagattttcgaagatttgtaactggaatctgacagatttggtaatgttataaattggttcaaatatgcaagctgttttaaggttactggaatttgtttgaatcaggcatggtaagacatgcagacgggaaatgactgtcatgaaggaagacatttctactgacagatccctggaaacaggaggcatggcatgccaggcagggccccccggggagaggtcagggtcagtcaggaggtagagagagcaaggagaagacgtgggcgagagcttgcctcgtggtctccactggaaggaatggacaaggcagggcaaacaggtttctgattggctaatttgaatacttttcaggggctccacatcatagggcctgtccttggctgcctggtacctagtcccagagtgattagagcaggtggatagtagcccagagtataagagcccgataggtgaggcaggggtcagtgtgggctctgggttggttgacttgtatatgaaaagcaagctccccaaaccaaggaagccatttccttctctaggacttgcctaacgatgggagggactgctgtctccccaggatcagcaaatctccaagatgtcagagcaacagaataaagacatgcttcacacacacacactcacacacacacacacgcaccccccactcaccaaaagtcagtataatgtatgtttaacatgtcaacactatgtgtccatcaagtgtgaatatttgtgtgcttatgtgtaccaaagaaacagacctcaaaataaattcgctgcattatttaaaagccacatggacgaattccaggttctcacacatgaagtgggaagtatctttccagatttttgttttctctgtcactcgtattggggaggggagtagcttccatttaaagcattttaaaggggctttatatgtttaattcctgctaaatgagaaataaatatattacatgtggtaacatttggctgccaaatggccaaagatccaaaaatgactgctactcaggcagagcaaattagcctctactgactcaataaattctggcaacagagtagcttaggtacacccactccactgacctccaaaagtcaccggatcctcaggcctgctctgtgatctgtcacaagggaagtagaatggtattgcttggtaggcctagtcttgtttaagagttttgaatgccctgtgtttgacccgacagcacatgaactagaagctaatgccagaagtctgtgtattcctgtacagatacccttttccctcttttccatcagttgagtccagtgattctcaaagatactctcaaagcactacatgtcatagaacctagagtgagacatgcataaagatgactgattataacacagtttgctcttatttgcaagaagaaaaaaggggagtaatagataagaacctctcaattttaacatttctgacccacaaattttctcaaactaaaaaattatttttttgtttttgtttttgtttgttttgtttttttgagacggagccttgctttgttgcccaggctggagtgcagtggtgcgatctcggctcactgcaacctctgcctcctgggttcaagcgattctcctgcctcagcctcccaagtagctgggactatacaggcgcatgccaccatgcccagttaattttcgtatttttagtagagacagggtttcaccatattggccaggctggtctcaaactcctgacctcgtgatctgacggcctcggcctcccaaagtacctggattgcactccagcctaggcaacaagaatgaaaatccatctcaaaaaaatatatatagatagatagataggtagatagcatttattacaagttctctgtgtttatttgtgggtgtgagaaaggtgggttttgcctgttgcattatacaattgtactctgtttttttcttaagatttcatttcctgttgaaatgtaatcacaggccttggacatttaaagctaggctaatttttataattactatatctaaaatacaaaaaagtatctttttataggtttttttttttggtaggctatttcattgtgggaatattagaaaattttttgtaagttcccacagaaaggtcatgtgataaatacaaccaattaaaactgtgctttctgttcataatgtggcaaaggaaagagcttggctttcagaggcagatcagcctggagtgctgactctgccacttcataatcccttcactcatcttaaacctcactgttcgtagcagcaaaatgtttgtcatgctgcttaccttgatggaggcttgtaaaatcagaataatgtgtgtgttgtgcctcacagattataggcatgcaacaaattttaatagatatgaattgtagtaacaaaatgataaagttaaaatacagctgaatatctaacaatcatatagttaataagtacttagaaaacgtacgagagaaagaaactgataggatagtcaaagatgtcagaggtaagtgaggatttgaataggtcttggaaaatgagtcttttctagatgggtcataaggagagagggtggaggagcctgctgataacccattttatgcagccatagcactgtttttgctcaaatctaacagtatatttgaagaagagtctgtttgatgtctttcttgccattttcctggtccactattaaatttaaagctattttctgtgaaattgttacaatcatatttgtatgtttgtgggtgtgtgagagacagagatagagaggaggcagaagcagaggttgattgattgattgattaaagaaagggctcaagtggctgggtgcggtggctcacgcctgtaatcccagcactttgggaggccaaggcagatggatcacgaggtcaggagttcaagaccagtctggccaagatggtgaaaccccatctctactaaaaatacaaaaaaaaaattagccaggcgtggtggtgggtgcctctaatcccagctacttgggaggctgaggcagagcattacttgaacccaggagatggagactgcagtgagccgagatcacaccactgcactccagcctggtgacagagcgagactccatctcaaaaaaaaaaaaaaaaaaaaaaaaaaaaaaaagggctcaggtgattgatttaagaaagggctcaggttagtccacttcccttcttaaatatgcccacatatgggccatgttattacatcttcatatctgatccaaatgcacagattgaaaatgaaaaagtgtgcaaattcattagctttagcggctctgtttaaattattgagctgcgcctatgagcaaggcacagtgcgtggctttgaatacagagaaacgacaaaacaggtttggcagctgccccaaaggagctgcatagtttggggaggaaataggcactaaacaaatgaacaaaaaatacccaatatgtgcgtacaggaggatattttattgcttatagatttaatttcctcatatgaacagtgacatcacccataaatgttcaaatatttactactctttccagttatagatttcttctggggtggaaagcaaaattattgtttgtgtataagtaggaattcatttgcctagtgttactcaaaattgagcaatttgtagatgtgtttagtgttgattatttttattataagctcacaaatatttataaatattaaaccagatataagctccttctgcctatacaaccataaaaccaaaagaactttacaggttaaaatcaatgaaaactctaacaccaataaatttagactaagaaaactccaaaccaatacaatttagactaagaaaactccaaaccaatacaatttagactatattggggatgtcgctttgctgaaactaaattaccggtattggatagaagtatgtttgtataatttatatcaatttgcttaatttttaggatagtggttcttcctttgggcaattatttttatcattttagttatgttgtcctttgaacaaagagcccattttaaatgatccattttttaatgaatgagtcaatttaacagtacaaattattcatcatattttttctaataaacttactgagaataatctcttacaagttggtatgtataaaaatgggattcatgcaataagcatatctttttggaacagaagtataattcttactgctatggttcagaagattataggtttaatataacacttcaatatgtagtttaattattacataattgtatattttataacgtaatatataagctatcattgctatatggtgactcacttgtttcactactttcactatggtaaaaatgtctttcaacctcatgctatgatacactttaccttctgttaagtaaaacaaatcatttgtatattaaattctattatgttttttctcaatagcccaagactattacaatgtatttatatttataaatattaaaatatttttcattatcatttcattatcacgaaactatgttgtaactttgaattactgctacaaaatattcaacatgcacaaataagtggatgtgggacaattattttaattttgacattagaacatgccatcttgatagaatactcattacccagtgaaaattagattctgtcgtttaaggtgaccctgtgttactagcataagcctcaaaaacatcacaagagagcccttgagtaacatggcagtattcagttgtaaactggttatccagatcgtcctgaatatttatgaaactccaatgagtatattacttctatttctactagacggggactgaggctctaggaagacaagtttgcagactgtataaaagaaaaatgcattttataattgttctgatatattagaccacacacacacacacacacacacacacaccatatacatgtatatatatttcaaagcaagcatttgtcaaaacaaaaataagccctttattcttatatttcttaagcattgaaaattagaaagcacacaatatctgaaattactatagaattttttatatatttatctgcttccctaaaattacaattttcatttgtcttctaaaaattacgtgggaatgcataccagtgaattataatgacctaggaatctgagggtaggacttgaaatcagcaaaagatactaagaagggaagagaaaaattattctcaaaacaggaggattttcaaaactagggagcagcagaaaatgaggaagatgaagtgacaagttagggaagagtcatagtggttctacatgtgagaaaagcaggttcagatcccagcacttctctttgttccataggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctggtaagtctccttttcatcccagcggtaatgatcatctgacctccagactctcagtgtttgattcctttgtctcactgccctatgtcaatatttcatttgcattacatgttttattaagcaggttttctagacaggcccaagactcaaacataaagactgctctttttttgaggctgtttttatttgtaagttatgttaatcacctccgggacacattcaagaaccaaacaggaaagacacaaaccaatctctggtagtgaaaaaaatggatttcatataaacttctatataaagtttgtgatgagaagcatactcaaatttatgaagggtgatttttcaatgttaaaagcataatatattgtgccaactgtgggtagataaggtgttgacttttaaatcagctgctgttctcctctgcaagatttaagttcctctgcaagatttaagttctcaagattttacaatgtcctctgagtttctgttcttcatagctatgcaaatgaggatgcaatattttgtacattggaatttctattttatatttatgtaaattggaggacatattctccattccacattgaatcactgaagctcgtcactgaacatgcatcgtttgacattctaaaatgagtgaattgaggggaagctgtgggagtgggctgcatcacgcagctctactggcagttctctagagtttgattctcagttgcattttccttgctattactgggtcatggaggatgttattaagggctaaaatgacttcgtggagatttggaagaatactggagatatacttctatttcagcccaagaaaacatgctatgcccccttcttcttatgaattggaaacttgattccattgaatttcaatgtccttactgtggaggtaaagcaggtcattaccttgcttcaggctacagcagtaccaagaaattatttgaatgagaatgccccaaatttgtagcatgtaattttataaagatgtttctcagacgtatactatttcaaaaaaggtttggattgtttctattgacttgtgacagttgatgcaatagaagactccttttaggtaacatatatttcttgacagaaagataccgaggatgaagtacgagatataatccgcagcaatattcatttacaaggcaaggtaagccaaattttattcttaagccacatttactacctatacattagttaatctctctttaaaataatactataaataatgttactttaaacattaaggtaatagacatattttaattagtcattatcctacttgcaaagccttttgtattaaaaattctaaagataataaatgatatatttttaaagaaaattaccagagattgtcaaattttggaaaaaatatatgtcatcagttgaaatacagattggatgtattcttttttaattattatactttaagttttagggtacatatgcacaacatgcaggtttgttacatatgtatacatgtgccatgttggtgtgctgcacccattagctcatcatttagcattaggtatatctcctaatgctgtccttcttgatagaggagttttagggtcttttggacgtagagaaggtgtctataagaaaatgttggctaggcacagtggctcacacctttaatcccaacagtttgggaggctgaggcaggcaaatcacttgagcccaagagtttgagcctgggcaacatggcaaaaccccgcctctacaaaaagtacaaaaattagctggatggtggtgcacacctgtagtcccagctacttgggtggctgaggtgggaggatggcttgagcctgggaggtggaggttgcagtgaaccaagaccgtgccactgcactccagcctagacaacaaagggaaaccctgtctcaaaaaacacaaaatttacatggagcgatcagtaattaaatatatatttttaagagtcgttagtctataggtgaattaggccatttttgctttactatatagaaatatctgagactgggtaatttaggaagaaaagaggtttaattgattcacggttctgcaggctgtacagaaagtataacacgggcatctgcttttggggaggttccaggaagcttaaaatcatggcagatggtgaaggagaggcaggcatctcgcctggcaggagcaggaacaagagcagtgaggagggaggtgccacacacttaaacagccagatctcacgagaatcttgagggcagcaccaaggggatgctgcgaagccacttatgaaagttttgccccgtgatcaactcagctcccaccaggccccgcctccaacactgaggattacatttccacataaggctgctaaaccacttatgaaagttttgccccatgatcaactcagctcccaccaggtcccgtctccaacactgaggattacatttccacataaggctgctaaaccacttatgaaagttttgccccatgatcaactcagctcccaccaggtcccgtctccaacactgaggattacatttccacatgagatttgggcagggacacagatccacactatatcaataggctatatcgagatttgcagcaataggaataagtgagtttacctaaggagaagagaagcgtgtacagttggaataaaaacatggatggaaatcgatagaacacctactttttaatggtgggtgaaagaattgttagaagtagttttggcaatccagtgaccatttactattatttggaaattttttataccattgaataaattattcatttgtttataaaacctgtgatgcagttttaaaagtcaagctagtattttgactcagcctgttgtcttctattctgggtgtcccttctgaggaattttttttaattatgaaaatacgcaaatgtcaaaaagtagcaacaacaatataatatatgcctttctgggtattaaaatgtctctttccaaagatccaaatcatatgatttttaaattagcattttaaagaataagataaaggtgagacatgcctttaccatattcacaatgcacaagtattcattcagagcaaatttcatgtgaagtttgatgtgtactcagttgtttactaacaattcttttagagtgagattaattactattagagtatgatctcttttcagatagccagaagaatttgaacatttttttaaaagtttataaagcctctattggaacttcagaagaaaagtttacactacaaacatttttcccctatagggagagacactaaatgtttttatgtacatgggtatttgagaagatcaggtaccccatgaaagggtgcaggggatccccaggggaccctagaccatacctggagcaccattatctagttcaacaattactgagttagagacagagagtgctcagtacctcttaagaggagtctgggccaatctcaagaaatggtcaaataaaggtggttatgattataagcagaaagaagtttgtccattatattctaaaggtcacttgtaagaatattttggacagtttagatgacgtattcaggagacaggaagaaggaagagagcaaaaaaggaaacattgattgtccatatttcacctccaaatgaataagacctgaaaataaagaggtaatgaataaatattcatcttgtcattttattctacactttcttaaactaggagttaggcaggcatattaatgagatacacagattttcaaaaaatgaatttttttattcctaacttcttgaatacattgtcttgaaattgtagggctgttcatcctgaggccagaggagtaattttatgttagaataaagattctactttattaattatgtattaaatagaactaagagtacagattaaaacctgtaagtatcaaacatagtcctcagacttaaaaagtaaacggatgaaaacattttattttatcaaaggataagtagtctttacaaatcatttatccctatacaaagctctatctgtctgtgtttgcctgtagatgaaaattatttctgacattttaactaggcactctcagtctgggagttgtgaagttttagatgtcatctatttatttctgcttcataacattcagtctcccatttctaatggagattctaaagtagaagacaaggggattgctttgtccgttttttgtttgtttgttttttgagatggagtctcactctgtcactcagactggagggcattggtgcaatctcggttcactgcaacctccacctccttgggttcaagcgattctcctgcctcagcctcccgagtagctgtgattacaggcgtgcaccaccacacccagctaattttttgtatttttaatcgagaagaggtttcaccatgttggccaggctggtctcaaactcctgacctcaagtaatccacccaccttggcctcccaaagtgctgggattacaggagtgagccaccgtgcccggctgctttgtccatttttaataacatacttattctatattatttctttgaactgatatgttctacccccattaaattgcttgcttttgtcaatttctatgacttataataatgtttctaaacacatgaagatttcatatacgtttttcaccaaggaaatttgatgctattgaaaagtaaaatgtgtagactcctttatgatgagtgtgattttaaaaacatctattgatttatataatttaatatctttgcctcagtgaaattaagcgctgttgtagagtccaaatatttataggtaaatgctatcctatatccttgcccataaaagtaaacatagaaatctttctacaattagactgtgaatggggaggagaagagcatgggtagccttacccattttgttttccagtttcccactcatccttaagccctagttacaacgtcttgtgttaagggaaatctacccaaccaccaaagagtatgataaatctcacggtattttatattttgttttagtagcccttatcacaattttaaatatttgtttaatgtctgtcttctctactagatgataaatttcatgatgaccaggactttatctgtctttcttagtatttttaatttttttttttttttgagatggagtctcgctctgtcgcccaggctggagtgcagtggcgcgatctcggctcactgcaagctccgcctcccgggttcacgctgttctcctgcctcagcctcccgagtagctgggactacaggcgcccgccaccacgcctggctaattttttgtatttttagtagaaacggggtttcaccgtgttaaccaggacggtctcgatctgctgacctcatgatccgcccacctcggcctcccaaagtgctgggattacaggcgtgagccaccgtgcctggccaatatttttaatttttaataattgtatatagttaaggtgtccaacaggatgtttcaatatacataagcatagtcacatgattagtgtagtcagacaaattagcatatctatctcctcgcatagttaccttttgcctgtatgtgctaagagctcctggaatctactctcagcaaatttccagtatgaattgcagcattattaactgtaatcaccatgctgtacattagatctccagacctgttcatcctacataactgcagctgcgcgtcatgtcttaactggtaaacactgtaaagcccaataaataatgatgggtggactcttcctatctttagattgtaaccttgtttttagattcccatcttcccattgtaaccttttccttttttctgcagttggaggatcctgctattagatggcaaatggctctttacaaagacttaccaaacaggactgatgatacctcagatccagagaagacggtagaaagagtattggatatagcaaatgtgctttttcatcttgaacaggtcaggctttgtgtcaattcaatcatatttgccttagccacatacaaatattttaaaaagagaatgtgtgttaatttgttaactatgacccaagaaacatatatgttcagcatattcattctaaagaataagagtccggtgtgcttagtatttcataaagacaatttctaagcttacaaatcttgtagcaatatatagattatatattttgggagatcctggcctttgttttgttgtcttttttcaaatatttctgaaagtattaggattatatttttaaattattctaaccaaaaaattcaggagttacatctgatttcaaatactttatgcatacttcattttttaatattgctcataaaaacatgtttgagatattatcttttaccggtttaatatttgaaacattttcttttttgccacttgtttaaccttgccttttattaggtatatttttgagctaattttctctgaaatcaggaacaaattacacttagagaagaacaatgcattgatagatattaaaatcatgtaagaaaagtgtttttatatattttttcagttgtgtcctactttacactacaaagctcagtttgatattcattacctttgcacaagaatgtgtaaaacaagaatacttgaaacattatcaatgggagggtcatatttttacagaagagatcatctggcttaggtaaaatatctgcaacacagagatatattatctatttctcatcaagtccattcagcaaaataatcacagtgaagaagctcattgtaacttgaccatctgatctgtcacagggctcttatgacagatcatactgttgatgacttggttattttatactaaatataaaataataataagatgccctatgccatctcaggaactttgccacctaaatgtatgtgtgtgtgcatatatatatatatatatatatatatatatatatgtatgtgtgataaatttcatagatgataaattaaattatatatatataattttgtattgcctttagccatatttgaacatattatcatagcaataataaacattttgcttgtattcctgttttatattatctgaaccctcacccctgccctggacagtttaataatgcaaagatatcatctaatgtagtatccttttaacttccttcttgcttactcaaataccctcccccaaacgttaataatttctctattgtcatgcaatttatcactacacttgatgagattaaagtcactaggatacccttaagctgtatggctattaacatatatttacgttatctaataccttggaacttaatactttcccctgaataacttacgtaatattttcatgaaatattaaataaatacaaattatcatcaatcagcagatgacaagacttgtcatgaaattttaagtgatttatataaagtcatagagttttatctccagaattatatatatatatgtttaagattattaaaggttaattaaatggctacatttctgacagcattgctctaccatcagtttttaattcttcctagtgtttatacatatatatagatttgcttgaataaattctagatacattaaatgaagcttatagaaactgattctattttattatattcccatatattcataaatatatccaatcatgatgaatgatggcatttctcaaatgaggttcacttttctaagtatccatttatgccttggatgtttatggagttccctgtcctagggcagccttatccccagcagacctggaggactgagtgctgtaagagaggaaacagacacttaaacagataaatatgggatgatacggagctgttaggatataaaatgtgctgaagaaagtatagaagcaacccatacttaatgtagatatgaagtaggtaatccctgtataagtcttaaggtaggaattatctagaaaaagtgggaggatcagagtttttcaaactgttaagaatatggcgagattggtttatcatgagaggagggttttgagttaaaagaaattgtcgattatcaaaaataaaaagtgggagatatcctcgtgtttaatttatgcctttaatatccctctgctaatgataacatgtgactgagtcacagaggagcgtgcaaagaatattttaacttgcaaacgtcagtgtaaaaaacagtaggtggacaggaaacacttgttgatttaatttatctcaagtatcagcagcctgttttagatgtatattttgtgttgtatatctggtaagttttcttatgagagtaggttatctccattgaattttctaataatcaaattctagccaagctaacacatcagcacatcaagacattcagacagggttacaaggtacatctttgtgttcgcctttggatcacatatctcacagataactatttacttatcattgatttagaggaaagcacactcaggtatttcctgaaatactttaataggcaggtaataaaatgcctgccaaatgataagcttcctggtggcaggaaccctttttgttggatttttactgtatcttaaatgccttaggaacttaaaatatgtttgtcaactgtcacccatgctgatcataatgctgtaattcctgtaaaaagctatcatctacagactggggtctcaaaatggaaatttaaattgaagtatgttgggtctcattgaaaactattgcccttgattgcttttacttctatgttaaaggcctaacagtggtttatttcacttgacacaagcatcaagaagatgattgaagtggataattgtcaccacgtgtttattgatcatagagggggaagagcatcacagaaataagtgcttttccgttaaacaagttgcctcgtgaaaatttctaaaccaccgcagtccaaacattttaaatgtttacttcagacattattacaatcatttttgactctttactgcaaaggataataaatgtagttttacttttttagctaacataacatttttatttctttcagaagtctaaacgtgtgggtcggagacattactgtctgggaagtacagtgctcaatggcctagagattactaattaatttaggtttatatgttgggattttttctttctaatacaattaatctctttcttctcttagagttccaaacactattagttatataaataacttgcttgcatcatttattgcaacttttgaatttatatttgtccctatctaacaaaatatttacatattttaacatttttaccaaatttactcactcctaatactgtgttcacaaagcgttgtcttcttctctttatcctgctgtattaaagaatagtagaatttttattaactgtctctttttgtgtttattactttagctcttacaataaaattagttacaatggacatatgaataagaatgaggtaatattttatgtaggcagaaaatatgtattaaaatcataaagaaccaaagaaaattttgagaaggagataaaatgattttatatggaatgattttctatttctttgattttagaggtgacatagctttgaagtacacagtattgggaaaatgtgatattcttactaagggaattatatagcatttgcaactatctaaattttatctttgggtaacttttaggatatggacttcttcatgataatcttaaggtacttttggaattggaattccaaatatagattacttaagaggggcaactgtttaatactatatttttgaagatagtttggggtgtaaatatttatttgtttttgaaggtagtttggggtgtaaatatttatttgtgtcattctacctcaggtggaacatcctcagagatctaaaaaggctgtatggcataaactactgtccaagcagaggaaaagggctgttgtagcctgcttccggatggcccccttatataatctgccaaggtcggaattactttattttttgtaatagatcaatgttattttttcctagtaagtgacaggtgtttagaatctaccttaataggggtacaatagtccaagagaaggatggaaaagctttattgattcttctacataaaacttgactaattttgttggatattttcggagaactgtggtctttaatgtaattattaaatgactcttactgaggaatatctgctcacatatgtgaggcaagagagagtcattaggagttctttctttgtcctggatttgaatcagaacatgatctgaatcattctttggcatcagacttgtcttgatttgaattctgacctcccaacttctctgccccatgacattggtcaagttatttactggcgaattttctcatctgtatcataatgggatcagccttatagagttgttcagattatttaatgggttgatgtatacagagtgcttagaagtgagctagtaggtttatgtcatgataaatgttagtcattattattatttttgtaattattagcattaggggaaaagaactgacttatgggaataatgtaaaaagatttgacaggcccgtcaaccttctcttagacatagagcagacatacttaatagagaagtagcctggtacattcaagtctggcttaggtggtccagggtaccatttcagtcaccttggagttctctgagaaactatgctctttcccactctgaagtttatacaaattgcatcacctctatgtctcagaaacaggactcagctcagctacatctcttttgtggaacatctctgaccaagccatgcccctctactccttgcacatcataccactttcctacagtattaaggctatttgtctctttgattcagactttgagatcctgtactagttttgttccattttctttcttcagcacctagaacagtgacttgtacattgacattcagtaagagtttgagtgaatgtataaggcaaagaaaaaaaagaaacataagcaaaacaaatagaggaaacatcatacttttcccttttgctaagacagctgtatttcttgccatcgtgtcacactcactgggtctaaaatgtattagcatcctcctcaaatgtgctacttctcaattctctgactcaattatgctgtcaccttttggtcagatagaatattaaccttaatatctagaaccagaaataccatttaacccagcaatcccatgactgggtatatacccaaaggattataaatcattctactataaagacacatgcacatgtatgtttattgcagcactgttcacaatagtaaagacttggaaccaacccaaatgcccatcaatgatagactggataaagaaaaagtggcacatatacaccatggaatactatgcagccataaaaaaagaatgagttcatgtcccttgcagggacatggataaagctggaaaccatcattctcagcaaactaacacaggaacagaaaataaaataccacatgttctcactcataagtgggagtcgaacaatgagaacacatggatacagggaggggaacatcacacactggggcctgtcggggggtgggggcaatgggagggagagtattaagacaaatacctaatgcatatggggcttaaaacctagaagatgggttgataggtgcagcaaaccaccatggcacatgtatacctatgtaacaaacctgcacattctgcacatgtatcccagaacttaaagtaatgaaagcaaaaaaaaagaatattaactttgaattcacattatcatttctttttggttactcctatactgtcattgcccagatttcatcagtttccctttgaactacttcacattcccatccttccctccatcaccacctcttcaagtcgcttgttccttgcctcatatcaagttgatggcagtggtttctgagttagtttctgtgatgtcatagagttcttccatcctctccaaaatgtcattttcaaaatggtatcctttattccagtggttcgccaacctggtgcttttaagaaacacacttaaactcatttaaaaagtattcaggcctcaacttattaaattagaatttcagtgagagcccagcatgtgtgctacttaaaagctacacaggtgactctgatgaacccagaaggctgagtctgtgctttggcatgccactctcacatacaagaatgtatgatgatttctagcagttccggctgcgttggcagttgccccctctgatttccaaggcccttcataaacctgtctaactgttacgtctcatgagtccttaacccaatttgttatcataaagctcagctttccatcctgcaatggcaccgtctctcattctatcacatctgttgttgttttatgatgttcccttcatgacattcttttattctttcttaccttgacatcttatccacatctcttactaacttcatcatgaattccactgattcttctcatctgcactggtcttttttcacaggcggccatttatgataagtagtgcagggtttaatctttgagtatgtactcccataaagttcacttaataccttttgttttggaatcctcagggccatccatttgttttttaatgtttgcttggacagagactaagtcctctattgacactgattacattgcttatcgagagacatgttatatgataatagtcatttaatgaacatctaatcaatgcgatttacatcctttatctcattttaaggcttacaaaactgaaatgtggttggagttatcctggttttataaaggaataaactgaaatttgggaaagtcgagtcacttgaccaatgttacaaagcttggaaatgactgagccaggattgaaatgcaagtcactgtgcgctatgtttgctgcaagaagcattgtctttcaggaggagagtcaagaatagagaatttatttctattttacactttcagtgcacagataatctagtaataaagcactactcaatacaatttcaacttattttctaaacaccctttttctgaaattgtgcttacctttcaggcatcgggctgtcaatctctttcttcagggatatgaaaagtcttggattgaaacagaagaacattactttgaagataaactgatagaagatttagcagtatgtttttagtggggctctaagatgaaagagggtctaggcttggtgcagcaatgttggcgtgagcagtcattatataacattgaaggaaaaaatatcattacagtatatgggtattaggaaacttttaaatcttaattgttactgcattcaatgcttatgggaaaatgtgctcttgtcatttccaagagatctcatcaacatcaaggggttgagaatttaaaatgaataatatagaagtattattaattaaacatgatttagtctttcttttaaattccttctcaaagcacctataaacacctgagaaccaggatagactataaaagaatgaactgtcaagaagttatccacctaaattaagtagaaggtgaacaaaaaattgctggtttttagaaatcaacagggcagagaatgatagactgaacacaggagactgaacacatggtaaatgtggagcatgagaagtagaattttcaccagactgtgctgataaagagcttgtgagttcagcacagaacagcagtcagtatcatcttttctaagtcatggacccatctaaatatctggcaaaagccatcttctcaacaaaatttacaagccatctcaaaacttggcagactagtcagaggcttcatgattcccaagataaagacatcttgtgtaaagttattttttaactcacagattattagggaatataatggataaattaatctaattcttaaaagcctaatcttgattgtccccatattttaaaatgatttttatctgtctttagaataaaaaatgtgtagactattggatatcttgtggaaatctgcccattatccacattaaggcttaattacaggaaagaacaccattcatgtacagagaaaattagtttccatggctaagtcagtggagatataaaactcaacaaaaagttggatgtaattgaattctgccaataaaaatgcttaataattttcctcgctattaaagttctatccgatagtaaaaaaaaaatattttttaagttttaaaagtaactgaaaataagaaaaaaagtataagtggttcaagcattaactcatttagtattatttacgtatcatgctgtgtgtaagcgaagaaaatatttcactttataagcaatttgcactgctatgggaactaaattttcacacttggggtgactcaggattttattgcaaatatttgtaaatcgagtcctccctaaagctaaaatccatgcagcaaatatactttgagttatgaaaatgcttataagaatggcatttggtatttttaaatgatataagttatccctgctcatattaatttttggtcaaattattaaatatctctgttttgagctgcataattttacaatggtaatgtaacagatatctagcatattatattacatttatatatgttatagcatgtatattacatatttacacttacatgcaacacatatacatacaagcttttatatacacatacacacatatatacatatatagcatgtataatgcatataaaatacacacacacacacacacacacacacaccccacaacagggaaggaggaacgttcgcattccttttattcttcattgctgtccttcacagtgcttttggatttgagtgaacatttttttttaatgtgacattttataaatttgacttttttgcagaaacctggggctgaacctccagaagaagatgaaggcactaagagagttgatcctctacatcagctgatccttctgtttagtcggacagctttaacagagaaatggtatggttgggagggttcctatgagacataggaggagcaaataaagacacccgtgtctgagtattctgtgccatgtgttcatgttttaagttcatcttgttgttgttaggagagagaattgttcaaagataacaaccagcctggcatgtacctagggaccgacactcattcaattttaggcttcagcaactacctactagttctagtttttcttaacaactttgtaattaatgatgtagttgattctgattcttcttatgaaatggtttttctgtttatcacaaacaaactttataaataaaacaaaagaaccaaagcaaattccagtgccgcaagtgtatggagaccgatggtggccccaaattttctgggtagatagtgtctccattgtgcagtgggtcttaggaaacctctagaggctaagtgagccatcacctcaacttggaggtatctctgagatctatttcaagggcattgcccatttttcttgtcttctgcagccttagtcatatgaattcaccaaagccacaaagggcaaacctctctgaagttacataagaaatgcactggtaggcctgatcgtcaaaatgtgctcagcatctgtcattacggagggcaatgcataaattggctgtgcagatgggacatagcagaggctagaggacctttatctgctgccctgcaatgggaaagaaagcctgttttgcccccaggcctttcccattctctgcagaatttgggatgtaatttaattaaaaactcatatccacatgaatctcctcagaagagttcatttgacctctttgcctgccataataatgtacatttctccctcttagctaatgtgatctatcctttctctcactatttctctctctcttattatttcctaactaacaaaatcatctcattcctaagcatagagcaactctctctctggcattgtcaggtaatgaggtatttctcataagtgaatttttctcatggctgaagtttaaaactgctgaaataactttgcaaattttaggtatatttttggtggaaacttttcttcacgtagtcatggtttccatgcttctcaaaaagaagataataaacatattttaacctttcttaatttttagggatcattattatggccatcttgttttttaattgtcatatcataatttggggactctttccatcaaatgtcaaatttcacttctgtcaaaagcccccacctcatttaagtttgcttgtttcaagttttgtagtctgaagaaaattaaaattattacatttgtgtgtaaaccaaaagacagtttattttgtgaaaattgaaggcccttctgtaaggtaagatgggacagctatttaggatccccgggatctttgctttctgatttcaggatatttctgaatatcctaatattgtcttagttttgtgttcatttaattttaaaaaggtatacttgttagaaaaagaacaaaggttattttaagcagcgatgatacgtgtgcatgtgcctagccttctgcttaaacactgatgttttcttcttgctttccccagcaaactggaggaagattttttatatatggcctatgcagatattatggcaaaggtaaataagtatccttcctgattttcatgtttaattttaataaagggaagtaactttcatctgaaaaggataagaatctgtgtatttcattaatttcaactttttgtttgtagcatgaatctccgttctaaattccatggcaggtcatcattgtttcctacttaaacattttatttatgaggagccataactttttctaaacattcattcattcaacaaatatttgctggacatcaatatattggagataacatgtgaagaagaaagaagggcacacactacacctttgtggagttttttgtctgatggggaagataaagtttaagcaaatggttgtagaaaaaccctgatgaacttaatggcagagaaatgtatccctccatttttacactgctataaagaattacctgagactaggtaatctataagggaaacaagcttaattaactcacagttacacatggttggggaggtctcaggaacttataatcatggcggaaggcaaaggggaagtaaggtacatcttacatggcggcaagagagagagagaatggagtggggggctgtcaaacactgttaaaccatcatatcttgtgagaactcactcactatcgtgagaacagcatgagggaaaccgtccccatgatccaatcacctcccaccttgtccctcccttgacacttggggattacaattcgatataagattttggtggggatacagagccaaaccatgtcaagaaactcttaggagtattgggaacaggtcccatggcatagtagtgaggtctgcttaaggaagtctttggctgttgaaccatgagttggccatgcaaaaatagtacagcttagtatttactgagtgtttatgtcatttactcctcttgacaagtggataaattgaggataaaagtggagtgaaggttttgctaaggcttctcacttgggtaccatgtactgagatggctgcaccagaataattacaggcctggggtgaagagagaagaaggcaaagtaaattgtggatgcgttaaagatgcctgtgagacatctaagtggaggtgtcaaacatgcaattagacattcatgtctgacattcagtatctcaggtaaggcttataaatatagacttggaatttatcagcattagaagccgtaggagtagatgatcttacccaggaagagatgacagcatgaggagaggaggaggcctaggacctagcctgtaaggacacagaacattaaaagatggttagaaggaaaggagctcataaaaaagttggagagaaccttaagtgtgagctaacataggagctagaagctataggacttattgtgtggtcaccaaaatcatgttctgctgtgagattgagcaaggtagggattgaaaatctccagatttatttcatgtatatcacataagcagagtaagaacagcttctgcggtttgtggagaggggccatggagtggggacatgctgtagtgtgagaaagtaagtagtgattcagatgtgaacagaaatagtatagttgtttcttcattgcaaagattgagagggaacagaaagatataaggtaacaaatatctagatggaattgtgaggttgaaggggattatttttgtttgtttgccatttgtttgcttgtttttaaagagagagccatctaagcacacatatattctggtgagaaggagccaacagaataggaaagggaatcatttgtgaagtgaggtctggagtccatgagacctgctggagaagacaggttacaggacataagggaaaagccatggctttctaatttattttaaactctaacctacagcaagaaatacatttacccggtacagtcatctctcagtattcatgggggattggtcccaggacccccagtgggatatcaaaatccaagaatgctcaaatccctgactaatggcatagtatttgcatgtaacctacacacatcctcctgtatacttagatcatctctagattacttataatacctaatacaatgtaaatgccaagtaaatagttgttcaactctatcatattgttatggaataatgataagaaaaatatctgtacatgttcagtacagacacaatcacccattttactttctccaaatattttctatccacagttggttgactccatggattcagaaccaatggagggccaactgtatatttatagaaacataaaactgtatgtttaaagtaacataaaaatatatgccatgaaagaaaagtttcacaaaattttactcttcctatgagcaatgtagtctgaacttttccattctatttaaacagagttgtttttattttatcatgaatcaccaaattgtttttatgtctgattgatgagctgaaacacatagtttaataaacactgggttaaaagataaaaggatagggctgggcacggtggctcacacctataatctcagcactttgggaggccgaggcggatggatcatttgagatcaggagtttgagagcagcctggccaacatggtgaaaccccgtctctgctaaaaatacaaaaattagccaggcacggtggtgcacacctgtaatcccagctcctcaggaggctgaggcaggagaattgcttgaatctgggaggcggaaagttgcagtgagccgtgattgcaccactgcactccaggctgggcgatggagtgagagtccgtttcaaaaaaaaaaaaaaaagataaaaggataaaagatacaaagggaagaagggaaggctgccaggataatgggaggttggaaatgtttccttttaaggttatttgctcgctctctctctgaagacaaaaggacagtcacctgctgacacctaagtgtttgatgaagtctataaaggaaggctagaggagagagagaagcaaaggaaggctggaggagagagagaagcactgaaagagacatcgtggcaattggcatggcacatgggctagaaattaaaataggactcacggactgtgaaggaagcctggtttattttaggctgttgtctacgaatttgtagcagtaatgctccccctggctgtgtgaggacaactagcaattctcagaaccaaatgcaaattctgagaagccaggaagttagattcatcaagggtgaagatttctgccagactcttgttgagaacagtagatcaaagcaggtttgtatgttgctaggaggtggcttgtaaggaaatgaagaaagagggaggtgagaaagagattgtagagcagcccccagcctgggtgttctctgcagctgaagaatcgaagtgggctgaacaggtagaagctcctggtttgagaataggtagaagctcttgatttaagaataggttgtttctgattgttagagttcttccttgtgagtgaaactgaatttgcctccatattgattttgttggatcctaaagctaaatctagtttcttttgatagatggtcaaatatttgaggagggctaccttgttgatgctttatctcaaattttccccttcataattaaataatcatattcattttattgtttaatgtaactcagggatgtccagcttgcaccacgcagtttgttacactcggcacattctccagtatattcatatgtgccacccagaagttaatcaaacacggtattccagttacgacctcacctgcgtagtgtgtatgggaactgtaccctcacttgcactgccttaggatcttatacatttgccatcaatggcaagaatgcattaaattttcagccaggtcatgtcagctatcctgtattatactgttgacttttaattttttaattaagtatatgtcatcatttctataattcaagtcagaccattgccccaggctgaaatctttctaacatttgattctgtcatacactgttatctctttccatttgtgttaaccacaaacttaagtgtgattgatttctctgtttatctcagttggtagtgtgcagctgaaatttttataccctttcccagactggttaacctactttgttttcaatccatctaaacatacttttataaaactcatatttctcatctcctttcatgagattcttaaagaaatcaagatgttactgtgattgcttaaactcgaattctaactttggtaaaactgccaaagatggatgagtattcctcagtgatttgcttgataacccattttagactattgttgattattaatatcgaacttcctagcgggtagtttttggaagctgtctttcctcattttaaaaattagcatcccagttgtctggaactttcacttggccttcatggtttctcggtttaccaacagtcattctgcatccacggatgttacttttgctttgagtcttgatacttgagacttgaactcactttaagagactgttgtatgtgtcttcctccaccactgcaggtcccttggaaggcatcatttatatcttacttaggtttttgtttttcagttttaattgttttttaaacttaggaacacagagttgggttaatgataactctgaattcatgatacacagtcactgttagtccactagtgtctacttttaaagttacttagtcatttctaataatgtagtaactacccataaacccacttctgacaagaaacaacctagagaatttacgtgttatcctatgggcttctcattaacctataccctgtctccccacacaaagaaaccatcattctaaaccttgtgctcaagatgcccttgcttttcttttcatgtagttttcatttatttatatatagatagataaattttcatatatatataatttaagttgttactgacttttaaaagggcagtaggctgtgtgtaatattttgggctctacttattgaattaatagtgttttctaagattcctccatacttttttgtgctgttggagttcatttttttttattgttgtgttatttccctttgggcagatataccagagcttatccatttacctttttcgttgatagacttttgtatcacctctgtgtttttgctaatgtgaacagggattgaatgcctattcttatccatttcacctatcttacaagagctacagggtgtacccattttcaaataaaggaacaaatgtcatactgttttccaaagttactgcatcaatggacattcttaacaacaatggttaagagagattctggtgatccacaccccctccaatatttgatatatgagttactgacttttgtcaaccaaatgggtatgaaatggtattttgctggagtcatgattttcatttctcttggctaggtacttttctgtattacaaacatcacttctttctgaaacaaaagagctgatgagtggttctgcacgtcctctctattatgatgagtacagcatctgctctaaatcatgtgcttactgctccttgttgaccatactttggtgataatttgaaaaatcattttacatctttgtatctttcaagccacacttcattctaaactctattcccctactcctatcatatatacttcctctttaaaaaatcctatggagaacttcagtgcatcccatcggtttgctgttgccacccctttttgtctgcatcatgcctaccctgctcgattccttagaatgtctctttaccagctgtcatccctcttggactatttgaagctgcttcaccccaacggtggttttaccaatttgaataaggtaacagtatggaggaagatatctgcaatgatatcacaaattaaacactcaacaatgttgctgctgttttgagtttccagctaagggaactctttcctcctagttctcctccttctcttattaactttttaaaatatttaagatacacatcgttatgcctagtgttccattctttcttggttaaaagtataaaatgctgcggtcacattcttatgagtttctctcttctgtctcacccatgagctctctgttagtcagatttaaatccacaatgaaagtttctgggttttgattccttagtcttctgcggagttatcaaatcagaaaggcaactaaggaatgcatgaaatatacttctgtggcagaatgaaattttcagcagatactggcaagctgaagagccctcattactgtgttatgtattcgtgctgccagttttgaattctgttgtggatacctgaatgatctgacatatcctccattttatttattttcttcgaaattatttattccacacctgcccctttatgtatttagcttattcaccttttccttcctggcaaaagaaggactcttccttgtctagaatttagcattctgatccagaaagccaaatcctgctacaggactgtctaatataacttcccatttgcttagcattatcatctatgtcacgtggatgccatttgctattgaagaacatatcttttgttccagtaaatccttctgtttctctacagtatattcaaaagctgctagaaatctgataccttttttgtttgtgtgatcttagcatattctcaagctaattagtagaagtttaaagtagtttttataggtttggtgaatttgtcagatacagtctgtacaccaagtaaattcaggtttaatagtttttaaaaatcacaaattttaacttcattaggagcaaatctcattaaattttcctaggaagatttttttaaaacagttaaaatattttatttcaaaatacttttttattaaaaatttttttcagctagtgctttaaatggattatccctttgtacaaaagcaaacatggcttatgaattttatggcttaaaaacatatcattataatcccaaataacaatttgtctgaatgtattctttatctcaatccttgtgtctctcctatgtttctgaaggtcatgaaatttttatagaagactatgtctttgagaaaatgtaaaatttcatatccttgagacattgtatattagtgttctaatttgcatagagagtaagcatgcttgttatctgataaaattcctattctttttactcctatttactaatgcacactgctaattattgggaataatgggagatattagaataggtagtcttaaggagcagctaagcaaaattcctctgttttcgacattagatgtacagtatgtattgatggaggactgcagatttgccttccaaatctgttttgctaaagttctcatgagttcttattttttaaatcctggctgactaataacatgggagacagagcagcagaaactcaaaggagaacatttcctgctttctgagggaatcattaacatctttgcttttgtgatgaaatgtgcagtttaacatattacccagacaatgaaactgtcctaggcctgcgtccccacctttatttcctcctttgcaaactatgctcatgtgcctatcattataaacagaaagcgtggtgctatcatgataaacagaaagggtagtatatatttgttgaatgaatgaaagaatatgacaaaccttttagaatttatcacggagtgagtggaagggtcacattgtttaccttccctcccatccccagttcatctccatgcccagagtactgtgtctcaccgaattaaaaatatgtttatgatttgtagcttatatttcattatctgccttcatacaccccatggaaacattgaatgcttaccaagcagcagaaatacgtgtaagggttggaacaatctaactttgatgagctgtagggttcttcctactatagctattggttaatgaccaatttcttttggtcactattatactacagaccataataataatagcagctgagatgtattaaaagcatgtatttttcagactcttttttctttattttatttttttgagatggaggctcattctgtcacccaggctggaatgcaatggcacaatcttggctcactgcagcctccgcctcctgggttcaagcaattctcctgcctcagcctcccgagtagctggcattacaggtgcccgccaccatgcccagctaatatttgtatttttagtagagacagggtttcaccatgttgttcaggctggtctggaactcctgacctcaggtgatctgcccgctactgcctcccaaagtgctgggattacaggggtgagccacctcgcccggtctaattttaactaatggtcattatatttgcctgtattcgtgcattgcaatggcagcataaaaaaaagagaaaatccttttaaggtttgcagtttggtttgaatgaggcaaatgtatgaataagtagcgggtatagtatgatgtggacctcatagttatctctgttacctataaaatatgtaatttaatattttatttttgtaaaagcactatatataattttcatgtcatgaattcattgattatgtcatctaagcattctatcttacatgtgtttaaacaaggttgatgataaattaatacaaatgatttgctcttctatgtctaatgttcttttgcactttctaaaatctcaacatattcctgtctcctttttttttttttttaaatatacagagttgtcatgatgaggaagatgacgatggtgaagaggaagtgaagagttttgaagtaagatggatctttctggatttgcctttctttctatcttgaaacattgtttcatagcttataactgacatttatgtttcttgcttcatggcttattgcagcttattgtgtcaaggaactgcatgtcagagctggatggacaaacctgagtcctaacatttgctgaagttaagaccaaggatcatagaatagttaaataatataatgaagcacatatgttcagaatgagtgttcctgagaaccctcagagatgagacggcttcaaattggtctcatctcagcgatgtggtctggaatttccaacagacgtgaggaaaatatttattgaagaacaacatgatgtcaagtttttcagtaaacccttggtttgatattttttcctgaatagaagtcttaaagatttggccttaaagacttctgcccaattagatcactcattccatgtacatatgcagatagtggcacacaacgcagtttgcttgcatgaggtaggagtccatatatccctaggactgtattgtagtttacaactattttctcaaatgctctcagcttttaaatgtcctacgtaatttgaaatgctgcttaatgttacttagcccaaaggaaagttaatagtattttccccctttgcttatactgtactttcgttttttatgaggaaaagctagttgttgctaactaccgctttttttgtttattggctctttttttgttttgttttgtttttttagaattttcataaagaaattaagtgcagggaaatagaaattagattctttttcttttccttttaatttacatgtctggactttgagctagaagtctggaaatatatcagtagccagcaatgagtctttaattaaagtggacccacaaaaacgtattagccaatgaataagctcagagcagtgaccttccaggatgcatttgttatgaacctctctgcagcattgaagtcaatgtgtcaaaaatataaaaacaatctaatttgaggaacccatgactattgctggctgagaaaaatgccataagattaatttctgtatgatttctataatcttttctaatgtatatgttttctattctcaaagtcatctttattgataagaaagtgaggtcagtttagaatgagctgtgagcagcagataatattgtttttctgaagtgcacagcatttatagtctatccgttgtcttcagagcaattgtttattgctattttgcttcttgtcctcatccttccttaaggtcacaggatcccaacgcagcaaggtaaaactatatatatgtgtgtatttgtctgggtctgagtttcggtttcttgtgacatttacctttgttagacccaacatcttggattcttttgtgaaaaggaggtcttgaaaatctttctacaagtttgtagctccaatgcatttggtctcttcaggatcccttcctttgacacaagtttattcttcttgcaatttaaatgactcataatttgaaattttatcctccagctaactttgagctgcatactgtgctgggataaaggagtccagccctttggatgacaaactttttaagccagggacttctcattttcggtgcaatgttctgaccttatccctcttgatgtttttcaacaccagttttattacttgaaaacagacatgataaatggtattgctggtgagattggaaagaagcctgcttttccattgtgctagtaatcacttcaattagtaactggagattatattccatgatttcaatattgatttcattgttgcattaaagggaagaactagatgactatttctctcttaatattttgaatactgggaacatttgctaaaagaaaacattttgatatagaattacaaaattacttacattaatatgaaccttgttaagcttatgttttattttcataaggctatatggtaggaaaatcaatcataaacattctgtgaagatgatacctataaagactttagttttgtttgtttgtttaaaaaaaaaaaaagctttttaggtggccaggtgcagaggcttacgcttgtaatcccagcactttgggaggctgaggcgggtggatcacttgagatcaggagtttgagaccagcctggccaatgtggtgaaacctcatctctactaaaaatacaaaaattagccgggcgtggtagtgcacgcctgtaatcccagctactggggaggccgaggcaggagaatcacttgaacctgggagaaggaggttgcagtgagccgagattgctccattgcactccagcctgggcgacaagagtgaaactccgtctcaacaacaacaaaaaagctttttagtttgtaagtgtaaactattctactttgccttctttttttaaaaaaaaaaaaagtgaaatatttgctgccaaaatgaattttagactgtcttgaagaaactattttaaaattcctttgtaattttttttttttttttttgagacagagtctcactgtgtcaggctggagtgcagtggcaggatctcagctcactgcaatctccacctcctgggttcaaacagttcccctgcctcagcctcccgagtagctaggactacagtggcgcgccaccacgcccggctaagctaattttttgtatttttagtagagacggggtttcaccatgttggccacaatggtctttatctcctgacctcatgatccacccatctgggcctcccaaagtgctgggattacagtcctgagccaccacgcccagccactttttaatttttttaactcactgttatagttggaggaatatatagttcttgtatcatcatccttgcaaatttcaaaatgtaaatcatgtatatactatcagatgcagctctgatccgatggatataatggttaatggcatacaatgggcctaacacttaataatatattatgggcttaaataatagataataatgggtataataagaatttggtagattttgattttttatcacgaattatttcatataaaatttatgtgaattgttgagggatgaaaatatgaagggctctcctaacattaagtaaagaactgatttcctaagtagcataaaagttaatgcctcaagaatgtgttgatagttgtatgatggggctggatggcagagaaggtgttgctagccaagaaaaccattttaccttgaaagaggaatgcagtttcagggagatcggtttgataaatagggtcaaatttagtgacattagaaaggctcctcattcagaaaagaagtccgaaagacgacaagtgatggcatcttaatatttagacactaggattcaggccagactaaggacaagaagtcaaatgacatatggagcatgacctgagagaaagggctacctttgaacttagaatagtggacaagttcacatggtggtgaaacctggcaattaatcccaaaacagaggatacagaccagcagatatgactgtctcagcaagagacaggcttttaaagtgctgggaattgccacacatttataggtgtaatgcaggacaccagatttggggatttgcgcttcctaatgagatttttttttttttagtgatctccatctgatttgggactataatttataattcacacctaatttatgtaacatgctactcttaacaaaatactgtgtatgtggtatgaaatattacaaagctgagaaacagagatatatataattaattccctataaagatactcttctctgaggttgactatgtgacaccaacaaaaccactgaaaaatttattgtttataaatgtagtaatctaccatacttttacattgagatgtctatctgacataatttagacatagtctaatagtggagttattcacataagttacaaatatgaaaggctacttgtcagtttcaataattcttataacacattatatcaaataaatttggaaataacataaagtgtgtggtaattgaattctatccctatacctggttaattattaatatttgctatagtttctatttaaattctttccctgtaaaatattccataaagtcattgagaagagaaacgaagtaggtaaaaagaaaagtgctattatagggaaattttccatgaagaatgcagtaaagctcaaaaaacatggaaaacaaggaaagaggaatgatttgccagctcttttcttcttccatcatatatatatatgtattgttcatatgatcctgttaaattaaaacgtgcctgatttaacctgattacaaaattccctgtttcatctgtaatataggtaaatatgctttcctgtaactacttattaaataactttattgcatatttagttaattattttttaggtttggagctacttctctatcaaaagcattaaaaagaacagttaaatcttataaagaggccgatgttaattgaaagggaagaaatgttttaccagttacctgaaaaaaataattattggagttgaatgctagatttagctttttaatttttgctaagggaaataataataaataataatgtttcaagtcaaataacatcatttttctgagcattatgggtttttctcacctagatcaacaaagaactttgatactgcagtagaacacatttattaactatgattttattaaaaaaactcagaaacattctttagatggttacttcttttattgctcttctctaaaatctgagcatatagcattaaataataatttattgaaagcatttctttagaatattaaggtactgtagtatagatttgttgttgactgtgaaatctaaattaatgacagtgaagcttagataagcaagaggaatggaatgttaacttgtcttccagccatctttctcaaatactgggcaagctgcatcttccttttggcgaatgcccagtttctaattgacagatgaattatctgatgagtctgaggtcctatttttctgtactattgattaaagagaatttcttgtgtgttaaattctaaatatgcctgtggcagagttggtaattctgtaataaatacttaggaaaccagcatattctctcagatggatctgagacacaaataaaatattgtcatacctgctaacatactcaaaccaatacccagctcgtatcccacagtatgcaccattaagtatggaagaaccaatttaggtccaaaatgttttaaggattaatattatatagcactaccccaatgatgaaaagtttttgtctgacccgcccatgaatctaactttcaatagaatacaatgttttggtaatgctacaagaatgaatgggctgtaagatatactgccctccatggctacataatttgaactttgaatgggtttatttggtgcttttcatagtaacagcattttaaattaaaaagtcttcctgaatcttagcaaagagaatttttaaatgcataaaaattaaagatatagctacggatataaaatattgaaacaattattccttatatcaagaaaatttataattctttagttcctactgcaggaggtatatggtatccaaaatatggactaaagcattaagagttgcttttcatgctattgaatcatagaggggaaagagggaaggaattctgagggccagtgttctccagtactcacgctgattgccgcaatctgccaactacatttttatacaataaaattatgcatctcaagtgattatctcgtgtcttagctcagatttcctggaaaacacaggcaaaagcttacgtgctaacactttattgggggaaggggtgttaaaatcccagggaatgaagagttagggaaatagagaaacgatatggggaatgagggagggcaagtagaagatagagtgttcttgagctgatcacagctgttcagcagtacagtgtgttgctcagttgtgtgggatgcctcctgagagaccatatgcattacagaacagaacagtgcctccccggggaaggaggataggcactttatatgcaggttccttacatctcctgtcacttactggtcacagagtgttaatttcatcatacttcctgttgatattaaccagttcttccaggcaacccctggggaagccagagctgccttgaatacagcctgttgagtgtccaggcaccacagtctctccttatccattaacatggggtctccttggtgagtggtaatgatggtagcagctggctttcataagtacactgtgtgggggcagtcatttctagggccattctggctcagaagcaaggcaagtagccaaggcttagaaagaagggcataggttgggctggggggtcctggccttgacacaaggaagattcccagaaagcacaaccctctatattgtatatggtaattcatgcatatgagtatgtggaccaaaatagcagtctgtatagaagacatgcagctggccctctttatctgtggcttccacatccttggattcagccaactacagatttaaatattcgaaaaaatatttgcttctgtagccaacaagtacagacttttttcccttgtcactgttccctaaacaatacagcagaacaactacttacataacatttacattgtgtattaagtatttattataagggatctagagattatttaaagtagacaggaggatgtacgtaggttaagtgcaaacactataacattttatataagggacagatgttaatatctgtaggatgtcctggaaccagtcccccacagatactaggagacaaacatgtattgaagcagcatatatttgtgcacttttcatgtgcacagtaatgtaacttcatgtgttgtcatttaaaaaataatctcagttgaagcttatacaggagcagattatgtacagtaaatgcaaggcagcagactcattaagagcagacactcagatggacttcctgtgtttgaatcccagcttgaacttctagctgtgtgagcggaagcctcaatttttctatctataaagtgtggctaattatagtatctacttcacagggttgttatgaggactaaattagtcaatatatataaggcactcagaacattgactatcacataaccatctctaaatatttgctattattattattattattattaatcaatttcactttctctgctgaaaacaagtcagggaagcccatagataaacttttacagtgtggtgaacataaacaacacaacacaggagacctggattatcagccaggtgctgtgtgacctcaacctctctgtttctcagctttctgttctttgaacaaagagttttcaactagatgttctcagatgtcaaatctacccttaacagttgtgtggtttgctatccaggcataaattctcttcatttttaagggcaatttcgcagtttctctaattgcataagtattgatgaaagcatgcaagtttttatcactttttatcatttgtggaggattgaaaaagaaaataaactccctgtgttttagaacaggaatgtgacacaaaaatgttttatagaaaataatgtcagccaggtgcagtgtatcgtggctgtaatcccagcactttgggaggccgaggtgggtggatcacctgaggtcaggagttcaagaccagcccaggcaacatggtgaaatcccatctctgctaaaaatacaaaaattagctgggcatggtggcgggcgcctgtaatcccagctactcgggaggccgaggcacaggaatcgcttgaacccaggaggcggaggttgcagtgagccaagattacaccattgcactccaggctgggcagcagagtgagactccatctcaaaaaacaaaaaaagaaaaaagaaaagaaaatgtcttctgtacatacatacgtatcccaccttttcctagtttagtatttaaagaatcatggaactatacataacacagtaagctgaaggggaaaaaaaaactattgaaagacaaagagtagggccttccaagaatagaaagaaacccatgccatggagtcttgtcagtttgatgtgaattgtcagaatatttgactccaagctttctaggagccaacgtgaaattacatacatttcacataaattacatgaaatgacataaatgtaaattacataaatataggagccaatatgaaattacataaatttaataatataatgaactttatataatttatataatattcataaatttcataaagttcattataaatatcaatatcattaaatatagtatgtaatatataaaacattgatattaggtatattaaatataatactatttaaaatatagtcttcctgactgggaaaaacaaatttctgaagtaaaattcaatagcatttttttcccctgaggatgacaaaaaatgtcctcaacaattcagttaacaccattttttgacaatttatacaatagagtccagttgtgcagatgctacctgaagatggattagcataaaatggctaccaagtatctggaagaattgaagaaatacatatgtaccacctttccagatggtctccagaaaaatcctcttcccagctagacagataattcttggcagggaatttgggactgtatcaaatacttggagtacagctgtttctcaagagttgatctggggtagggttaataaccattcatgaagatctagaattacaaagactagagcttctatagttgtgagttttcaaaattcaagtaatgagctgctgtgatccaatctatgatcaaagttattctgacttctcattttcccactaagtagtccaacactctggcgccctcatgacctaaccatagctttgtattcttagtggtcccaagttttcttcttgttcttattctctcttttgtcaggctatgccaggagagaaagaactgcatagtacttgctttctgtattccaggcagtatccagtgctttttaaggcttaaacaaataagtgggtaaatgaccgctgttttaaatcaatattgcatttagagataaactacattccctctaatgatgagtcaacttaactttgctaatttgatagcttctgattttagagtttctcattcttttctttccttgttataccttgttaattaagctttcagtggtatagtgtaaattgtgtcaactggaccctgaaatagaaaattatttcaacttagttgagttttattgcttttgcatagttttaaattagttctaaatatgctgtatccctgagaaataatattccacccaaaatgcaagtgtatataatattggaagaattaagctgtaaagtcacattacacagtatatctaacgtcaaagcctctagtgcattaactgaattacttgaccctggtttagtgtttcttttgtctctgtagattagtcaaactttgataccatttttacagagtgttaaagagacagcattagaaactttgcttatcctatcaagaagcagaattctggaagatcattacactgtttgaaagatcagtaataaagagagtggataatgatgaaagatctgaacaaaaaattaaatgagctaaagcccacaatttgattattatttgtatatgtataattctgaagacctctttaaacatgaactgaaagacaaacttttagagctactaattttgtagcacttcaaacaaaaaagataacatttgtaatattttagattgtgatcacaaactataggatatcacatcatttagttctgtcatttattcatgcaaattttcttgaatacctattattttcagagaactgtactggatgtacagtatgtgtgtactggtgtggttaaaacaaagaaagcccgctctcttcatggatcttctaggaaacttcatgtttgtttgtttatttatttatttagaggcaatgtcttgctctgttgctcaggctggagtgcactggcgcaatcctggcctcaggtgattctcccacctgggcctacaggtgcacaccacgaagcctggctatttttagttttttgtagagacagggtcttgctatttgcccaggctggtctagagctcctgggctcaagcagtcctcccacttcagcctcccaaagtgctgaggttacaggcatgagccaccatgcctggctcatttatttaattaaaaaaaaaaaaaagaaaatttaggaaccactcgttttaaacaaagttgtagtcttagtattttcccatcactgtgagtcaactctacagaaatgtagctaatctacatttttcaagaacttaaatacaacagaaaaaaataattgaagtagataagttgtctcttatccatacttttgacttcccttagtctgagttgacctgtttgtgctgcaaaccaaattattagtacaatttcactccctttcttcattgtccccattgttatccaattaaatcttctatttttctgtctttttatttcgtataatattgatattcaacatcaccttgtaggtcgtaactctcagatgccaattaaaaatatttcatgttgacttatgacgttactaaattatgggaaatttaaggagttttgttcctggatatttctattctcttataacttgctaccacctacagtttctgaggaaaatattatgaaaaccttttctacacttgttgaagtcatggaaatacaaacaaacaaacaaaagaacacaaagtagatgggctcattttgtatgatgcacagatgatagatttggtagattcagcctgtcagtcgctcaggttctgccccagaggtcaatgtagctgaggcaggtccttcagaaacaatgtaaattcctttcctgtaaccaggctgccctggtttaaaatatcttttcatctccattacaaagataaactattaggtcagtggcaaaaaccacaattacctttgcaccaacttaatattttctccatcgatgacgagcaagggacaattgtaattccccttatttcaatatttttttctcacataagacaagttgtcgaagaactaaatatagttgtttctcttcaagcctttctacttgtttccccaagtgttaaaagcttgacacactcttagacaaaatgaaataatattagcaatgttattacaaacttcagttataaccaaaagcaaatcatgatgtaaaatacttctgttcattaccagtgatttgaacatgggtctgaaatatgaccatattcgaccttggaaaaacctcctaacaagcttattaggatatgcactgataattcttggttgctcttggcaatcagaatgttttgcctaagggaaaatttaaattctggagctgctctttttttcctcaccttactgtgtaaccttgaaataaccttgaaataacacaaagactaaactgcaggtggtgtttatttaagagccttaggcagtttaagcagaagctgctgtgtcagagaactctattcttgaaaaggtgccttcaaggtgttattttcctgagtaagatgcttataaaagatctatctacaatttgtttagaaaagctaatctgcagtttaaaaaattgtttttacataattcatcttagtatctgaaaattttctggtttagctttcagagttttttttttttttttaatttataataaactttccctatgacagattaaattacatgcccagaagctgttctcaaagggcaaagtactggaaagaaataatattaaagaatcctgaagggagagcttccaatttcagttcaacaaagaataaattcaacagagaggttgacttgatctctatgaaatacagtatttttctgcgtctagatcagtatgtctttttggctcaatgtttttttttttttcaaatgactttcatcatcttcctcaaaacattgattattaaaatttagatgcgatgttaaaaaaaatgagtgacctgtccagggagtttatttttaagcaaggtagtctgagatcctgtctatttcttggtccttgtaaggttcatacatcatgtgttgatttcagttaggttaccgggaccttacaggctacactgcaagttgttctggcaggtctttaactgatcttcccccttttggagcacaaatggcaaattgttgttttgttctgttttttctcaagagtgtgtggcatgttgccatcttccatcttctgtgagtttcctgatgactgtctttatgtgttctattaggtcaatagaagaacttcttcctgactcccttgcctctttagttgatgaaaatgataggacagtttcatgagcgaataatttcttatcattttcttactgaaaaactctctcacaaaaggagctggttaagctttaagcgaaagttccacatggagctctggcaatgggaggaacataaaagattgttgggtctaaaaggaagaatcagatgttgctcatcagttttaaacaacacctgaagagcagacgaaagggtcctctttcagtttttctgaaactgtgttgtaatgacaaaatggttttgtgtgtctgtgtggttctgtttctgttttgtttttgacttcacaggaagaggtttaaacatgaaggcaaaccttatagatgttagcatggctacatataaagcaaagctgcctctttttttttcttttctctgcttccatttaggcctatcacataatttaagaaaacataaaattaaccacaggagcgctaactatagtgtgacaaaaaaaaccctgatcaattttgttttcgcagcacgatattatcaaagatttaagaaacaaatttgccagcctcggcgagaactctctggtaacagcataaatgtctgtgttggttgcttttgatttaaaggtttcttttttcatttgtttgagcccatttcttttccccctccttttagttcactttatttttcatattctgtaactagcaagccttcattttttaaacctcttccatcttccagtgtctattttctgtattttggatggaaagtttatggcagcaaagctgtcattctggctacctctgctgcagctcttcctgctcttaggtcatatatgttttggccgttgtgtttatggacatgatactaattgactgtttcatgtcccattgactaagcttctctaccacgccatttgatggactcactgtcatagggctctatgcaactttcattctgcaacttatactgcttagttccttctcaattctccagtgaactggattgctcaagtgaatggtcataccagtcttgaacttgctgtgcctttatattttatttttattttcttctttatgttttcagtggtagcttaagtggaaaagaataaactccagccattgctccagcagtaccatgcagtatcgtttgttaccaccagagaatacaaaatataaaggcacattgcatctcttattctttgggggtgactggggagatctgtatcataaatccactacttcgttgaagcctaccttttgattcatatcagctttcaattttacttaaacttcaagacatctcagttaatgtttttctgtgattcagtgatactttgcaactcgagccatttgctgagcagtatcaagttatggccatggcatgggagattattcaaaacgtgacaaacttatgcacaaatgtataaatcagaaagtgcaagtttcattgatgaagtacagtacttcaaaactgtgatacaggctttgaatgaatcaaatcattaaaattgagaaaaaaaaatccatgctgataaaccagtaccaaaaacatatcaagaaaactataaagggggaaaaaaaaacaatagttgaatatgttaataatatctgttgaagaacatcgttggtgttgaaatggtccataatgttgtcatagagcccatacatgaagagatgactaaaaatatggtctgtagaaatctgttgtgcttactgataccctcaacataaatggttgggatttgtgttcaggaaaaagaaatggaaaagcaaaagcttctataccagcaagcccgactccacgatcgtggcgcggctgagatggtgctacagacaatcagtgccagcaaaggtaaggttccttgagttcccctcacgagtgtctgttcttcagatttcctcgttgctctcaaggtcctccctcatttcaattccactgactcatttagtcctggggtttctggttcatgactatatcaggtgcctattcacaaatacgagctctcattgtttacggagaccaatgttaattttttttttcagagtcttactatacagattcattttcattctgttctttaagttttggaaactatgttataactaaaccttagcagactgatcctataaaatgggggtgcacgagctttttctttaaggctggagagtcaatatgttcagcttcgagggttatgcaacctgtcacagctcttcaactgtgccatgttagcaggaaagctgccagacacaataagtacacaaacagcgtggctgtgttccaaaaaaactttatttacacacactttgtttacacacataggtggcaagctgtaatttttttatgtaatttatggtattttgccatagtttgctgactcttgatacaaatatggagacttttaaagtgagacttttttaacaattaagatgctgtcatatatctcagtagccagctgtttcaagatgattttttgtacattcataatagcttctttgtgaaaacattttaaatataatttgtaatggaatggaaaagtaatggtggtacattctgttattaggtacccttgtccttgaatagaagattatttatatttctaggataaatagaagtgaacaatgaaaaatgaaatatgttacactaaataaaattttgttattatccgaattacttaaaattgagaatagtctgcctaataaaccagatgtcaaacatattaaaataaaagtgatacaatgaaaatgatgaaagttcttcatatataatactgttgagggaagagggagagaaattttctttaaagaaacttttaagtagctcatacttattttaatgtttattaaacacataattaatcttgaatcttaataatttcaggtctcgatatttcaaaatcagttgtcttcctattctgttacttctatatcttcttatggtttcagttcttagatattatagagaatttattaaaaatgttgatgccaaatatgcattattattatgttagcattttttggaacataagtcagtctccctatgccattaaacagattgcctgggggggcataataataattttaaaagtgcagcattggaggtagaataggttaatatagaaggcgaaatgatataaggaacactacttttttatatttcttaggtgaaactggaccaatggtagcagctactctgaaacttggaattgctattttaaatggtgggaactccacagtacagcaggtaacagcttccagtcattcatataatgtacttttcagacaaatggaccatatagtaaagaactatttgttgtaaaatgttttattttctatgtacaatatggctcaattttagtttaccacagtactgaagagagagcaaaagagggaaaaagtaattatgtgatagtgttacaaatccaaacataaaatgatgtcaaaatatctgaaaacatcaagtgtgaccttttatcatgtcaaatgaattctggtgctgaggtatgaaccactctctcaccatgcgtttaccaaactgtggctctctggttatggaacctggcaggggtaaccagctcgttctgttcccagaataagtgattatatagctttgaaaaaagaaaaaataaaacacttaatctctccaaaacatttatcaaaaaataatgtctcctgcttatgttttacttaagaagaccctcattacttagtatgtatattcagaagtccttagatccagagacaggagtgagagatcctgtaatgtatacttcttgtctatgtggaacttgtctgttttctttataacttcaaatatatatcccaccatctcctttgatcctgcaagccacatccctttgtttgaaaaaaaacaatgattgtttcattttttatttgaccaaaagttatcacaccccccgtaaatggctatatggttttgtgtctatgtgcgtatatatgtgtgtctgtgtatctgtgtatcatacctacactacgtgtatatttgctatttgtgcatttgtgcgtatatatatatatgcatatgtgcatatactttgtgcatatgtatcctttacatatttagtttgtattgccttcgctatctgaaaaagattactactaaaatttagtctgcttaactgagccctttttagaacagcattgataacaggaattgttctgctcttccagatttgtagagaagcagtattcttatttccttaaacctttgagcatgctttctatcatcttgtatgtgcttttacatttgaaatctctaataaattttaaccatgtcagaaatagctgtttcgttatgctatgtaacagtaagctaacaagacaaagcattgctttagcgtttttttacatgtatgtttaaccaaaattttgaccatagattctggacgtcattctgagaacaaaggagaacattttaatagccaaatgattcctattgttttttcaatttacagactatggtaatggaaactgaatttccgtctatagcattagcatatggcagtcacaactctcagattgtaatgctgttcggggttttttgttttgttttgttttgttttttgagatgtcacccaggctggagtgcagtggcaccatctctgctcactgcaacctccgcctcctgggttcaagcaattctcctgcctcagcctcccgagtagctgggactacaggcacatgctaccacgcccagctgatttttgtattttttagtagagacggggtttcactatgttggtcaggctggtctcaaactcctgacctcatgatttgcccacctcagcctcccaaagtgctgggattacgggtgtgaaccaccacgcccagcctgtaatgctgtttaatgacatcaccttggtatggaaacctgtgaataacatctataggaattttcttcccagttaacttgcactagagtatctgaatcaccaaattactttaagagtgaccaggagagaattaagagtaatatattacccctgacatttttggtgcttgtggtgatgtgtaaggcaactaaccctcttattccaagtttgcgtaactatcttgcttcgaggtgtgttcctacttcatgataaagatggcattagtcatgtttgtacgcagtgaatattttctgtctattctagaatggaaagcctgttttggttgtttatttatttaacaaacaataagatttttgttcagtggccacgtggtttctataattcccatagaaaatgcttgactacctcaaggagaaaaaggatgtgggcttctttcagagcctggccggcctgatgcagtcatgtaggtaaggactcacttccttcttgggggttctactcagtggttgtattttttcgaagcatttgtttcttactctgacgataattgcacatagaagaatagttaatgattaacaacactttaaagtgggataatcggcagtgtcttgttttctatcttgttttaaggggttggtaatatcataattaataacttacagaatggtaataatgtcttaaaatagctttcccatagtactataatcccagagctttgggaggaagagataggaggatcccttgaggccagcaattcaagaccagcctgggtaacagggcaagactccatctctacaaaaagattaaaaaaaaaaaaaaagctaggcatggtggcaacacacctgtaccatagtcctagctactcaggaggctgaggtgggaagatttcttgagcccagaagttcaaggctgtagtgagctatgatagtgccactactgcagcctgagagacagagtgagaccctgtcgctaatttaaaaaaaaaaaaaaaaaaaaaagccttccccgtgtttaaatagggatcttggagaattagcgtatattctgcatacttgaaaatgagttgtgtatgcttttttaaaaaagaaaattctatttagttttatttaggagcttgtaggccatttctcattttgtgactaaatgatcactaactcatttgcggtaatcgttttccattttttttcaagatttaaaatcattcagacagcatttgactaaggaatctgacacacatttaatgtaagaagctattccaactgcaaaaacataattattagaattttatttctgcacatctgctggctttgtaatgtactccccatgttgaaacctaagaatgctttcatgtttgactttcacatggatcatttcagtgtaggcccaggggagacactagtctgccactaagaaaatacggttggtacgcaatgaatggagacatgttttcagtgtacgttaacatttgcttcatcttccaagatatatggtgtttagatgtttgctctcctgagcaaagaaaatgttctattagtcctctaaatgtttttttttcccttgttattatagtgtccttgacctaaatgcatttgagcgacaaaacaaagctgaaggtcttgggatggtgacagaggaaggatcaggtattaatgacttacattaaaaggatcacctgtctcccttccctccctgaaacgagtcaattatcaattacctttcaagtagagagataagaagttattttaaagttgatgaaatgcttacatgactcatttcaaagttcatagttggacaccggtcacaccctaaaaccaaccttccacgccggtcattaactccttgtgtgccagccccattgccagctgcctttccccttattgggttttcaatgaggaataatggttgaatgaaggatcaagatcctttattagagaattttctgggaaatcataaaccacatagatgaacctttcaagaacatttgactttctttggccactttagcaaagtcgggctctcagattcttttatttccttaggatagtgatcctttgagctccttcagtctactctcattcctattccctcctcttcccttccagcacagtgatcctcaaatccatacatgtttgcaagtctagattgatgaaagaaattagagaccagttatttcgcttaaataattctgtgcacaaaagcagagatacacgtgatcttagaatttttctctctctaaatagatgctggtataaactagaaagtttagcatacaatgcatttaaagcagaaataacctttgctgccctttcattttagcagtatttattaagaaaaaaatcttcagtagtttttggtttgatttgtttttattcttttgtgtttgatttttaaactagttttactcagggccccgtatgtttatctgtttttgtttgttttgtgtggtttggatatgtcttcttgtcaattattagttttggaacattgggtcttttattggactaatcttatttcaaaaaataattttttctcccatctgccatttgtagtctatgtttatttctctgaaatattttaggattaactaatttatctatgtatttttttcttctcacaaataggaaaaacaacatttcttattgtattttaaagtttattattaatacccattctgacattgctaccactatgtggctcccgtgtttattttattttctgcttgacatttggatgtacaagtgcagtcaacaaaaataagtcatatggttactaaactgagttagctaccttcaagaacaatcactgacaccattctataacttcttaggttttctggcctaaggttctggcctgaggttcagaaggccagacctttgagaaaagtcaccagtgccactctaaaccgacttaggttttctggacccatctgcagaacttggagccactgcagatctcagggcctatcacctgcctacctccagcatctctccaaagtcctaagcaattttcagctataaaatttctaaaaatgaatgaagtctctgtccaaagcctgacttccctgtcttggaattagaaatcaatttcattttcccctgtagttattacctaatgttccaggggctcctaccgcaaatccatagtcattcttagtcgctgttcatatcagctcccaaaaggaatagcagccacttaggttattttcctcagcctcctttccttcgtcaggcggatatgggttggaataacattttcgagtcccaagtcagaaagaactttgtgagagtgaccattctgatgtgagaattctttatatctctcaaaaggagattgatttaacttgtgcattctttttcaacacataagaaaataattactcaaaccgattaacacgttttgtattatttccttacaaacagaaaaacaaaagcaaaatctcaactttttttctttttccccatttccttttctttcgactactgtaaatgtactaccctcccttcctcagtcatcactcatgagcgtggtaattattaaaaatgaactgtcttttgtttatttgctcctttatttgttgttagctttgtgtacagacttgatagtgacaatttccgtgcattcttttttgttgtagactgttttaacaagtagattatttaatttccatcattatgcatcctgttattttttacatttacacatctagctttcctccttttctttcttgtttctatgaggatgtacagttattagtatgtcagatatgaaggggcaacaagcatttcaattacattttcggattggttttgttgcttttcagttaaaaacctttctggtgggcccagcgtctgcaactgttgtgtcaatgaatgatcctagaatgtgtgccctagtctccctgtggcgtttctgtcttgaacatgctgtggctttatggctgtactgattggtgcacgggaaatcggtgacagattcaaggaggacgtgacaagctgagtctcctcctcgccagtgtgctctgccagttgccttccaagtattgggaggcctactgagtttttcctctattcctttgaaaatctgacagattacaaatcatttaacatcaaaactaatttttatttttgtgactgaattcaaagagcagtagaaacaatagcaactatttgctcctcaaactaatatactagcaaagatgccattagtaattcaaagtagtttctgaaagacattctatgcagtggaaataagggatgagattttagatagtacttaggacgccaacaaggcttccaagattaaattgtgctttctgaatacatgctattgccttaatcaagagacctattaggagcatatgtaagggccactcattagctctattaatattacagtatcttccagattgttttaagaattcctatacagacacttttggcatgtttaaatatatctgttttgagatcactcttttgtttaagattctgtaaaagttaaaaaagcctacatacactcacaggagaagaaaaatcaatcatccctcttggaagggatagaaaaggctgaaaaagcaacatctgttagtgatgtcacttgcttcaacacttgaggctcagagagcatgggcttagcactgagaaaataatctgttgtacctgaatcttctacatccttgcccactgtttttattaagctaagtctcttcctaatgacgacaatatgaccataaattatatagccatggaaaacgtataagctcaaatgcatgaacttttgatacccgcaaccctccaatgaggtagctattaccttgattttatagataaggaaacagaggaacagaaaggtttcttgacttgtccaaggtcacacagctaagcggcaaggctgagactgaaatgcaggcattctgcctcccactgtttaatttacagatcccacgagtgaagtcacttccctcccatctgttcatattcttcaggggcttacttcatgtctaccattgccttaggtagcatttttttttttttttttttttttttttgccccttgacttactgtttgtttatttaattctttttgagatggagtgtcgctctgtcgcccaggctggagtgcagtggtgcagtctcatctcactgcaacctccacttcccgggttcaagcgattctcctgcctcagcctctcaagtagctgggattacaggcctgccaccacaattggctaatttttgtatttttagtagagatggggtttcaccatcttggccaggctggtcttgaactcctgacctcaggtgacccacccacctcggcctcccaaactgctgggattacaggcatgagccaccacgcctggctgccccttgacttattgttctttgtccctttccgggacacaaatctcttgccaaattttgcatttattgttaagtttcaaaattgcttttgaactttttatggttacaaatgttcctaacctggtattgagatgccatgaggaactgtgtgtttctttgaggtttgtatctacagctttcagatgaattatttatactgttttttttctgctgccattattgtcatgcaagtttgacctctgtctcctttttatactaagtttctctcatttctgtgaaagcctgagcctcccagttttttttttttaaaggttcttcaggaaatgtgttagtttgtaatatgctcaatgctgtctgtgctgtatattttatatttatatgtgttttcttttaatgacttaatcaaattcaaaaacaaaacctgtatgaatatttaaaatgtcattccattcttggatttttaatttgcttttttatcagaaccattaaccccattaccaaatcattatgacattgaaagtgcaatttttctgctttcaaaattcttcttggaatatagcagaagatactgaattttttttttttgatcatgaggtagtcctggacttcataaaagcaagacaaagttttgaagttgatccgatttcttaaaaatagtttgattttttaaaatcctcactacaacattaactaccaattaaccttccccacctttctatctgtatctgataatttgtttcactgaggttcttactgatatatttataatcatctaatcaaatttatgtgaagttgaagcaacacaaattgattaagcaaagagattgaattgatctttaagtattggttaccctaactttttgatactcttgattgcttaattatttatgggctaccttttcctcaagattttccaaatactttcacaagtgtagtttagtattctgtgtaccttattctgccattcttgtgggtaaattttctcttcaaggaaaacttgtgatgttggttcgtggcaccaaatacattttcttaacatccttgcagtttttaaactttgaagcgctcatttaaattagagtgactattatgtgctagatggtgtcctaggcattggaagcaatttaggagctcagtactgtgtagacagacttgtaaacaaataaattcagaacaatgctttatgcatataaaggaatttaggtggaagtacttagcggctgggatgttgcggggctgggggagacgtgtagtctgaattaggaatcaagggggtggataaggaaggcaaagacattccaatgcgagggaacagcatatgcaaagttcaaggtaccaaacacggcagagaatggtgactaagctgttatgaaggaaaatgatcagactagaggatggaaacatagtacctgggaggccacgaaggaccttctctgccctgccaaggaatctacactttatctgaggccacagagagccattaaataccacttaagtgatactatgtgtattgttaaatgatccacctagaattgagttcctaacgtttattgttcaaataatgcttctgctagactccactaacagtacaatgtagatttcccatttctcagtcatgctactaaatagaaattgactcctccaaagatagtgaccagcattattatttccttcatggcagtgggagagctctgagttatgcctaatgatagattagagggaattcttcagagtagacttttcacagttaaagaaatccatctgtttaccagggaagtaggataattggaatggtgcttttgaaaaattactcataggcaacattgtgtgagataggtatcagagtctcaaggcagggagatcagtaaggatgctgatgaatggaatggatgaaaaacaataagaatttcagtgagagtcttgacagctgagaagcttaggctttggctataagagaaacaagatgcaatcacatttgaaagcaaagggattttttttccgctccagctagtttaatttgtttaagaagttaacagaatgtactttaattctgttatccgtgggacaaacctgatttatttcacatagtggtcattttcgttgtcttggcatcggaaataggaatgcattgtatacaacgctgtcagactgttaactaaattttaacaaatgcactctggaatttatagaacaaacaactgtcatacaacctacagaaattctgtaacttagaaatttaggtcatttgacctaaggcttcacatttatttcttttgtgctttgtagacttcaaagcacttttaattgtttgatccaattcgattctcccaacagtcctatgaaatgaggagttgaggagtttgttcatctctatatcaacatgatgaaacgaaggctcagaacagtgaactgactaaagtcatatatctagcaatggttttcctttgattcttaaattgatgaaaacaagcacgagttcacaattatttaaataacatatagtatatgtaatgataatcagtcaaagattttattagttactgatggtaactttacaacatttagaaactatagcacactgaattcagaaaggccatataatactgaaattatctgtttatttcctgtatcttccattagactgtgaacttcttcaggttcgagattatgttcacctcacaaggtgcctgccatagaagagtgaatgttttttgaagtttactggaatcatactctttaccagtcgatagctatatgacattggttatttaatttctcagttgttcactgaaccacaaaatggcattacatttagctaagttacaggattataataaacctgaattgaaatgatgagataacatatctagcacaatgcctagcacactgtagtcactaactaaatattaactgtaagcttattttttaaatttactttttaattgaattgtaatataattgaagcagtcatacttaagccgcttaaacagcaatattaaaacttcccacatggaataaaatacctgacttttcactattttaaaatatctgtagcatttttcagttttggcaagatgcagaatcgatcttaaggtcccctcaagatccacaatcagcataatttcctctatggcagcggggtgctttagagtcaactgtatagattataggggatcctttaatgtggccagtcctatgcttcatgaatcaccttttacctgtgcattattgtagatattgacatgacaggacctgataaagagaatgttagtcttttggagtctatttatcctaattcaccaattgtaggtagaatagtagcctttaaaaatttgttaactttattagatctttaaaataggacttactgtttcactcgtagcttggttaaataaaatctacctagattatttccaagaaaaaaatgtaattttgagaacattttaatccatgaagatggtgttcaggagatataaacacaattaataaattcaaatcgctttattcagcagcttggcatgatgtttccatattttttagtattattgccactgcacctaatatattaacctttccacaatttacaaaaaattaccacagattatgaagagccagtgacgtagacagggtacgtgttatctttattttatacaagagaaaatgaaggcgcaaagaatgaactcagaagcagcaacaatattgaaatacctctccctttattacagtattaaaaatcttaagcctcttataacaatgaaaccaaagggatgtccttcacaatatgtaccttgagccctcaagcagcaattacaaatcataatttaccagtgtaagagcactttcaactacatgttactccattccgttatttgttattgatcttagtttccatcttacaatggaatttcttttgcacacatcacaaaatagactgctgatcctgtaccttctgcagacataaagccatcatccatctctgttactctaccacttatttgcagcatgggcaatggcagcattttaatcagataggaatgtcttcattaagcaacagtaccccagcttatacctggtatcacctgatggtaaacgaaggcctgactcgtcccctccctaacccctcccctcttcccattgttctgcgatgtacggtgtgtccttatataagtgaaattacttgtacgtgtttcggtatacagtcaagaaaatactgtgtgtgtcgacaataaataaaaccttatgttataaatcattatgcattgtgcagagcatttttaggtacacaggtagattatatttatttcagtgtttttctgaatactttctagtaagggttacttctttcacgaatatatgaacacttaaagtgtgtacatggtttattgaattgatttgttttttgaaaaaaaaattgcagatgggctcacagggaaagaatcaataagcctatgtaatgaactcataatattttgatttaaatatcactttaaagactcttctgattaaggtgactcatgaaaatggaactaagtatcaccaatgaagagtttagtgcctttatttgcctaaaacattctccctttcgtttcctatcctgtcgtgaatttaaacactgaggaatggacttatcagccaattatgggagattcaacacaataatgtgcctataacacttaaacttgccacgtctgatttgcatacgtggtgattttcacatagtcaccaaatttcatatcttgtgggctaacagggaaatgagtacagtgattttatgtactttttttaatgtttatattagttttcaaaatggttttgcttcctaaccctaccattatatgaagcctctcactttgaaagtcacagactgcggactggtaagtccatcagctctctgtcactgtgatcattcataatttcacttaaagtaaacatacgatcattgcctcattttctttctcagccgaaagtatttatttccattctgtaaaaagttctttttttttttttttttaatatgtaagtccattcattcactggcttttttgtcattttgctttctaaacaaatttagattttggagcagctgctcgtaatgtggaagtgttttttttccccccacggacactttctgtcttgaaaatcagcttcatttgtgtggtgctgttctgtgtttgtttctttccttgtgtttttgctttcaaagtaacttgtgatcaagatacctttaaattgaaatacaagtaaactgagcccttttctgaggttttctccttgccccaaaaatatttgttagtgttggatgatgcagaggaacttctgtaactaggggacgcctttcttttcacctttctttattagttttagctctcacaacacgagccaccaaagtctgtcttttggtttcatatttagaattaaggttgtttgccatttcctcctcctatggaagtaatgctcaaaccagtcacatctctattttagatttcagaaatctttctttttattcagtagtcaacctgataacaaagttaattaaaacaagttaatcaacaattttctagtgatttacagctttcacaaaaatccatgaattattctttaataaaagaaactcttggccccgcttttttggatacacagaatgctttccattgaatcatttggtcataatccgggtacaaagcaaatttaacacgtgtgagagatgcagaaaaaggtcccttctatgtacaccttgccaaatacaagaacataaagaaagaaaaaagcaaagtttaagcctttaggtcatttgtaaaatgttgccaaacccatgctgctacttttaacagagaagtctgagttttaaaattcaaacgttcttttcttacaaagaaaaagtgcctctatctgccaagcgcatgatcttatgagcttcagatagaaaagtggctatgacttgtgactgtttttggttcagaacaatgctagatcaacatgcaagttgtatggaggtggggacagaaagggagcggcaggctggggtggctggtaatgtttgatccctctggatttcccacaggagaaaaggttctgcaggacgatgagttcacctgtgacctcttccgattcctgcaactactctgtgagggacacaactcaggtttgtgagtccccggaacttctgatgatactaaggcataaataatgttttcaagccagtaataacaagagcctgttagttccaattatgcatcgttctagagacaacaaatcattctagagcatgactctgcattgggaactgggacgttttatatattgcttccctgctttcacagtcctcggatatccatttcacttgagtcttatcaatagttttgatgttagggaagacacatgaggctgggtgcggtggctcacctgtaatcccaacactttgggaggccgaggtgggaggattgcttgaacctaggagtcccaatatcagcctaggaaacatagcgagacccccatctctacaaaaaatttaaaaaattatccagacatggtggtgcgtgctcatagtcccatctacttgggaggctggggcaggaggattgcttgaggccaggagttcgaggctgcagtgagctgtgattgccccactgcactggagcttaggcaacacagcaagatcctgtctctcaataaaaaaaaaaaagacagaggatttatgaaaaacatataaatagttatagagtaatatagagtatcatttcttttgcaccacttctctttaccttgagcgtatacatacttcattgtactagttaacataatgtatctccattacttgtttacacatctaactctctactaggcttgtgcacccctgaaggcaggaactccatcttaattttatcttggctgaccccagcactttgcacagtactgaggaacaagtgattaatgaataaataatttccttcttatatcctcaaggatagcaaccttttttagtcattcgtttgcccagagctctagaactaggaatgaagaaactgatattagcaatatctgagacaaaaattgaatattgatcatcaatggagcacccagatacacttttggggtgatcactttttatggaaaatataaattattttcatagtaaaactattagataaaaacactgcactaacccacaatgattttgccatagaaagcatttgcctttggagttcttagaatgactcaacttgaacttctgagcaagcattaataacatttttttatcttgcatagattttcagaattatctgagaactcagactggcaataatacaactgtcaacataattatctccactgtagactacctactgagagttcaggtatgttgctttccatattagtaacaaattaaaagggttggtatgttgaaacaatacggcagagttttaatgtgttttggtttataactagaaaggagtttttgagatagtttatctctgatcacaatctctcagcaattcttagagcaaaacagccactgttatctctgcttctgaacgtgcctcctacttttgctcattattttatttctgtaagtagagatttttcgcctgtttttttagcttgatggtattttaaagtcattttcattttgtaaagcacttttatactctgctccttcttctacagttgttagacaaattggggaagaatatttggaacatttgtaggaataggaaagaaaggctttgcaactactaccatacacttaaatttgatagtctaaggtcagttcttttcagctgtcctaatatttgcattaattttcacaccacattgcttaaaaatctctgatattgtaatcatatttgagaacgttaatcaaactgaattgaagacgtaggcctcttaaataatgagagccctgtacaacttttttcccctcattttatttataagctaaaccaggcacagtatttttaaaactataaatgcagactttcagctttttccttaatctttgagtgtgtaaaatcacaactttttttttttctaactgaaagcttaatgtggtgggggaaggtgcattttgaagtcagtacaccaagaagtgttgctgaaaacacatttgtcattttaaaaattgtctgaaaacccaaatgtagttcacagctcaactaaattggattatttacttatccaaccaaaatatctttaaaatgtatgttattgttaaatacatctggtttatagagattgatcttatttagatatttgtttacaattgttagtatttacaaatttacaagcaatccaaccagtttcctcagggacagacacaaaagccatggatatcagcgagttctcactgatgcaatgttattagttttgttggagaaaatggaggccagatgtcggtaccccaaaaaagattgttccatgattcatctattttctgtgctcacatagtaaacatctaattttgctcatgcataaatatgctccagtcttaatgaattcttatgtttgtgaagttcaaggttatcagacagtaatttttaaagctaagttttcttcttcttgtcttctcttcagttgttagctatatctaagaaggaggttcacatattgtatgtttaggaaattcattgaagaatgatatttacttcacagatatttttgtttgctaccatatctattatttaaaatacttctcaggcataaagtccaagactggttagtcaatggtaactttagaatgtgacttgataataaataatatcatctctatttcccaggaatcaattagtgacttttattggtattactctgggaaagatgttattgatgaacaaggacaacggaatttctccaaagctatccaagtggcaaaacaagtctttaacactcttacagagtatattcaggtaaacatttaaacatggctgctatctgtagcactgaactccatagaaaaatgcagtatatctagagtagtttccatatctcctattgacccctttctgagtttctttgcaaattgctacaattaaaatattaggttgagatgtgaatttatatggaatgaaattgcttcaccatttggcaggttgagatatgattaactccttagaggcatgggctgtgatgttagctctattgtacctccagggcctggtatatgtattaagcacttagtaaatattaaggaaggaagggcgagcaggcacaacatttaaccattctttctggtattccactaaaagtgggaagaagtttcatagaaacttaagaaagagaagagtgtttgaaaacatcgcatatgtatattatagataaaattccaaatagcgtatagaatattcttttcttttttacatcgatttgttttatattctccttggactaagcttctagccttaacttcagattttttaaagattttataaaattctgggtttttctgcaatcaccaaaactttgcttgatgaccagtcatctttcctttctgtcttgtctcagtggacatgttaccctgaatcattcactatgtttgacgtgccccatgctaaggataaaacaggagggagaaacttataattggctttgtgagactaaacataagcttgtggggagaagaaaggttaagttaaaaataaattgtatcccaggagcgtaacagttacagctgtttgagtaaataaatgactcatggccaagtacagccaaccaagagtaagtgctgtagaggtaggaagacctcctccaggctcactcgcctctgcattcagtcccttggaagcatggcactttttctattttttgccttggtggggaagaggaaccttatttcagcatttccagatggaaacgtcacacttgataattctaataacatttcctttaaaatcaaataaaagtgaaagcttaagtcagttttggtctactcacagtcccatttccttacctctcctggcttccattattgccttagtattctcatgcatgcctagaatgataccagtacaacaacattcatgtgtcatgtcctgaataaataacaggattgactgatgacattagcaagccactggattttccagaaatgggaatcaggatgatttctataatatattccaaatgaaacataaccgccatttcagctaagagtaggcatttcttggttcctaaaataattgagattcctgaatgtatcgaaatctagaagcatccattgagctcttactatatgcaaaactctagggtgttgtcatagaacacagatttctatgtgaatgtttaaaggatattggataaagtcacatggcttattgtgcttggttcaataagaaccaaaaaaaaaaaaaaaaaaaacagaagtaacaagtaacttctcttattacttattttttatatgacattttaaaataacaatcgtatctgaaatatgtattttggaataattttagtattcagaaaagttgtaaagatagcacagagggtttctgtatatgattcacccagctttccccaatgctgacattttatatactcatggcacatttgtcaaaactaagaaattaacatcggcacatcctgttaactaaattacaggctttattttgattttactagtttttccattcacgttatttgttttttaaaattctgggatacaatccaagttaccacattacatctagtgaaatatattttagagaagcttgccttagtggtatatctgctgataaatattgatactatgaagataagcttatcattagcttcgtgctgcttctggactgccttttagattacagcattgcgtattgctttattattcaaacttctactaactatagaaagttatataagggggagatccaacaccattgaaataaatggaattacctataagattgtaatcccaatttaataaaaggggaagaattgtttgagtaagaggacgttgtattgtcaaggttcctacagtaagaccatgaggtagttgttgagaaaagagaaagtttgatctgtccttggcacaggtccttctggtagttagcaagggttttccatgttgcaggtacatacgtcatgagaaaaagaaagcaaggcaccagactagggagtttacagctcccagaagctgaggacctaaggttgagcaagccctgcaaaggacattctgtgtgtttcaggttttaaaagaaaaaatgggtactttggctttgggcttgcaactctgtcacatgagggttggccaaacaacttttggtcacctaggggttgcaggagagcacaaccccttgtaatgcttcaacttttgatttaaaccttaactatcacgggaagaaaattatttctgacttgaagaaaaaacaagtttattttcctaaaaatggctatctagtgttcacctcttgcacttttcctcctccctaatttatatgccattggaataccaagctgacactgaacatcgaccacaggaaaatcctaaagatctattgctttcaaaccagagctgtaatagccagttgggactaattataaccagggatgaaggaaactataaagctactatatctggtacattaaatgagctggatttaatgacctacagattaaaataacctgattccttctcaccactgtcccttcagacttgctttgtcgaccatttctttaccactagaaggaatcttgtgcactggccactttcagataaataaaatcatgtcagtcactttgtcacaagaataatctcatttcagtaaaacttccgcttacccttgggcctgattttcagctggaaaacctagagtgagggtgcaggcaagaactcccatctggatgttgttcattctggaaggagtccaatctaggctttttttactctcccccctgaaggttcttctctctctctctctctctctttccctttcccctcctgattaaccccaggcttcctctgggttgttgctgtgggagagaggaggtatggggaaggaaaggtctcttccggggcacatgtaatcccagagtgcaccacggagctggccctctggtgtggtgtgttgtatttttttatctaacgtgcgagcctggccctcttagtcctccagtgcctggaaatgactcttttcccatccagtttaaagttattcaatcagacctcaagcatctggtggcccccatccaccttggaattatgttaccatttcagactgatttcagatggggcagaatggccccttcctgagtagtccatataagaaacacatctttcttgtcatatgctgtctgtcacactttctaataccagaccttatgctacccaacttcagaagacagaaactgagctcacatgatggttctcctgaagcctcttctctcacttggtgtaaggggatgcagaagtaacgaaatggagaggctcagcacacggagaaccccctccaaagtttcccccttttcaatttcaacccctttgtatccttagagtggaaatatctatttttagtcaccccttttgcaggtagtgagtctactgcttttgtagacagtcagtcgttctcatagtcatctgagaatacatagtcagtatctcagctgtagggcctcaagagatgctgagacaggaaaaagttctatttcaacatcttggatctggccatctcttccaatcacttgtttctagcataagatctgaaatgtttttatgtggcctgcaatttaaaggtattataagttatttgcctaaaggaatgaaggaatttgaagttaagaacggtattttatgtacttttttcctttctaagtaaaatccctgttatttattttcatggttgatgtagatgggtttacaaaactgaatgatggtagaattttttcattggaaagtgaaaacagaaattggctccatgaaaacagtctgcgtgctacagcggatccaccctagtattgatacttcagaagtgtcagctaagagaacaaagttaggtttgttaaaagataaacttaggcacaataacatcttaacaagtttatctgagcattcaactatttatgaatggagcaataccagaacactaatggttcagcacttcaccaaaggtgggggcacttttataaggcgttcctggaagcaagacaagaaatttgattggtaaaagtgcaaagtccctagttagaggttagttggcagtttctgactggtgaactctctagttagaagttagctggcagtttctgattggttaagcttaaatttacattgagttgggatttggttttcttagggaggaacgcaagacactggagccatctcagcctaatgactcccaattagttattttaaccacttccaattgccttggattctggattcgtgaaattaataagcaagtattactcttttaaaacacgtcattggttgtaccatttgtaaaatagttgttcaattaagaaaacgttgaagaggattttttttctctatatgaatgctttatccaggttactatttaggagtaagaggtaatcacctctcatctaaagcatattctcagattcttttgaatacaaaatagtgactattgattgatttgactaaatagccaaagcacccagaccttattttttttcctctaaatagaggagatcaaagccagaccaaaaaaaaaaaatgattcacagaatataaaaatccttgagaaactttttttggaatatattaaatgttttaaagaggaacgtatttctctcttaaggatcattatcatcactgtatctccttctttcactttgagttcctatcttttcagataacgtgctagcagtgaaatatatcagcactaagtcaacttttcccctgttattgtacagtttgttttggcaaataaattatgaggaataattgccgtttgtctgtttatgctccagggtccttgcactgggaatcaacagagtttggcacacagcaggctgtgggatgctgtggtcggctttcttcatgtgtttgcccatatgcagatgaagctgtcgcaggtaaactaactaactgccttcctctctcttaaatgacaaactggagactgtaatcatcagcaaattaaacatgctttttgatgttagaatattatctttttaaaatcactttatcacttgtctttttaagatcattttatcatgcctcttttgctcattaaaattttttaaaaataaaaaccgttatgtaacctgagaatagacaggagtcattattcaaatttgagacaatggatattaagaaattgaatgtaatggacaaatgaaacagtcgagtccccaaacattgtacatttcacaagcttcatcttcctggccattgctcactggaattttccttccccttacagataattgaaataggttttataatctgttacaagggagacaattttgttacagggtcttaaacaagcagatgttctcagtagggcgatgcttacccctaaccagtgtatttaattttgtgacagagaaaaagtagctattatatggataagcaaatgaagaataaacagattttctaccatgtttaatgttaacttgagggctattgaaaaatatcagcttgtttgctcactgctgtatttgtttcatttgaaacaaaaagatacacaaacagaaaagttcttgtgaatgtgtctcttcaatgcagtgaattttgatggtataatctgagaccttcagagtgtgagtatttgccaggcggtcaggtagaagaatgtcagattaaaagacagaatgctgtcattctaattcctgagctgccatgacttgttccacccgtgtgggccaggtctctcttccctgaggccttgtttctctgcagtaaagtgaagaacctatccctcaggcctgcaaatgacaatatgcaggatatattgtcaaagatcagcagggctggatgctagtaaaagtggtaaggatacatcttaatgtcaaagataaacaaagctggatactagttaagcgaataaggacagattttaatcagtagtgctattgcaacaaggaaaaagagttcagcatgaactgaacctgatttgatttgtacagaggtgactgggaatattaatgggagaatgaagattagagaaggggcgagcaggagctcagtagagtcagaggagtgaaaagttacaaaaggttcattggtgtaaatgtgattagaccagctatgtctgctaactggcaattgtcaaagttagttagttaggattctgtcctccagagtccttatccttagatgttgtctggaactgttgatttttttatcagcctggagttttcccaggcaggtactttagtggagggctgggatcatccttgacatgcagtcttgaacagttagaaactatatttattagtgtttgttcaagtctttatagaccaaagttgaggccaagttgagaagagggctcagaggtacctgactagagtttggtcaaggagagaatgtcagtatggagttattggtgacttcagcccaatagggaaattccagtctttcatttaatcactagggatattttggtaagtaaaggaaaccaacatatgaaccaaatgtagaccctcacaagagagttctcatcctgatgtttttccatcagggtattaacatctggtgctacctagcacttgttcatggtttataaagtttccataacagctatttagaaagaaaacgtctcatcttcccaacactgtatagcttcatatgtaccaaaaatgccttgtacaaattttttaaagaatagtttaaaaaatggatgagatgtaaagttgtgcagatgtaagtatgatccgtatttccagggactatagctaagcgtagtgatgtttagacacaatatgtctttgaaaaagaatgtttctttatggtaaaaaatcaaaagcaaaaacaaaattttaaccagagtaatactggaaagcttaatcaaattggtaaataagatacattgtgtaatatttattagtacaatgttgtactaataggtaatacctgtgtaggtttttggttaatttatctaacaaatacatttataagtttatcttctatggtgcttatatgcctatatttcttctatatgaagttgatttttacataatagcacctagaagaagttagaaagttagaagaaaaaaatgcaggcttttcaaataaaagataagatagatgtcaaatgtgcagaaggtcttgagtcttgcttggcattggagaatattccactgttgtggttctttcatattattgctatatatgttcattgtcggtacaaatactttttttttttctgagacccagtcttgctctgtcacccgggctggagtgcagtggcgtgatctctgctcactgcaacctccgcctcccaggctcaagcaattcttgtgcctcagcctcctgagtagctgagactacaggtgtgtactaccctgcccagataaatttttgtatttttagtagagacgggtttttgccatgttgcccagcctggtctcaaactcctgagctcaggtgatctgtgcgcctcggcctcccaaagaagtgctaggattacaggcatgagccactgcgcccggcctacaaatactttaaagaacatgagttgaaatcagtaatactttttaattgtaaagtataactatttttaatatttggccctcctttagttccataatgcttcaagtggttactatttattgccagagcagcatcctttttgtgagaataagtatgatgttcctgctgcatagttttcttgtattatctcaaatgcaatgttcatattttcaggattccagtcaaattgagctattaaaagaattaatggatctgcagaaggatatggtggtcatgttgctgtccatgttagaaggtagttttgatttatacttttaaattctctttattatcttatttaaaggatcagcatgggcttatggaatcagagtgtagcatagaataaaatagcactcagatatgatagatgccttggatttcttgctggcttattattctttttctcacattagtttttttttaaagggagatcctgcatatctcagtttacatatctacaaaatgaaaatagtagtactttataacagtacttttcatttcatagtgatatcgtaaaaagtaagctctccagtctataaagaatattttatttgttagtgtgtttgtccataatcagtgggggtttcggacatttgggtaacagtcagctgtgtaagctgctgctttgaaaagaccacagagtcactcctttgggttcttaaagccgtggcactgctgggaaagcctctgtcccccagggcagctggcagtggtagtcttgttctccccaccacagcctcagttttaattttctctttttttttcttcccagcttattttgttattgctttttttttttttttttttcctgtagcaggcaggaaatgtagcagttaagagcttgggctccaaatccaccgccagagtttaaatcctggcttccttacctctgggaggtatgacccttggacaagctacatctccattttttcagtttcctcctctgcaaaatagaaatgatagatattgatatgagaattcagtggaatcctataaatacaaccaaaacaactaagaaatgtttggtattacggtgcctatcactttttcttaacttcttcctattttctctccgtgtctgccatacatggcgtaactccacttcagttaactgaggcagctgtcacgcctcgtgctaggactttgaagtggcagcatctgcttaaagcccttagtcggtggcaacagtagccactttataccctttaaacacaggatccatttttccatgcatggccccgattcgaattttgggttaaatactaacaaacagcaacaataataactgcagtagcagcaaccacagcagtgacttaaaaccagcctcataacgtgccagatactgaattaagtacttatttaatcctagtaacaagtttatcagttcaatggtaatattatctcaagtttgcaaatgaggaaactgaggtacagagaggctaagaaatctgcccaggttgctgagcacattaagcctggattcaaacccaacaatgtggctccagatcccacactcttaacaccacggtgcttactgcttctccgattgactctgtggacctctgaccagcgacctttcttctcctgcctgtctttatgatatatagcacgttctgttcaatgaataaaagcattctgtgatcctgtagttcaggaatctgccattttctaacaactatacacactgactcatgaagaaatgtagaaaggtgcttttcattatgaatcagaaaaagcgtacagtttgctctcaggatctggtctgaagacctggcactaacctttaataattaagtcacaatgggcccattaatttagtcttgttgaacttcaatttcctcatcggtaaaattagggttaacaaaaagtacctgccttacatatgaacattaaatcagatattgtctatgatagtgatttttcaactctaaagggctgagcaaatgtttatttttattattaatatgaaacgattttagtttctggctctttggctcattttctttatctaaaacatgttgcttctttgattgaggggaaaaatgtcaacttttgttgaaatattttatgtgtgtcagtctaattgctctgtaaatagggttatgcatgtttgtgtaatcattttttaaactatagtttataaataattatctttttatagagtgagagataaacagggacatatccttgattcagatgttattaaagatctacattgttatcttctgtatgatcactgattttgttagtttattttaaacaaatgcaactgctttaccaccaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggtaatttatctctaagtcacagcagcattctctctggacttcaggtgggtataataaatgatcattagaccaggtttcatgctagtgccagaacggtgttacctatgtgacttgaatttccaaagagaaatgctttttggtagacaaagttagtgtttttaagagtccttatgaattattaaattatcttaaactattatggtgtaagcttcagtacccaccctaactgtagcctacatctttctccacgtttatataattttatatgcacatttgaaaagttgggaaaagaaagaaaacttttagatacctgtaagtggcattattctcacagagcattgaaattttctcctctgttctgtgattttctttggcatgttttcattgtatgttctttgtagtcattagtccatagagccatcattccatccatgaatatggcatattttccaagtgtctgacagacaccactgggtatcatagggaattcaaaggtaagatggggtcactgccttcaaattaccttaaaaagtttattccagagataaaactaacacacatgaagaaactagaaaagggttaactgtgaaatagtataggcagggcagtaggggttgcttatgttgagaaaatggcaatgccgctatggtttaaagtagttagataagaatgaagaggtaggacttaaactggcattgaaggatgagtaagattttagtaggtgcttaagataaagaaggatatttctaaatgagaaaagagagtgaaaaggagtccagaaagtttgtccctgctgctggtgcagtaggtcagtgtgcagaagaagcgggagatgtttggccctataaaatgaaaaacacgtggcgcttttatcgtggtataagcaagagggtatcttatataggttatggtttgacacatggtcacatggctccctcaattcattcaaaggtgatgggtaatcctggttttcttttccccattgactcattcaaggaacagaaggcaaaagaagaagaaaaggaagaaaaagaagaaaccaaatctgaacctgaaaaagccgagtatgtatagtttgcatatacttttccttcgtttcagtttgtcattacatctctttttcttgtactctgtctttgggagctgcaagggagaatctcatattgtcaaggagccacagaactaattgtgccatctccgtggagaggctctgacagcgaggacctcaggccatgggcagggatcactgtagacgcccccggggctgccagtctagtcttttcctctcattccatggggacctccatttgtgtgattccctctcagcaggaaagactccagtgattgcatggaatgctgtttgtaagaggactcagggccacaattctgtctttaaaaatcactcatgtctttctgtcctttccaagaagggaggaaacaaacattccaaatgcgctttcatagaatcctgtggagtggtgctccttaaaccatagacccaggaccacatgcataaaagtccccgggagagttggttaaaacaaacattcctgggccccaagccatagatcctgcctcagcaggtctggtgtggggcctgggagccttcattttcaccaacactcctgggatcaacgcagcaataaaaaagagctggatgtgaggcgatgaaaatgcataactccctcataacaccaggtttctctgaataatcgaagcctacatctttctccacgtttatagaattttatacgcacatttgaaaagttgggggaagaaagaaaggaagcttttaggtgcctgtagtgccactattctcccatagcattgaaattttctcctctattctgttattttctttggtctgttttcatcgttatgtttttgtagtcagcactattcattgtcatagatctcacactattgggtcagttgtaaaaatggccccataaaaagtagacacaaataacagcaagacaggcatttcaatggcaattctttaactaatatatacctcatatgagttaagattaagtatagcttatatatattaatatttctggtttatgtattaatacatatgacttcactttaatttaatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaaatcttaatggaaaatgttaaaaattgtgcattaaaattataggctgggcgtggtggctcacacctgtaatcccagcactttgggaggccgaggcgggcggatcataaggtcaggagttcaagaccagcctggccaacatggcgaaaccccatctctactaaaaatgtaaaaaaaagttagctgggcatggtgtcacatgcctataatcccagctacttggaagactgaggcaggagaatcacttgaacccgggagctggaggttgcagtgagctgagatggcgcccctgcattccagcctgggtgacagagcgagactctgtctcaaaaacaaaaaaaaaaaaaaaaaaaaaggattgaaattataatttaaaaatagggtatgtgggacagtcatagcaaaatcattcatcattcttcatttttttaatgtttcattgcagaattggaaggaatctgctatgcataaagattcttcaagcctataaaatgtcctctatatttcaacttcacagaattacccatctccaggggactgtgatcaacagaaaatcctacccctgattctaaaattcagaatattatcattcaccggaaaagaaattagttttcaaaagtaatatgatggcctaaaatatttgttcacttgggtaattttccacaacacccgtttagttctttagtttctggagagcttatgttttgtttgtttgttttcataggggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctagtaagatgttttagaatgaatattgttactgatatagtgcaataccgtaataatttaggctcagtaaatgtttgctgacctctccctgagtggcagttagggaaccaggttagtccagcacatgtttgatttgctcattgtagtgtgtttatcttttatagtgaatgtctctggcccaccgctccctactgtcaaacccataacctctactcatgttcacactccctgaaaccctttcatttggttcctgccaggacagtgctcccagtgtctgcccacaaagacattaggacaagtgaataaacatagtctaaggacctgcaacagattttaaagcaagatgtgccttctaggacacaagtaattcaaaaatgttccagaactagattagtcagtatttctataacatcaccgttttacttaaaaatccaggtataaaaatattagctaattgagccatagtcagtatttctataacatcacccttttacttaaaaatccaggtataaaaatattagctaattgagccactttccattgataataagaaggtctattcaaaattgttctttaagagagggattacagttctttatatactgtcctgtacattttacagaggtgttcccctaattagtaaagcacacattcatatttggaaaacaaaaggtatagctctctctatgtctattcatatttatcttgaaattcttaaaaatattgtttgaaaggcctttattaacatgcatgtgtaatgtcacatgtatacacatatatgtgtctcctatccttttcctccatgcttatctcctatccttttcctcctttataaaaattaaacatatgtgtatatatgtataatttttataattatatgtgtatatatgtataattatatgtgtgtatatatgcataatttttataaatttttataatttttataagggaggaaaaggataggggataagcatgtagaatccacctacaagaggtactgaccagtgatgttagacctagaatttaagaacaacaaccctcataagaaagccatttgaacagcagagtcatatttagtgttttttagcccttgagaaatcaaaaattgacaactcagaacctcaatgaactatagaatttcacctataaggaaagtggactgtcctcagtaattatatattctaaatgcttatctttaaacatggttatgtattatatattttatgcaaatatattttaatttagttgtaactacatttcctaaaccatcttgtattttccctatattgtttaatacagagttcactgaacagaaatgtttcctagataactaactctgaataattcctaatttggtatgccataatggcttccatggctgcaggtatagttctattataggtcatggctgcaggtatagttctattataggtcatggctgcaggtatagttctattataggtggtttaaaggttgaatgggcgctgcagcaccccagtgggttcctgaagaatgtgtttaactacagttgtgtaaaccaagtagttgagattttgcttccagctttcactgtgtcagggttcacatgttctgttgtctctgcacagctcctcccttttcctgcatctctttgctatctttctcggctcaccgatttgcatgcacatgaccagtcatggccacatccgtctaacaaaggccccttttcccctaagtgagagctcagcctagctaactcagcctctgtgacccagatccaccttccaaggacaaccagtgaaactgacgcagtctgggtgtggtggacagccttgttctaataagctctggcagtaaagatggggtcctgtgtggggaaatgacacgaacagagatgggctgtgtacacagaggggaatatcattctgaggtgttacattttgatgtagctttattatggtaaatcccctgacatatccacttaaattatattgacatctcccacttaatattaaaacaaatgcttaatgtccaccataacctattactttaaacccacttctctaggctttattttttcccagcccaataaattgtaccagctgttcccttagttgctgaggctcccaaattcagaaggtatcatctttgaaccctctctttcccaccttaaatacaacccaacgataattattctcagttgttccaaatacatcgagtctgcccagttcttgccatctccacaggtaccattaagtccaatccaccaccatgaacctcacctctgcctgacgtcttgtactaactttctaacgggtcctcttgctttcactgttgttccactgctatcagttttcacatagtagctggagtgggccttccaaatcataatccaactgcaccaagtcctcctgaaatcctctaatagcttcccatcccacctagaataaaataataattatactggaatattacatttattatagataatcaacataataattatattaataacgaactttccctatattaactcatttcatcttcaaagcacacttaagagttaaggtcttttgttattcccacttcgcatgcagatgagcagagtgatgctacagaaaagattaagtcatttgtccatatcccacactaggaaatggagggaggcaggcttcatatccaggcaatgaggcctcggaggttgtaaactgaaccaccacactgtcaaagacaagacaaccttttatcagaagcctacaaaaccctgccccctgctcacctgtctgatcacatccccctgccacccccacacatcagtctcccttcttctcactgtgtttccttctatttctcaaacacaccaacatcactcctaactcagggcctctgcccttgttgctcctctctttgacacactctttctttccccaaatatttgtatgacttgctccccgcttgtgcattcaggcctctctgttcaaagcttacctcctgagataaaccttcccagaccaacaccatctaaaatagcacccctattccctaagctcctaacccgatgtagttttcttcttagcatttaacattctctgaaattatgtttttcacttgcgggtatgcttttttattctttgtctcctccatggtggcagaaatgttctccctcacttttaggtctgcagcaccaagaatggtgcttgaaacagtaggcttgcgatcaattgtttggggtaaatgaatgaatgctttatttaaattgactgcaggtttcaagcctgttgattcagtgaccttttcataatgtttttcaccctcagaactattttgctcgcaacttttacaacatgagaatgttagccttatttgtcgcatttgctatcaatttcatcttgctcttttataaggtacgtacatctcactgttttaattactggtataaaactccaaatagaaatgaatgtaaagatttcacgatgaacgtatctactactgctagtgaacatgtctaaacctattatgaaatactggtgcctaggcactgatatcactgttatctaggaaggcaagatagatttgttcctgagaagtgagaaatgcctcaactgaagggcatttgatttagcagagggcttccccacagtattcccagcctaatttagctgaatatcttatttgtgactatgcctgggtgtggcataccgtattatattacattcttttgtaattgagaagagagcttagccatctaattttttagcatgcattggaatcctcagaatttttggttgaataagaatgaattttaaaagtatgttcattacttgcctttggtttttgaaaagctatcgtttttagcctttgctattagtcctttcattatgcagtgacttcacatccaactatttgctgaaaaggctgtatttcttttgtcttttgcttgcaatggtatcttagatgcagcaaactgactctactttaaatgctttgaatcaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtaagatagtaaggcaccaaggtacctgtgtgtgtgtgtgtgtgtgtgtgtgtgtgtgcgtgtgtgtgtgtgtgcgtgtgtgtgtgtgtgtgtgtgtgtgttttgcaggctggacttctggggaagcagattctgagctggaaactttgtgcacaaagtttctgagggaatgctccatgaatcaacatgcatggggcaaatggaggaaggatgggacagaggggaaagctgggctactgtagacagacacagcaggtgccgtctccaaagctgggatgccccttcagggctgtcctggcctggggcattggagcctggcctttttatgtctacattgactagtctgccctgggaaggggctatggccatgagctgtcttaaagtagctttctttcatatactgataattattcacatagagaatttcgcctataacttggccctacagaagtgagctcacccacccactatgtctcatggtaatgcagtgatacttggtgtattaagacttatagaaatatattgtgtcaatcctgggagtcattttattgttttattatgagggaagtatctactgctattcttggcagaaatgcctcatgatttgtcacacttcacccagaaaataatgcagctttatccccagaggcctgccaagggaacaatataatttggtgaatagaacccaagataatctctctgagtgctcagggctgcccattacctgtccaaacctctttatcttttcctagcaaggtgcttttttactgtaatgcctttatttcactttcactgtcctctgcctctggttataaatcttgcagaagacgtgtgaaaaaccagggctcagagtaaaagactagaatgtaaagagttattcaggaactcctttcctcccgtttattctgttttatgggagtgcatattcttggctatttccagaatatcagtgtctatctgctatctgtgccttgtgtaaagtctgtccgtgtaaaaagagaatcattatgttctagaaaatcattatgttctggaaatattttgacaaactgacagatttttgctgatgtcgaaattaaaatttatctcaaaatagtatgtggtgatgctgagcatgaaattattaaagaggtttctcaaataaaactgcactttagtagcatgcatttgggaacattgctgcaattgctaaattttatttcattcattcatgttgagagatatatgtaaacaaaatgattttgcataatcatcttttcatctttgaagtttaaaaatgatttcactagtgtaattatctataagaccctatgtgtttaaaaacatatgcatatatgtaatatctattctatcttctgtttttccaaaaccttctagatgcttcttcctgcttgaatatagctgattcattttcattccatttttaccttcctagaagtacacaggaaatatttctttccaaaagctgttttgtaaagatagtgaccacaagatatgccagtaaatctaaactaattttaacgtatttatttttcctatgtaggtcccattggttatttttaagcgagaaaaggaagtggcacggaaattggaatttgatgggctttatattacagaacagccttcagaagatgatattaaaggccagtgggatagactcgtaatcaacacacagtgagtaaataattatatgagactttctgcactcaaaaatttcagacatgaaaatatttggttggagttcctgcagatttgtcaaaagtttagcagaggtgaataatagttatatattcagccaagaaaaatctaaagactcagtgctgtccaactcttaatggtggatgtcctcaatttttgccctctgagttctgaattccttaattaaaaatggcttagagttcatttccacagcactgatggaacttcacatccattactcagcgttcagggatgtgtgtagcaggaagtgcatgacctgcaggcagggttatctcatccaaaagcagaggcaaaaattattcattaacgaaaaagttgtagcattaaaggaaaatgcattgaattttacaccttgaatatatctgagttatcaactttcagtaccatcaagcaccctagcatgaaactaactaaatattaggacacggtgtaaaatgtaagacagaaaaacaaatgctttttctatccaataaacatttagccctgtgagatcaagacccaaactactagctgctgttctgagtataagtccatcacaaaagtataatttttcactgtaaaaagaattagtgcaatagttgtaatagtttatatttactattcgagtgaaatctttttaaaattgtgattagttttgctaattaaaaagtcatttgctaatgggttccgagttgtcaaatggagattatttatacatgatacatgtttatcctaaatgctaaatgttttgtttagcaattctaccattaatactaatttctaagcaagtcagtccctttaggcaaactctctatgtattagtgaagacgctagagttgtgctttgctgctatgctcgaagtttctgtgaggataagtggtgggaaagagatttttttcttcatgggaaaaacaatgacaggtttctagatactttaatttttaaaggcaattgataaacaggtctatgtactgatatgttataaacaaataaatataacaatgctacctaataaatatgctcatattcttctccattaaagtatcagcttataatcttttgtatatatttacatgttaatatttaaaataatattcaaatacctatgatgcaggaaattatgtgatgttagccaaattcattgtaagtttacgtggcaggatatatgtttacatattattttaagtatgccatatatcccaaatgatatgttattatttgtcattaaaaataatactatttacttctatgcttttgtatattttaggtcatttcccaacaactactgggacaaatttgttaaaagaaaggtaatattacttggaatcctctacatttttcttaaagcacagtttagatttttatttgatgtgattcagatgtagaataagatattgaggtataatttatctgcctattaatgtctccattttttttttttaatttttgagatggagtctcactccgtcacccaggctggagtgcagtagcgcgatctcagctcactgcaacctcagctgcccagttcaagcaattctcctgcctcagtctcccgagtggctgggattccaggcgcctgccaccacacccggctaatttttgtatttttagtcgagatggggtttcgccatgttggcctggctggtctctgactcctgacctcaggtgatctgcccgccttgacctaccaaagtgctgggattaaaggcatgagccaccacatccggccaaatatgaatttcaagaatagcacataatggccgggcgcggtggctcacgcctgtatgtatatacaggtatgtatgtgtgtgtgtgtatatatatatatgtatatgtatatatatatatatatacacatatatatatacacacatatatggatacacacacatatgcacgcgtatgtgtgtacatatgtatgtgtgcatatgtgtacatatgtatgtatatgtatatatgtatatacatatataaatgtgtacatgtacatatatgtatatttgtaaatgtacatatatatttttttactttgttagaagcaatgtgttcgatttttatgtggaggaggtacaagtgttttgttccctcgtgacctggcatcttgagtcgcactgcgctagtgcatctgaggacacccaaattaggcaaaagctgtgaaagaataattttaaaatggttttaaatagataatttgaacattttattcctattatttaatggaataaggaagaagcttctaaattattaaagcaagagtttcttgctttaatgaagaaaactctatatctgtagtcaaataaataggtaaaccataatggcagctaatcctgttcctggatttcccgctatggtacctaatttgtcctgcagggaatgtgaggacacagtcccgagagaatcccccggctcaaatcagcccagcccatttttagcactgtgagaataatgcaaaacaaatggttttaattaacctaagtagttcatgttcataggctctttcttttggtttcttttaatttacttgattgcatacattcagaaaaagccaatttttatatctgttaatcccttcttttcatcagtatatttccttcttcattcacttcaatcttgttcagtatatttccttcttcattcacttcaatcttgtattttcacattctgtctccttttctaatcttttctcctgtatagtggactccttttttgctaccagtgatctctcctcctgcttgtctttaattgcttttcctgttccctccattttctttttttgtttttgagacagagtctcactctgttgcccaggctggagtgcaatggcatgatttcagctcactgcaatctccacctcctgggttcaagtgattctcctacctcagtctcccaagtagctgggattacaggtgtctaccaccatgcctggctaatttttgtatatttagtaaagacaaggtctcaccatgttggccaagctgtctcgaactcctgacctcaaatgatccacccacctcggcctcccaaagtgctgggattacaggagtgagccaccactcctggcctccattttcattactgtgtaagactcactcaggaggtatatgaaccagaggccaagaagagctgtatcccagagttggacataactgagctcacaggggagctgtgagcacatccaagccctgctctaaaaacatgacaaatgggcaaagccaggcagatgggacagaagagaaataagcaaggaagctgaaggggattgttaagaattattctaatgattgatagacatggaatctatactagatgctaattaaaatgaggatggtgacaaggttgcaggtcctggtgttttactgaagaattgctggggtcaggatactcaggggagtgggttagaaagatgggcattgtggccagagagttgaagggttgaaattgagaccatggaaggatgccacccctgtgatgtgccccctattggcatgcagaggtctatgcagaagatcattggctggggagtcaggcatggcctggttgcttcctggacccatctcttgctgagtttagcaaacttaggcacattacatgaagttttctaaggtacagtttctttatctgcagaatatcaataacgtgaaacctacatattgtgacagtcacatggaatgaagcataatttctggcacaaagtattaatttagtaaaggtcgttctcattccatttccctccatttcttatgcttttatttcagctcatcatcttctttggtatgactccctctcttgaatgagagagaaatcttgttcctcagataggtattatgtaagatgctgtgaatttgtttagaccttaagcagtgtgatcacagaaggtgagccacacactagattttaagtgattgttagggcaaatatacagtaagtataaaaataattagatgttttatacacacatatagatgatgttacttaatggttgaagccaacaaaatgctttttctcataccccaaggttatggataaatatggagagttctacggccgagacagaatcagtgaattacttggcatggacaaggcagctctggacttcagtgatgccagagaaaagaagaagccaaagaaagacagctccttatcagctgtgtaagtgttacttcggctctatcctacagacttagattgaaaggggaaaacattaatacatttttaaacttgtgcattgatttcctttccttcaatgtcagaagaatagatagatgaggaaaacagaaagtatataaagtctacttttacacttcttggtatttggaactctggaattattggattttttttctattaatttttggaggtaccttttaatatttataagagaacagaaagactatgttttttacttaatttgccttttctgtctttaaatgatccttaaatctaagtaaaacacatgcaaaaactcaatatatggctgttttctggtaattcctgtttgaaaaaacgttaattttcttatgttttggaaaagggaactatgtagcccttgtatttaaaatgttcagaggaactcatattactttactataagtattgtattgttttgaacagcaaaggcttagtgcgtcagaaataatataccatcataccattacttgtaaagtttacttcaaaatgaaacactctttatatactgctttcatggaataatatgtttctaaaccagttgagttgaatgcacctgaatttaaatgtcacacacacacacacacacacacacatatagtgtgagtgtacagatatatacatacatccatttagcaaatttgatcaactgaatctctggaataaaagtaaaacatgcttttaaaaacgtaattgcttattgtagtcacttaatgattttggaagaaacataatactttctcttaacatgagtagggatgtgatggttactttgaaaacatatttctggttctgtgaagcagtattattttcttaatctgttagctagcattaaaaagatagtttagctggcctatctcattggtcatattgtttttatctatctgaaaacttattaaggtgaacttgtttttgaacttactgaaaacaacttggatcagcaaatatgaattaagttccaaaatattacttgagtactctaggaaaacaaatgtatatttaaacgttgtgccgctgcctgtaaaatgaaacaccgatgggcaatccttaggatctgtgttccttatgttagaatatcatgaaacaagaactagggtgtgaggctgagcatcccacaaacattttcagatccttaacaagcaatatagaattaaatagttttactgagttatgcattttctgtggtcatatttgtgactctaaaaaaaagtctgaaaaaatagaagggaagtttagactgtttttctactatgaagaaatagttttaaattggcatagttttctaccattatacatagtaactgtttgtaagtaagtttgacccctagcaaagtaccaagaagttcatatggcatttaacaccttgacatatggagaataaaattagaagaataaagttctggtaaataatgtacaactaggaaaaagatttacatataatgtctctttactaaagcatttaggaaggtcaggttttaaaagattatccgatttctatatgaacgctatcttaatgggaacattcaaatacaaaatgatttatatatttatttatcaaacacataaggcttggtatgtgcacctttaaataagtggccagctccattcctgggggtggaatagctgcaagcagtctggaaggctgcaggtgtcttcatttgcgtcctcactggggaggaaaggagctcatgtctcaaaacatctccaaaactcaccttcctggttatagtttacccttgactggagctttggagtccccccgccccccaaccaggaaggccgtgttctgattggcttagctcagccatggccctcccccagaggtggggtcagcctcaccgaaacaaacagcatggctgccacctacgggtgagaaatgagtgctgtgtgatactgatggtatattgtcacactaatgtatgctagagatggaaaataactcataagaataacttttaaaataaaataaataagaaaccaccataggaaattcatacatcctgatataaaccattattctgttttagattgctttaatgtaaaataattatgctcccatgcaaactactacattttttcccccaactcttccttttttcatttaagaaaaaaaattcttatattgaaacctgttgtaaatatttgtggcactttttttaaaggctcctgtgataataaaattaattatagttcaaagataactttatttaaggaaaaaaaaattgtttttaatcctggagtaagttaaatgagccttaacccttagtgaaaaaaatctcctaaaaagtcaccttcgatttgcaactacttagcatttataatttaagaaagattcgcttaattaaaagaaatgattaaagaagtcaataaagactaaaacattaaatctagagaaaccctttagaaaataatattgccattatgttatattgcattatttcatatcaattacttagagctggaatattggaaaggctgggaaagttacaatttctagcctataaatcagtggcaagttctgaaaaaatgaaaattaacacatatattttaatatacgtgtttgtaatctgcaaagatcacaaatatttactttagtatttatccattcaacatatatgtatttagacattcagtgtgtgagctggggagttcacagacaagtgagagaggcatataaccacctacatgcatataccagcacccacaactgtaagacaatgtggaaaataataataaaaggaattgtctacaaaatgctatgagaactgaggggaagggctaaattcctgcctggatgtaaaaggaaacagagaaggtgaattttctggaaatgaagtaaaaacaaaacaatttaaaagctctttcatttataaaataaggtagttgtaaaataaatgtgtatatttatgctagcttttattatttgaatcaaaagttattctgttggaatgcaattgcaagtgcatatgaaagtgaggaaatgtttgatgtgtacatatgttggccaatttagtacagtttcaaggaataaatgttatatgtagctgggcacaatggtgcatgcatgtaatcccagcacttcgggaggccaaagcggacagatcccctgagatcaggagttcaagaccagcctggccaacatgatgaaaccccatctctacaaaaaaaaaaaaaaaaaaaaaaaaattcgctgggagcggtagcacatgcctgtaatcccagctactcgggaggctgaggcacgagaatcgcttgaaccggggaggcagagattgcagtgagccaagattgcaccattgcattctagtctgggtgaatgagtgcaactctgtctcaaaaaaaaaaaaaaaatgttaatactgaatgtaggaaagggaaaggtgaaaaagaaaggactatttttaaataacataagacgaaggtgatgatgttttgttttccaagatcctctaagaacacatcatgaaactctaggatacagtgtcagagttggctctcagctcctcccttggcatctgggatagaactcgtttcccaagaaggtgtccaagtcttgtcccattgaatgtgaaggccgtcaggctctcgcaagcctatgagtctttggttaatgtgcataactacgcattttttttttttgtcattgcagactgaactccattgatgtgaagtatcagatgtggaaactaggagtcgttttcactgacaacgtaagcctacttcattatcacaaaagaaaatgcactctgattagataagactgtgggagttctgcagatggaaggctggttatttagaaaatgtttcgaataccaattcatttcatacagaccagatctggagagagacccacagaatgatatgattaatgagcccatctctcattccatttctttcaatagctgaaatagtaaaatgaaaatatatgaaaaactgagatgcagatttgtgagtacgttcattaaggttttaattggacaatggcatacttcagttttatagatgttaaaaagaaactcctaaataattttaaaagaacattaattgtgctaaatttaggttttccccaaattaagtacattaacttatggagttttattttattttttttattctccttttaccaaagagcctttggagactaaatatagggccgtaatatatatccaaatagaaaaaaattacctattactaaaaaccgccaggtgtctcaagatttcactctttaattttagcactgacttttatagttcacgttagttccattctcctatttagaagcatttgatagcccccaaattctcctgcctctatccttatcccttccctcatccagccatgggcccagaactctgggtgtcttaggagcattctctaagagttcaaaatcaggtcttccaagtatctttcagaaccataaactattaatacactatcttacaactaatttctcatccaaatgggagcaactcccctgaataacaagagggcaacctcagctttggctctagttggcattttccactgaagtggccagtccatcttaagttctgcctgctaagctcaatcttccatgccacagtatttgcatagcccacttttgcccagatgcagcttctgcccagatgcagcttatccataatattcatcttgctttgtagtttttttgtcctcttgataacttgggcatggatagatccaggatggagtctttccttagacagcgttctgctattttagtaggcttttatccacctgcagtttcatggcttctgtttggccaatcacctctcaacatgcattcattcttcactattactgtgtctctctgaaacatagccatggttaccagacgaaattcagaattcctagttaaatgtaaattttagataagcagaaaataatatttagcataagtatgtcccaaattacttcatgggatatacctaaactaaaaatcatttattctttctctctcattcaaattttactgtgcagcaagcacatgtgtagaccacacatgcacctttggcccagcttgtcacttaggtcgttactcatcttatgcccataaattttccttttcctcagtctttgcatttttcttttttttttgagacagagtcttgcactgtcacccaggctggagtgcagtggcacactctccgctcactgcaagctccgcctcctgggttcacaccattctgcctcagcctcctgagtagctgggactacaggcgcccgccaccacgcccggctaattttttgtacttttagtagagacggggtttcaccatgttagccaggatggtctcgatctcctgacctcgtgaaccgaccgccttggcctcccaaagtactgggattacaagcgtgagccaccacgcccagtcttgcatttcttaatgcctccttagattagctccatctgaatgtcccatggcaaattttcatcttccttctcctctgctcctccccaccaaatccagtcttcggtctacaattttctcttttagtatttttgttcttcttactacctaagcttaaattattcatatggactcctcctcttctttctccctccaatgcatgtatttgattatttgctgaatcttggtcctgtttgtgtcctctgtaattctcccttctatctttaccacttttgctgctttttttggctctggtaacctcaccctggggtttgtccagtagtcttctaatttaatggctttgccacttacaatgattttagacaatagcttaactagagcaagctcacttcctcatatataaattggggctaaacgtgcctattcatcagagatcttgctaaaataaaaaagagaccatgtgtgcaaatatattgaacgttgaccagcacttagtaggtgctaaagaaattttcctaaaatgccatttttcacaaaccgttatccttctcatggtactgcagtggcactcaagttcctgtggggtacacaaatgtccttgaacttgccctcaagcctctccaacactgccacacttttccaacttggtcttgcaaaacaggaacccaccactcaaaccaaattttccttcccaagcaaactctgtttagtcttacctcagtgtgctttttaaaaatgctgttttcttttctgccacttgacctctagcttcagttccacatggtccttgaaatccctttactagctcagccccctctttttattctctgtgaaagattaagatatcttacagtcaaaatgaaggtgtccgccgcttccccaaatgggtggtttctgactccactagcaaaacattccttatggagcagagactgtagtcccataagtaagagcagccaccatatttttattctgcattagtcctggccctcccccaaaagtgtattcattttccagcctatgtgaataatcaacattaattataacccaggagacttctacaacagtaccaatagtattattaggtgtattatagctttcagtgacgtcacatggtatttgggtttctcctagacttactgtggctcacgtaaagtgagatgcttggttaataaaacacttcatataatttcataactagtaggtctcagcaaacactgatttagtcagtgaataaatgaaaagcaaagaagggaagaaaaggagggagagaaagcgactggttcttttgttggctgtagagcaagggttcttctctactggggaacagttttgtctgctaatgatgtttggcaatgtctggagacatttttggttgtcatgactcaggggagaggtggggtcggtgctattggcatctagttgatgctgcttgccatcccaccatgcacagaacagcacccataataaaggattatctgaaccaaaatatgaatagcgctgggttgagaaagcctgctgcggagtaggaagtcaataaatgtttctctgtcggaggataaataacaacgacaattcctgaaacactttaaaactgttttaaaggaggatgacactgaccttttcagaacaaattaagtaaaaataaaattcacaaagaacaaactgatacagctaactagaattgtaaaaatgtatagtgagccaggcgcagtggctcacgcctgtaatcccagcactttgggaggccgaggcgggtggatcacgaggttaggagatcaagaccatcctggttaacacagtgaaaccccgtctctactaaaaatacaaaataattagccgggcgtggtggcggacgcttgtagtcccagctactcgggaggctgaggcaggagaatggcatgaacctgggaggcagagcttgcagtgagctgagattgtgccactgcactccagcctgggcgacagagctagactctgtctcaaaaaaaaaaaaaaaaaaaaaaaaagtatagtgtacgaagatgaagtaaatggagtaattataacagagtgaaatcagagttactttttaattgtatttttttaattgacatattcatggggtacctagtgatattttgataaatataatgtaatcagatcagggtaattagtatatgcattatctttaacatttatcacttctttgtgttgggaacatttaatatcccccttctagctatttgaaactatatattattgtgacctgccgtcatcctacagcggtatagaaccccagaacttattttttctatctagctataactttgtatcttttaacaaatctctccctattcctacctctcctttttctccccaatctctagtgtcctctctcctactttttacttccatgagattaactttttaagattccacatgtgagtgagaacatgtagagtttaactttctgttcctggcttattttgcttaacccataacaatagtcatgcgttctgttttctgacatgttctttccccccgttttgtcttaatagtccttcctctacctagcctggtatatgactatgtctgttcttggacactataacaactttttttttgccgctcaccttctcgacattgctatgggattcaagacattaagaaccatcttgtcctcagtaactcacaatggcaaacaggtaaacagtttatctttttcctcccttgcagaaaataaaaaagcaacaaataaaacaaagaaaaataaaactacccctcaaatgacaatgtacagttttaaagatttttttgaagggagggtctgcacctgttctaaactgcagggattagtagtttgagggtctcctaggcctatactcaagccttggcttgactttggataaattaactgaaaataataaaagtacataccttaccagatttttgcgaaaatgaaataaaaacaaatgtgtatgccttaacacagcccctggcccatatcaagcactcaggaacttagttattattttgttcctagtatagtatttgctccacttgctattatggagaaccaaaataggttacagaatcctgacccactcattgtattcgttgtaaaatatgagatgctgcattttaatgtagtatttttaagctggatattcatgtactctttacttttaaattgagcaaaaaggataacgtttcatatttgacaaggtcatgctgactcggaagaaaactggtctaggtccagaaaatgcacttacgttccaatggaacctgttcttaatgttaagacttcccattatcctgaagcatattgcagaagtgtgcactgatccgttcacttgctatttttcaagtgtccactgggtggcgacatattctgtgttagttatttggcttaacagactccttcatttccagagtcttgtagcccagcacattttaaaataattgcctctctaaaagctttgaactgggtccacagttaagtccacattatcatcagttttctaaatttcagcatgattcttacatatgtcactttaggttctgagtatgactgtgacgtgcacggcaagtcatgggtctagcgacaaaaaagtctatttatctgtcagttaataagatgtgtttgagctcccaggatatgcagtaaagaactggagatgccaaatgtatgtgtgtttctacataaaaggtccggcactactttccatttctgagctttgtggggtttctttttgagggatcaaattttctttgtttgtttgtttttaagacagagtcttgctctgtcacccaggctggaatgcggcggcgcgatctcggctcactgcaacctccgcctccctaggttcaagtgattctcctgcctcagcctcccgcatagctgggattataggcgcgtgccaccatgcccggctaatttttgtatttttagtagagatggggtttcaccatgttggccaggctggtctcgaacttctgacctcaggtgatctgcctgcctcggcctcccaaagtgctaggattacaggcatgagccaccccacctggcctcaaattttcatttgcagaaatatgtagagctttatagtcctaacaggtgaaacatgcagaaattcacagtaaccttgcacttcatttatagaaatgaatgaaaccctctgttaaggtaacatgttttctccagataattataaagtgattttgtaaagacttaatcagcataagcagttgcagtcaagaccataaagatgtgctgtaatcagaaaaagtacacataaagataaagcactgttagtatggtcgaatttctgtgatgaaaccagaaatacattttcaccaactgggtgaaaagccacatttttagcatatacatattctatcaaaaatactctacaattctatcatatacttatagctatccaaaaattaaagtataatttggaattaaaaacagattacatagagctgaaagacctttcaaacagagacatttaattatagattgagaaaaatagccttcaaaacagtgttggtcactagctgtggtatttttcactttggccattgtttacaaagcaagatttctcagttttaaaaaatatttatattataccttattactagttgtgtgtccccagatttcaggggcaatacaaatttctatttagtttaggatatgattgaaaatttaaaaataatttacagtcataacaaaaacgaaatgcattttattaggaatgtaatttatagaaaatagccctcataaaatgaagaaagggccgggcacggtggctcacgcctgtaatcccagcactttgagatgccgaggcgggcagatcgcctgaggtcgggagttcgagaccagcctgacaaacatggagaaaccccatctctactaaaaatacaaaattagctgggtgtggtggcgcatgcctataatccccactactcgggaggctgaggcaggagaatcgcttgaacccgggaggcagaggttgcagtgagctcagattgtgccacagcactccagcctggtgacagaaactctgtctcaaaaaaaaaaaaaacaaaataaaataaaataaaataaaataaagtctgacaacttgataaagagaatatgaaaataaatgtctgcatgagggggctaagaaaggtgagaaataagttatggatcccattagcttctagtaaacacggctgtgttctcactagagcactcgccgcccatgtagatgtcacgtgtcaattgtatgtcctacatttctaatacctggtccttgtcacattgttttccagctcgtattaaccgttggcttattagctgttgttgtatacctatacactgtggtggcattcaattttttccgaaaattctacaataaaagtgaagatggtgatacaccagatatgaaatgtgacgatatgctaacagtaagttcataacctttgatctcacataaacaaaaatgtctcctgcttctgcagtctaagtaattgtgtatttattctctaacagtacaaaatagaaaatagtctaaacaaataaaaagttgcagggctgtttaaagattcagcagttttcaattttagcagaacataaaggagcatttctgtcaattttccatatgtgctgcacagcctaataattagaattgctgagtaatgtacttagaactcgaaggagtaatgtcatcacttaagcctgttgttcacatatcccaggacaacgggtaaaactatttcccagagaacatttggaagccttagttttttgttcaccttaatgactttaactgaaattactaaatttcaaaaatatatctcttcctagaactactggtttttgcttttatattgagtatcttggcttaaatgtcttttttggtcttggttttcaaaaatcaacagctgttaaagctttcatattgctttatatcgctgttctacaacctgtctctctaatattggcagctgagaggtaatcatacatgagatcttagatcaggaaggggaacatgagacaaaatatatatcactagctggaaagagatgtatccttcagtaagctcctcacgaaaatacctacatcatttgtgttggggatgtaggtatagaggctgatataatgatacataaattactctagaaaaaatagcccaaaagattgatgagaatgaccagtattacaaagactaacaattaagataattttatactaaagaatgacaactcagtgggacagagtagttcagaaacagatgcaaatactcacggaaattaaaagatgataaagatcttttgaagtaatgaaatgaaaaataatttaataaatgacattagtaccatggacaagctatttggggggaaatgataaaaatggatgccaaccttgctttttaaataaaaataaattctgaaatgagcatattttaatgcaataagaaggaataatcacaagacagaatttgatgccttaaataatagtaatactcatttttacatggagaacggtctgagtatgacataaaactcaggatctatgaaagcataaacattatttgaaaaaagagcaactataaataaagtcgtaaaggcaaatggtaaactgggaaagatatatttaacaccataacaaagggccattttccttaatctaccaagtccttatcacatcaataagaaataagccaatagaagaacaagtaagtcacatgaccagacaattcacggtaaaattaattcagtgggcttgcaaatttgaaaagacgctcagcctctgtcaaagtgaaagaaatgcaaattaaaacaatgaaaaaaacactttttacctatcaggtttgcaaagtattcacgtttgttaaaacccacagttggtgaattgatgggaaaaatcagcattttcatgactctggttgggaggttgaattgacaacaattttagagaagttttgtgacacctatcaaatttttaagtatatatatcctttgacctattaattccactgctagtactttacctaaaggtttactcacaaacaagcctctgtatgttcaagaacattagctgccctcacaagctaggaataatctaaatgatcattagtagtgtcctgattaagtcagttacgataaatccataacaagtatgcatctgtttgaaaatgagagaaattcatgtatacagatatggagagatatataaattacattttaattaaattacatttaatttaaaaaaacaagatcttggatcagtaatgataggatcctaattgtgtgaaattatatatacacaataattcatatttttgatatgctggaatatgcataacatttttctggagggatttattcataggacactgtgaacaaggattcctacaggggtaggaccatagatcacaggggaaagaaacttgtttgcttttcattttatagactttactcctgtctgaattattgatactatttctttttaccataggtatttttttatttttaaaagcctaagacagttttttccccaccatgttatagaagataatctgccttcagttattcccacaattagtataactacatgcagtgactgttccctggcagggaggagagaacagaacatacaggtggctgacctgagggaattaaaggacagaggttgagggaagctctgctgaaactcgatgttacattttgatccactgcctgttcttgagccatttatttatagcccaaatctcttatttgtgtaaagaagtttttctgtatttaaaactttatcataaatgatcattaatatagaattgcccatcctttctctcctttaaacaagtattcttttatttactaatttagagagcttcagacaagattgtcattctttagcttttcaatattaagcattttgttctcttcccaactttctttttaataaaaaaaatcttaagaataaataactctcaaatgaattgcaggttagttaaaaattggggatacataatagcttgctgacataaaaatattcacttttcttaggtcaagattaaattttcgaaggcttggaacttcaaaaagggatgcttttgatggagaatgcagggggaaaaagctttcaactcatccttccacacatagttgacagcagagcaaatcatattgttcatgtgaaaatcatctgtaattttcaacatttcctgtcacgattgccgttctgaggtgtttcacatgtgactttgtggtttccacgtgctagtgacctacttggaggacacggagtatcagagctgaaaggactctgatgttcatggttgttcatccataaacttaattcctcaactggaagaaaatgccatcccagttacaaatccacagtcttgtagattttttttatttgtcaagtgcttatatagcacttggctataaatgctattgtcccaggcattgtctcaagagctttacaaatattaactcagtagtctcctaccaactttctgctgcaggttggcactgctatcattcccattttacagatgaggaaactgagctaccaagagtttgagtaacttgtcataagtcacacagttaggaagaggtgacactcttcaaccagtactctaagttacactacctcacagatagtaacttcattcatgcttctgtcattaattttagtgctatttttataccaggcactcgttaaggataaggcttgagtaagtacagtccctgccttcatggaatttgcatggtaagcacctttctagaaattctgctaagctcgttcttttttctgggatcctccaagaaaagagtgccccagaaattccagaagttttggaaaaccttgtggatcagtattcctatcgcatacagaacatttaatatactatacaaaaatagtggattcaacatcactgctcaaatattgcaattgagaagttgctttaggtggctggctactagacagggaaatagaaataacttattaatgtcacatgataccacagggtggaagatattgatacggacatagatcaagtgccttaatacttgagatccattttagtcatcataagttgtcatgactgagatgtaatacttacttacatttgctagtcttcttctccgattaattgctggacaaataattcatgcaccttgcctggagcctcctccctgactgcctttctatcaccccctgatttggcccacctgcccacttcttaaaaccatctcctatccttccttttgctgcttttctcgcaccacaaagcagagaaaaatgtataagttttttttttttttttaacttacagcaactgtaagaaaactggattcaatgcaataagactgacccgttactagtgacgactctccatcagagtcactaacatgcaacactttaccccctcctcccacgcctattcattcattccaggcctagggctgaagatgtgttaaggatccttcatctcctcttccatgcgctgcctttaatatcagctgtgctcagagcctttctaccctgtgaccctgaaggcaggaggggagtgggaggccaggaaaggctacaaggcacaagggaggtgcagaaggtagcagtagcaggtacattgcctgcagtgacttccaggaaattcagttctattctaggacaaacacccgacaaaatttataaatctcaatatctaccagcctcagggcagaaagtttacttaggttatgtattcctaaaggctatgatgctcagagaattgctaaaaattaatagaaaaataggaatgatttcagataatggcattcagtgacctgtatcaggtagtgagaacaatatgtgactttagatcttccttttgtaccacagggagaccccagcaacatcctggtctctccttttattatgcagtcgtcatagttgaccccattcaagttgtaatcataggatccttaaacgactacattttgaacctcactctcagtatgcatttccattacttttgttaattttgcttaggaagacaactgccttcacctggttgattttgcctaatttcatgggggcatgaatacagaagacagagaaacttggttccggtgaggaaatacggcctgttgatgttctgaactatggacttagctagagcctagatttttttcagtttgagggatttctgtcctcatgagtaagactatttatgaccagctctgttgtaggtttttatatctctacacataacaataaacttactatcttgtctttgactgggttgagtatatgtcttagatgtttcttccctgcaagagaaaactcagttccaagacacaagccactttttcatccctagctcattcacagtgacgggctgctgccaatcagtcaaaccagacaggagtctgtgtagcattacacacgctcatatcccagtaattgtccctaaaaactcccacatgggaatggaggccacattacctagattgacattccaattgtagcgtccaaacacttacttttaatttgcttcttaccagtacttgtgcaggggcttctttaaaaagccaacaaaatttaaaatataactgatcacttagagtagtgcgctttcaaagtacaggcttattaaaaccagcctgccagcaagaaagcagcacagaataggaaacaaagatttaatttctttaatttagttctcaaaagatgatcctttctttatgacagtctcttgaacgtgtcctttcacagggcgatgtctatattctctcttgagataaattttcctcactcatgtcacattttattcacttcatcctgagtttctttgttgtttctggttgtttctgtggctctgagagaacatcttaggttttgcaaataggcaactcgccctcctgtttttcataatttacagtagggggcgccatagctgcagtgttatagacaagtcacagggggatttttttttttttccagattaggatgttttgagcctgagaatctaattaaaccagcagtatcctgatagaatttgaacctcctctacaagaatgtaggaggagaaagagaaaaatgatgtaaagtccaaggtagaaagatgattgtggctagatagccagggagtctgacttgacatataggacgatgttcatctcagatggagagggaccccctgaaccagaggctgcaggggaaggtgtcaagacttatgcactttgggaaaaatagctttccaggtgattaagatgaaaagtacactcctagggaaataaacttgcttaggtaattgttctaaattacctcacttaattgttgtcacttactttaccctactttcccaacaaataatctgctccttttttcttttttctttttttttttttttttttgccaagatgaaggcctgataaggatcttcaccagcagctgaccctcagtgttccctaaagccaatagaaactatgatcaacctcagaatgaatctgtttaggagacggatgagggagggaagccacagactataacatcttggaaatcaacaacttcctcttctaaatttttgtaggaccaggcaccttccttcctcattactcagattgtctgaaagaagcacatctttttgtctcacagcattacttctttccacctccagctctcattatcaggtttaggctgattctatgaaaagaaaggtggataaaaggattttcagttgcagcaggataatttggtagctgaaagcctgacagccatgtattggaagttattcaccacatacctcctattccagcaccacagccaactacatacagttgtctaaggctgaccaggtagtaaaggatgaagctgggaaaaccagtatcaacatcccacaggtgaactgtacattttattctttttaaatttggtaatttattaagcctaaataatcagatgcacaagactgtcttttcagcatgactgttaagtccactaccgatctctgctggaatcccttcatcacaatgcataaagctgatgtaaaatgaaggagagcagtgaggaagggtatttccaggaaaggttgttagatggctgacaagagatctgcaaagaaggagacattttctttggtaatttagcctcattccttggtcctgtcttcaacattacatgtctagaaactacaagtgaatcattcttttggggacagactcacattaaccagtattacataagcctgatgtacgagtcagaataccaacatgctactcattaaaagttaatgcaacaagttggcacattctcttccctagacaaacacctctatgggaagccaaattttaacccaagacccaaagactcccaagtgcaagaccaagagtcttggtcagcaggaatcaccaagaggaactgatggatgatcagttcatccatcagttgctgggcaatcttagccactagtgctgtcacacgcagttcctcaaagaagcagggatggagagctaggacattccaagacctggactgggaactgcacaatccactgttggctcactgtggggattggaatggggacccaagagaccagaacttgacatggaggagtaccagtccagaaccaggtatactatccaaactgagtccccagagaaatccccggaggagagttgcaaacacaaagctacttgtgaagtcagagaaacgtgggcaatgggaaagatggtctaactaaagaggaaagaagctgtgttaaccactctttgttgatttcctgtagtcacaattaaatacatatgaagacacagatttggagaaaagcaatccaggctaggcacggtgactcaacgccagtaatcccagcagtttgggaggccgaggcgggcggatcacctgaggtcaggagttgttcgagaccagcctggccaacatggtgaaactccatctctaccaaaaatacaaaaattagctgggcatggtggcggacacctgtaatctcagctacttgggaggctgaggcaggagaatcgcttgaacccaggaggcggaggttgcagtcagtagagaatgcaccattgtactctagcctgggagacggagcgagactctatgtagaaagaaaaaaaaaaaaaggaaaaaagcaatccagttcttaataaaagtaagaaatgtgtggtaaaacaaattcaaacagtatgcctgagtatatggtgaaaatagtttccccttctcacagattcactgttagcagtttcaagcaccaagttttgaaaaactacagcagtagcttcaggatatttttttaagtgatggatggtctgtaagattttacttccagagattgactcagtaggtagtaccaggaacccagaatgttgccacgtccaggagactctgatatgaggttaggcttagaccctatcagcctaatctggctctaaggatctcctgacctttctgcaaaagagacccctaacctgggctccagatcagatcttgggtgggcactggctgagctggccttataatgctctttattatatgccaggctgagtctacaaccatacgaccctgaatgtgcccaatctcatccttgtatgccaggctgataaaacgtttccaaatgacacatttaattctgttccctaaattccagccatctaacccaggagactttttctcctctgcatctaacagatccatcagctgttgaactcatagttgaactatgagcattttgatatcaccttgttgactgctctttgcctacacattgtgctttttaaagtgtcctgagaatgtgagatctgtgggttgaggcagtgaaggctcctcattcatcccacaaatgatttgaggacttaccatgtgctggacgttattttaggcactggcaacagagtaataaccaaagcatttcttgttggaatgcagtcagtcctactggaatgagatagacaccaaaaaataagcaagctggatacccaagtgtggaattcaagaaaaagatccaggctggaaatagaaatgagtataattggcacagagatgatacttaaagccatgaaactgggaaaggtcccccaagggagtgtcctaaaagtaaaaagctcaaagaacccagtcctggggcatttgttcatgaagctacagggagatgaggaagatttggcaaaggagactggaaagcaatggccagaaatgaagcgaagcagaggagtgtggtgtttctgtgttaaggcttttgtccccatcattctggtcagcagcaactaactaggttttgaattgatgggtgacacatccattaagtcagggtatctggaacagtctaagaaaatctcagaggaaggattattaatttaggccctacaggatgagtagaaatggagtaagaatggaaaagcctattgcaagagaaggagaatgtacgagcaaagatctggaatcaggaatagttcacttggaggaggtatggggagagcggagagagcagagagggaagtttttgggaaagctgagtgtggctaaattcaaggcctgaaaaaggagttggaacttagcttaaatgaggataaaatattggatgctccaagccagtgactcaatccagcatgacttcatttgccaccccctgccccaggacatttggtatctggagatatctgttattgtcactatgaggtagggtgctattggtatctaaggggtagagatcaagggatctttttaaaatagcatacagtgcacaggatagcccctgcccaaggaattatccagccaaaaatgtcactggtgctgaagccaagaacactgccctaaaatgcactttagtgaacccctcattttttagcagtaggcacaggcagctgtacttgttggtggctttgacgttttagggtttaaacaataagatgctatttcctccccaggtctcctctcttttgtattctagatattaaagtagaaaataatttcagcatcatatttcatatatactatgtgagggaagggtgttagtatgttttcttctagcttaatttctaagattccatcttattacctgacctttccaatgtctgttatgtccaaaataaccaaacaatacaatatagttgtatgtccctgaatgtgttcgtaatatgattacctcattagcacagatggttcagagccaagatactagatacaagatgctagaaaattttccattttctccaaagtgagagagaaagtgctaggcggagtatgcagtatacacttttgtttaaaagacagcaacatgcaaaagccaaatgtttgcttcacaactagaaatactgaaacaaaaagaggcaatatagaatgcaaaaattctcatttccagagtgaggattaggaactacagagataactcgggtttgtcgagaaaaaaaaatgggtaatgtccctccaagaagtgataccatgtcttttttccagtgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtaagtatcctcctcactgaagctgatgaacatctagaatttgagccacatgttgctgaagttaatattcaaggtagggtaatgacgtcaagtgtttcctggcaaagccaaatcaaacttttccttccagtatttcttcatcatgcaatctaccgggggaaatataaagcggtatggaaccctggtatgaagggaagatacagtgttattttgtcttctttcaaataacataatggaaaaggcactttccttggtttgattctcacctctgggtttcagactcatgaaccccagctttacaatcttgggtgggtgagccatttaaccctttaaacttctaagccagctgggtgcggtggctcatgcctgtaatccaagcactttgggaggctgaagggggatggatcacttgaggtcaggagctcgagaccagcctgaccaacatggtaaaccccatctctactaaaaatacaaaactagccaggcgtggtggcacacagctgtaatcccagctacctgggaggctgaggcaggagaattgcttgaacccgggaggtggaggttgcagtgagccaagatcacgccactgcactccagcctgggcaacaagagcgaaactccatttcaaaacacacactcaaacccaacaacaacaacaacaacaaaaacttctaagccctgtggttgttgagatttttaaaaatgacatacaggccaggcgcaggggctcacgcctgtaatcccagcactttgagagactgaggtgggtggatcacttgaggtctggagttcaagaccagcctggccaatgtggtgaaaccttgtctctactaaaaatacaaaaattagcctggtgtggtggtgtgaacctataatcccagctactcaggagactgaggcagaagaatcacttgaacccaggaggaggaggttgcagtgagcagagattgcaccattgcactctagcctgggtgacaagagcaaaactccatctcaaaaaaaaaaaaaaaaaaaaggtgggggagggagggtagctggcaagatggccaaataggaacagctccagtctgcagctcccagtgagattgacgcagaaggtgggtgatttctgcatttccaactgaggtacccagttcatctcactgggactggttggacagtgggtgcagcccacagagggtgagcagaagcagggtggcgtgtcatctcacccaggaagcacaaggggttgggggatttccctcccctagccaagggaaactgtgagagactgtaccaggaggaattgtgcactccagcccagataccatgcttttcccatggtcttcgcaaccagcagaccgggacattccctccactgcctatgccaccagggccctgggtttcaagcacaaaactgggtggctgtttgggaaggcagcaagctagctgcacaagtttttttcatataccagtggcacctgggatgccagcgagacagaaccattcactcgcctggaaagggggctgaaaccagggagccaagtggtctggcttggcgggtcccacccccacggagcccagcacgcgaagatccactggcttgaaattctcgctgccagcacagcggtctgaggttgacctgggatgctccagcttggtggagggagggcatctgccattgctgaggcatgagtaggcagttttaccctcacaatgtaaacaaagccactgggaagttcgaactgggtggagcccactgcagctcagcaaggccactgcagccagactgcctctctagattcctcctctctgggcagggcatctctggaaaaaaaaggcagcaatcctagttatttacttatagataaaaccctcatctccttgggagagagcacctggggaaaggggtggctgtgggttcagcttcagtagacttaaacgtccctgcctgacagctatgaggagagcagcagatctcccagcacagtgttcgagctctaataagggaaagactgcctcctgaagtgggtccctgacccccatgtatcctgactgggagatacctcccagtaggggccgacagacaccttatacaggagagccctggctgatatttggtgggtgcccctctgggaggaagcttccagaggaaggaacaggcagcaatctttgctgttctgcaaccttcactggtgatacccaggcaaacagggtctggagtggacctccagcaaactccagcagacctgcagcagaggggtctattagaaggaaagctaacaaacagaaaggaatagtatcaacatcaacaaaaaggacgtccactcagagactccatccgaaggtcaccaatatcaaagactaaaggtagataaatccatgaagatggggagaaaccagcacaaaaagactgaaaattccaaaaactggaacacctcctctcctccaaagtatcacaactcctcgccagcaagggaacaaaactggacggaaaatgagtttgacaaattgacagaagtaagcttcagaaggtgggtaataacaaactcctctgagctaaaggagcatgttctaacccattgcaaggaagctaagaactttgaaaaaaagttagatgaattgctaactagaataaccagattagaggagaacataaatgacctgatggagctgaaaaacacagcacaagaactttgtgaagcatatataagtagcaatagccgaatcaatcaagcagaagaaaggatatcagagattgaaggtgacctcaatgaaataaggtgagaagacaagattagagaaaaaagagtgaaaagaaatgaacaaagcctccaggaaatatgggactatgtgaaaagaccaaatatacgtttgattggtgtacctgaaagtgacgggagaatggaaccaagttggaaaacactcttcaggatatcatccaggagaacttccccaacctagcaaggcagaccaacattcaaattcagggaatccagagaacaccacaaagatactcctagagaagagcaaccccaagacacataatcgtcagattcaccaaggttgaaatgaaggaaaaaatgttaattaagggcagccagagagaaaggtcgggttaccgacaaagggaagcacatcagactaacagcagatctcgctgtagaaactctacaagccagaagagagtgggggcaaatattcaacattcttaaaggaaagaatattcaactcagaatttcacatccagccaaactaagcttcaaaagcgaaggagtaataaaatcctttacagacaagcaaatgctgagagattttatcaccaccaggcctgtcttacaagagctcctgaaggaagcattaaacatgaaaaggaacaaccggtaccagccactgcaaaaacataccagattgtaaagaccattgacactatgaagaaactgcatcaactaatgggcagaataaccagctggcatcataatgacaggatcaaattcacacataataatattaaccttaaatgtaaacaggctaaatgcccaaattaaaagacacagactggcaaattggataaagagtcaagacccattaatgtgctgtatgcaggagacccatctcatgtgcaaagacacacatgggcttaaaataaagggactgaggaatatttaccaagcaaatggaaaacaaaacaaaacaaaaaagcagggattgcaattctagtctctgatagaacagactttaaaccaacgaagatcaaaagagacaagggcattacataatggtaaagggatcaatgcaacaagaagagctaactatcctaaatatatatgcacccaatacaggaacacccagatgcataaagcaagttcttagagacctacaaagagacttagactccccaaaataatagtggaagactttaacaccacactgtcaatattagacagatcaatgagagaaaattaacaaggatatccaggacttgaactcagctctggaccaagcagacctaacagacatctacagaactctccaccccaaatcaacagaatatacattcttctcagcaccaattcacacttattctaaaattgaccacataattggaagtaaaatgctcctcagcaactgcaaaagaatggaaatcataacagagtctctcagaccacagtgcaatcaaattagaactcaggattaagaacctcacttaaaactgcacaactacatggaaactgaacaacctgctcctgaatgactattgggtaagtaacaaaattaaggcagaaataaagatgttctttgaaaccgatgagaacaaagacacaacgtaccagaatctctgggacacatttaaagtagtgtgtagagggaaacttatagcactaaatgcccaaaagagaaagcaggaaagatctaaaattgacaccctaacatcacaatttaaaaaactaaagaagcaagagcaaacaaattcaaaagctagcagaagacaagaaataactaagatcagtgcagaactgaatgagatagagaaacgaaaaacccttcaaaaaaatcagtgaatccaggagctggtgttttgaaaagatcaacaaaatagacagactgctagccagactaataaagaagaaaagagaagaatcaaatagatgcaataaaaaattataaaggggatatcaccaccgatcccacagatatacaaactaccatcagagaatactgtagacacctttacacaaataaactagaaaatctagaagaaatggataaactcctggacacatacaccctcccaagactaaaccaggaagaagttgaatccctgaatagatcaataataagttctgaaattgaggcagtaattaatagcctaccaaccaaaaaagtccaggaccagacagattcacagccgaattctaccagaggtacaaagaggagctggtaccattcctttgaaactattcccaacaatagaaaaagagggaattctccctaactcatattatgaggccagaatcatcctgataccaaaacccggcagagacacaacaaaaaaagaaaatttcaggccaatatccctgatgaacatcgatgcgaaaatcctcaataaattactggcaaaccaaatccagcagcacctcgaaaagcttatccaccatgatcaagtaggcttcatccctgggatgcaaggctggttcaacatacgcaaatcaataaatgtaatccatcacataaacagaaccaatgacaaaaaccacatgattatctcaatacatgcagaaaaggccttcgacaaaattcaacagcccttcatgctaaaaactctcaataaacctaggtattgatggaaggtatctgaaaataataagagctatatatgacaaacccacagccaatatcatactgaatggccaaaaactggaagcattccctttgaaaactggcacaagacaagaatgccctctctcaccactcctattcaacatggtgttggaagtcctggccagggcaatcaggcaaaacaaagaaataaagggtattcaattaggaagaaaggaagtcgaattgtctgcagatgacatgattgtatatttagaaaaccccatcatctcagccccaaatttccttatactgataagcaacttcagcaaagtctcaggatacaaaatcaatgtgcaaaaatcacaagcattcctatacaccaataatagacaaacagccaaattgtgagtgaacacccattcacaattgctataaagagaatacctaggaatacaactttcaagggatgtgaaggacctcttcaaggagaactacaaactaccacttgaggaaataagagagaacacaaacaaatggaaaaacattccatgctcatggataggaagaatcaatattgtgaaaatggccatactgcccaaagtaatttatagattcaatgctatccccatcaagctaccattgactttcttcacagaattggaaaaaactactttaaatttcatgtggaaccaaaaaagagcccgcatagcccagacaatcctaagcagaaagaacaaagctggaggcatcacactacctgacttcagactatactacaaggctacagtaacaaaaagagtatggtattggtatgaaaacagatatatagaccaatggaacaaaacagaggcctcagaaataacaccacacatctacaactatctgatctttgacaaacctgacaaaaagaagcactggggaaaagattccctatttaataaattgtgttgagaaaactggctagccatatgcagaaagctgaaactggatcccttcattacaccttatacaaaaattgactcaagatcgattaaagacttaaacataagacctaaaaccatgaaaactccagaaaaaaacctaggcaaataccattcaggacataggcatgggcaaagacttcatgactaaaacaccaaaagcaatggcaacaaaagccaaaactgacaaatgggatctaattaaactaaagagcttctgcctagcaaaagaaactatcatcagagtgaacaggcaacctacagaatgggagaaaattttttgctgtctatccatctgatatacagctaatatccagaatctacaaagaacttaaacaacttcataagaataaaacaaacaaccccatcaaaaagtgggtgaaggatatgaacagacacttctcaaaagacgacatttatgcagccaacaaacatatgaaaaataggtcatcactggtcattgaagaaatgcaaatcaaaaccacagtgagataccatctcatgccaattagaatggcgatcattaaaaagtcaggaaagaacagatgctggagaggatatggagaaataggaacacttttacagtgtttgtgggagtgtaaattagttcaaccattgtaaaagacactgtggtgatccctcaaggatctagaactagaaataccatttgacccagcaatcttattactggggatatatccaaagaattataaatcattctactataaagacacatgcacacgtatgtttattggggcactgttcacaatagcaaagacttggaaccaacccaaatgcccatcaatgatagactagattttaaaaagtgccacgtatgtaccatggaatactatgcagccataaaaaaaggatgatttcatgtcctttgcagggacgtggatgaagctggaaaccatcattctcagcaaactaacacaagaacagaaaaccaaacgccacatgttctcactcataagtgggagttaaacaatggtaacacattggggggcatcacacaccagagcctgttgaggggttgggatagcattaggaaaaatacctaatgtagatgacaagttgatgggtacagcaaaaaccaccatagcacgtgtatacctgtgtaacaaacctgcacgttctgcacgtgtaccccagaacttaaagtataataaaaaaaggacatacattcaagtacccagtctaatacctgatgcatagtcagtgctttataaataattataaagctattaatagtatcattgttgaatacctactatctgcccagcacatgtattaactaattttaccatttcaccaaccttatgagaatggtgctcttattttatgcatgaagtaactgagccacaataagtctaaggaacttggccaaagtgcacagctaaacagggctggaatccatctatacccaggcaatctgcatccagaccccttcaaccacggtgctgtattgacccactagctcttccttttacttccgggcaacttggagtgtggtgtttttctctctcagaaaagtcatgttatcttttccgcttaacacatgtatcctggcttgaattaaatgtctgtaaatgtgacaatctcttttaagttccacagacatcaaatgacactattttttagtcaaataccatggacaagcttaagggactcataattcattcattgtgctcttattgagtgtaaaaataacgtgttttctaagagggcaaagttataacttcgaagaaagtgtgaagccagcaggtctcaggagggaaaaggagcttaaaacagctcaacacagtgtttctgattgtcacagtcaatgaaattatggaagcttacttataagggacttgtgaaaaaagtgatttggggcctggcaccatggctcatgcctgtaatcctaccactttgggaagctgaggcgagaggatcgcttgagcccaggagtttgagaccagcctggtcaacaagacgaaaccctgtctgtacaaacagaaattatcagggtgtggtggtgtgcgcctgtaatcccagctacttgggacgctgaggcaggaggatcgcttgagcccaggaggttgaggctgcagtgagctgtgattgcaccaccgcactccagcctgggtgacagagcaagactgtctcaaaaaaaaaaaaaaaaaaaaaaatgacttgactgggcatggtggctcacgcctgtaatcccagcactttgggaggccgaggcaggcggatcacaaggccaggagatcgagaccatcctggctaacacggtgaaaccctgtctctcctaaaaatacaaaaattagccaggtgtggcagtgtgtgcctgtagtcccagctgctggggaggctgaagcaggagaatggcatgaacccgggaggcggagcttgcagtgagccgagattgtgccactgcactccagcctgggtgacagaatgagactccgtctcaaaaaaaaaaaaaaaaaaaaaaaaaaaaaagacttgaggcagatttcttcgtttaagtggtgatgtttcatttctacattagtacttgaaaaatctgattagtggagttttctgtacttataaatctcagctgctctttttcggcatgaagtatgtaataacatctgtatatgccaagttaacaaaaggtttttcctgctgtcacttcattttaaaacactcttttcagtgagtgtatgtcccagtaactgcacatacttctgtccccaaagacagaacaccgcctcctttctcctaggagtatcggatatgtagtcacgtttaccatgttctgagcattttgcaaggtagttgtacatctcccctttccctggggggattagccaaggaactgaattattcattgcttgataaagattaaattgtgtttttatttaacaccaggtctaattattgatgcttttggagaactaagagaccaacaggaacaagtcaaagaagacatggaggtaagcttctccattcatgactcagcttctttgttgtcctgggccctcgttttcctcactacctttatcaatagaatcatgaatgtgggaaggaggagggggaagggcacaacttgtggtttcactggcgtgttttccattcaagcaatacatatagttgagctgcgtggtcggctgaaattgtggtggacgccacatgcatgcaaacagcgataggacaccatcctttccctccagaagtggagagactattcattcgaaaccaaagattcaatgacaagtaaatagatgattacagagcagtgtggtgagtcctttatgggagtaaagccctggagtggtagggtctctagggctggtatctgattcactcctggatggtcagggaatttcctagaagaagggatgtctgagctgaggcctgaagactgtggaagtctgtgggtttgataaggagagaggaggacagtttgggcaacctcccaaccccttctcccacaccatggacatctccaggggtaccattcacagtgggacctttgagcccatcaccacctgaaattatataccaagactgattttagggaagttgatgtgcaggtttttttcttagcagcctcagtgctaccagatgcagattaaattctgatgatgaggctggagaggaataccagtgaatgaagaatataatcactcatttgagaaatttacagtttaatatgtgggctgtgggaagcaagaaaagggctttaagcagagcagccagatgatcagatttgcattttaaaaagataactatggtttaaaatgtgaggcatgaagtagaaactggcaagaacagggacagggaagtgggctgtcagcattttccaggtgggagattctgaagcttttgctagaggtggcacatgggagttgggcaagtactgcctgaatccatctagtttctgcatcctcagcgagggacttggtgactgaccaaatggagaagatggagcaagcaaggggatatccaggcttcaggcattagccaccagatggatggtggcatagttagctgacctagggaacccagaggaagaacaggttcatcggtaaagctgatgagtgtgatttgagccacttcaatttaagagacatcattggagtggtatgaagacctgatcgattgttctccccagttgctcaatgtgacctatcagctgtcagcagttgttgatcagtaaggcaggaagaattttatacactattataatcatcttgattgtagttcctaaaatacagggtctcataaacatgcttcagatggcataaaacagcttacaactggcagggaaggatgagcaccagagtcacatgggacaattattgaatacattgcttctccttgggttttgtggaccaggcctgtctgcaaggggcagacctaagcaggtgcccctctacagggtgcttaggagaggcgtggtccagagaaggtggaaccaagaggaccaggaatctggtccctagtgccgaaagttgttctccattcacatccactggctaattctgtacctagcacagcacctggaagacccttgctaaactgtagatgggatgtctcatagcttggtatttgatttggccttttctaaaggaaagtaatctgtacctattcccccttggtcgtccgactttgtttgggtgggtactaagtttgtagtttcagttgaagacacagttaatcctgcttagataactttagtcaatgtcatgaacaagagttgatcactaagcctggacattttcacctaggctagagaaaggaagagacgttgcttttcagccatcatcatcatcatcttgttccctgtctgcgtctgctacttcttgctgctggtacctgtgtcatttaagccaacaccaagatatagttacagcgacagttccatttatattcgtgggcttggcacagcctccatgtgatgatctttgacgtgtattgagtgaaccaaataatagctgcccctacatggcgagttgtgttttccttttgttttgctttctgaactctgacgttaatatttccctttgttttctagaccaaatgcttcatctgtgggataggcaatgattacttcgacacagtgccacatggctttgaaacccacactttacaggagcacaacttggctaattacttgtgagtgtgcccgtttcagaatcttccacctctccagtagacgccactggtccctgcccatctcagaatagagaggaagtttttgtttattgtttaaaaaataattgctgcagatactttaaaagaaagtccaacagctaatggctctcttttcctctggagtaggttgacttaagaggttaagttgcagctcttcatgtaagtgatgctttctagaacttgaaatgaagaggtggacagggaggagcagggcctctgtgggagtcttggtcatgtttctcattttagataggaattcttaggctgcttcctagggagatgcgagtctccgtttttcttcttacagatcttaagaggactttcagatctcgtcaggcactgttggataccaacttaaaagctgcatttaaaaaaatattaatacatagaaatctttccattactcgagattagccaaaagtatagtttggtaaaatgctattcttactcattttccgacccaattttagtatcaaacagaagagatgccgagtagcattatagggaaaaaaaattggcttaactatactcagtggaacttgatcagtaaattacaacttctcattaagctagtcttcagttctaattcatcagtgttgatttgattctgaccagtgtgtatattcctaacttgaagcctctagggtcaaatagcaacagatcagaaaagtcaggtccacagcctttcctctttctggtacactaatttttccaaaaatttgcatgtggcgttttctctgtgctggccataattgattgcaaccatacaatttatctaaatatgccctgtttatcctaatatttccataccgttcatttctgatcagtttctctgtatctgtaggttttttctgatgtatcttataaacaaagatgaaacagaacacacaggacaggtaggtaaattattacatgtcatcttctgaaagaaatgatagagaagctctaaatatcagaacaaaatgtgtgcattaaacagtgaggcacggaattactttcagatattagttgtggtatcttgatgtaaagttcctgttatgttgaatgagtatggaaaagattgcctttgttaaagtagaattctgtactaagtttatgtaacacaataagcttttactaactgaaaatgctggatttgagttttgaattccattattttgaaaaattgagttcttaattattgcataatgtctttgtttaatcagatagatgatttccaatgaacttcaaagtattatgtacaatgcatgttaaatgcctaaggtgtttaagctatttgaaattcctcttccactgtgcagattgttagtagtttgaatttgaaggatacgatattttaagagaaccctcagaagcataaatgtatatatatacacacacacatatattttttgagacaaggtcttgctgttttgccaagttcaagtggcatgatcaggacctactacagccttgacttcctgggctcaataaatcctcctgtttcagccccacaagtacctgaaactacaggcatgcaccaccacacctggcttttttttgtgtttttttttttttaattttagtacagacaagatctcttatgttgctcaggctggtcttgaatgcctgaactcaagcgatcctcccacctcagcctcccaaaatgctgggattataggcttgagccagtgtgcccagccaacatatttttatcattataatggtcaggatgaagattattatgagacgttaaggtctggtatagttagttaggaaccatctaaattaatgtggacttctctattccgtgcgatataggtaacagaattgagtttctaccttatgttttgttagcacacactttggggaaaatgttaatacatttccttgacttttgcaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcatcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaac

SEQ ID NO: 370 - DNA, 1114032 bp, Homo sapiens
tgtgatagtgttggaatttaatcacaggtttacttaacttggattccattgtcttttatagagaaaaagcatatttatgaaattagtattttaatattgtttgcaactaatactgtatgagtttatggtttctggcatatcaagatgaacaaatataacaaaagtacatttaatggctacatctttaagtgtatgaatatagaggtctttaatgactagttaaatccagaaaaaagagagtcaacattcttcctctataatataaggatgggtcttcccttcaaatgcagccttctttactttcccacttaagcacgaaatggtgccgcatataatttttaaaatcaataaatcacagttgtattaagaaatattttattaacaaaacagtaaattccacttgcttagcatttccaataatggataaattggccttgcaacagaaaaacaaacaaacaaaaaaagaagaagaaaacccctttgatacccaatcacacaaagcactagaagggtagggttatgtggcctttctttgatgtcttagggattgaccacttcacacgttattgtagtatttgttcttttaaaaaaggcaacacattacatggataaaaaagaagcataatcaatcagaaaagttacagtctagagatgtaatcaaatttatgccaagtcgtgtgaaatcctcaatcaactgcaaactatgcagggaaccctgatatgtttggtatgaagatacttgggattcaagtcattttctctttctaactctgttcctctcttttctttttccattgaggaaaaaataatttttgctagagtttgtgtaagccaataatattagaaataattttgctgataataaactatatcaatcattgcatgtaactttaaaatttacgctggggagaaacattgaaatcaatcccaaacaacacatttcatagatatactgcttaaaattaccattattcaatttattttctattatattttagaatctttccagatggaaactggttcaagcttaatagataaaatagaaaagcaatcttaaaaaaaaaaacccttcaagctgtaaattagtagttttacacttcccttcttatttaactggctttccctgagtaagactgaatgagacgggggaaaagaaaagactcgtgaattatttaatgtggcaaattaaaaaaaatgaaaatctagaaaagaagcaatggatattaaattttcattttataccttctactttctgggtcataaaaagccactaaatttctttgtacacaacaattacttggcaaccatagatagtggtgatttgctatgaattatacatatttctaaggtgctgtatgtctgaaatccaggccacttcttggcttttttttcatcaactaaagtatcacaaaagatgttttgcattttttgcctttgctgattaaagctaattggaaagatattcttctcttctacaaaattttttatcgttcttttagaaggtattcaagtaatgcaaccaatttttcctgaaacatcaacttgcaatgtaataatgcattttttgcactaccttctcatattagtaatttattgctgtgaacatcattgaataatatgcaaaacaagtgtataatctatacttttccactacttaatgtgttaaactaaaactatatttaatgatatatatgtaaaaccagaaaagttaaaacatagtcaataattaacagagaatgattttttaagtgggtagtaatacagaatcaaaaattactgaaaaatactttcttagtcgagagaaagtgtttactttccagaaatgttcatcatgcacatcagattcagagatatatatattattttattagaaagaaagttttcaattgcagcagccagagttaaggtgtagattaaccaattttgcttccataacctgcccacataatggttcttattcatgcagcagtatatcagtgatattctatttgataaggaaaggttcatttctttagggactaaaatcttcttaaggttacctgggagcaagatctcaatgaagcaaatcaccccatttgtcatcaataccttggcacaaccctcttccttcctgcttttcaatttgtcaataaatatttgctactgtatgcacgtttggatcttccagcatatctgatggattgctgtggattcgtgtgtgtgtgtgtgtgtgtgtgtgtgtgtgtgtgtgtgtgtgtgtgaaaatagtgaatgtatgtgggaatgtgagtatttcagggagaaaagattataagatacatatgtatatatgtgactttctaattcacacctttcatacaagtactaaaacttaattgcaacagaatgaaggctgtacatataagaaaagaagtagctgagtctttgtatatacattcatacatatcttccttagaataaacactacactgtaatttctttaaaaaataaaagtaattgtggcaatttataatggtggcaaaaaaaaagaaaaacccaactgaaataattgttgctctgatgtcataaaactccctatacttagcaacacttataacattgaatttaccaaaaatggctgaagagcagagatatattttgcattttctatacaacaggctataaaacgtcacttatcacagtccagaaagcacacagagatggattttatataaacatatgtaataacataataagcgtgcatgaaaatttcccaatgattgcatctatgccctcttgtttttgttttgaaattttgtgtgaaaacgtgccttatatttcacatttttgaaaataaggcctccatacttttttttcctctctcacaaccagaaaggggctttttgaatgtgttcctacacaagtcttcaaaaaagccagcactttgtttcaaatgcaagttccaaccactgctccagttgcaccaggcggcaaactcttaaaggtttgcaggttgagtcactcaaaaggacagtcttctctggcaattggactgacttctcaggaaagcgctagcactttggctaaatccaggatcataggtagcttcttttttgtgttatgttttgtgttggtttttgtgttgtgccttgatgctgtagtactcctttgctttatgaatgcgtgcggtcatcactgtcttttagaaatgttccagcaacataaagacaagcagagtaaatgaaaacactgtggatgttagggaatttattggcccctgttttttgttttttgtttttcttttttgagaaacaagagcatgagatacttgtttttattttttaaaaagtctttccttcctgattgcattccctgtcttcttttgtatgtgcttcataaaaaggaaagtaaataagtttatattatgtctcagataaaatgaagactatttctatacaagtgtccatttaagatcttgggatcagacataatactctttatccttgtttttcttatttttgttggagcttttcgcactgctgggttgtttctcctttacaacagccccattggactgtgctgagttactgatgtagtttcgactctcgtccacatggtatgagccttcatcccggtttctgtacttgtacatggcatagaggaggataaggatgcacagggcggcagcggctactatcccaacgaccatacccgtggtgctgctggactcccggatcacttctgctgagcctggatacggctctctgccgcctgctcgggttgggttggctatagaaaagaggatgagaacaaacacaaagtgatcattgagttcactgaataccagagagctatattaacatttattatctaattctaacagcacctatgctttaggaaaggtatgctattgataaatgtagccatccctttgcctcatggttactaaaaactagggactgtgatttaaagttctctgggagatttgttgctgtgtcttctttcttcacaaatcaattttgttcacagagtttggtaagcattgtcccaaataaactccaattagctctaaagggccatgtgggtgacttaagtaaaaaaaacccacaaacccagcataaagaaaagcagaacagccctaccctataatactagagggaatcataagaatcaaataggtgttgctctagaacataggtctaactctagactgaatcaggacaactaaatttaggattactttagaaatcatattccccttgtattttaaagaatacagtattgaacaataagataatccatacattttaactgtctgctttttaaagtataactttagttacatttttataaataaaaatagactaatttccattttgttggagattcatttgtttacataagtatgtgtgtattttattaattgattggggagctcccaagatgaactttggaggagaaagtaataaaatattctttctcagttttaaatacagtctagattgattttttggtcaaaactctgaactacctaatagattagataataatagaaggctggctagtctagttttattcaactgacaaaacccttcttcagtcttcccaaagtataaataaggctctttcttggatgagaccaatggattttggggtgcctacgtcttcttgaaggcctggtcaggcactgaaattgatgattgatggggaagaatggacctgagatttaattggtagatatgaggagaaggggcagctcttttcccctatatataataaacttttttgatataaaaggatagaaactgtagcgagagaagaagattctatcctactctgactgtaggtcattttttccttgtgaattgtgttttctgtttttccctgaatctctatcctctcgcttgtcttacataaaaatattacttttcagatgtaatgtattaaaaatgctacaactttcaaaacactattctttgccaattatgtataatgaacaaataatctcatgattccatatatattagataagaatgtgtgtgtatgagtgtgtgttcatgtatatgtaagaactgaaaactcaagaagactaaaattgtgcttttatttcgctactactaaacatcatttagtaattaattttaatatttctgcaaaagttcttgttaattactgggaatcattttaccaaacatatggctctatactgctttgtaattccattttcaaatatcaccaatatttcttttgcctaaacgtgtgtgtgtgtgtgtttttctgtgattttcttttccttcctcaaataaagccttaacaaatacagccatttccaaagtagtagctcttagtctcaaagtagcaataagctatgttctggtgctacaaaatgtagcaggtaaaactttttatgctgaatgtgtcattgcttgttttacaaaagcccacggagtgtggctgaataaaaagctttggtgttgcttctgtggacaaggtgaaaggagacaaagactataatccacagtatttgattacaggaattaatttcctctcatgaagaatagaatctactgcagtaactctgtcactacctgacaaaccaaaggcagcactttttcttttaaatacagtcatctttgccaaagtgtgccaattaactcagctgctttcactaaatgaaaactttcattttacagagcattcttttactatggtgtctcaagagctaaaaagggaattttgtttaaatgttacctaaatcattttttccagcctgatggaatgctttcattttaaacacattttcacaattacctcacttttactctgtctgccagaaaggaatagggagaatggagataacatttgaatcatttagcttatgacagtaaaatttgagaattttaatggagtggagggtttatattttgtatactaagaatagacatgtatttttttcaataaggaattgatatcgtaaatggactatcttatcaaaaaaattttatttttatctgctaaaatatttctgagaggttttcaaaacaactatgcacatagcatgataacagcaactttgtgttaaaataagaatgaggtcacaaagaccataacaaagcctgaaacacttcaactgtgccatatgcatttgaaaacatctcctgtttaaggaaaacactttcttttttgcaacactagccaaattgttgcttaagtcatatgaggcctaaaaatatctctacacaaaacccagatgtaaatcccagatgtaaaaattctaaatatcatgtttcttaaaaatataacctagaaaatctctaccaaaattaaaatctaaacccaataaacatgttatctttcttttccccagattcacattaaaattttaataaccatcatagcagatattattataggtatgttcggaataggtagttactccaatatctaactgattaattaatattctttttctatttatgcttcaaatctgaaggctaagtgaaatttttcttaacttttcttctgagactagaaatatttatgtgttggtcgggtgtggtggctcacatctgtaatcccagcactttgggaggccgaggcgagtggatcacgaggtcaagagatgcagaccattttggccaacatggtgaaaccctgaaatacaaaaattagctgggcatggtggcatgcacctgtagtcccagttacttgggggattgaggcaggagaattgcttgaacccgggaggcagaggttgcagtgagctgcgatcgcacactacactccagcctggcaacagagcgagacactgcctcaaccaaaaaaaaaaaaaaaaagaaagaaagaaatatttatgtattaatgggacatctctcccagatatgcaataacaggccaaagagatttaaatatattcatgaattataaatgtggcttctcttattgtcgctaatgctttattttgatgatcactgagaaatctctgatgaaattttatattaatgtaaatgtagagaatagtatcaatgactaatatggttaaatgtctttttatataatttgttcaaaatttatataaaaggtaaatgcagtcatctcatccatttactaaaatgtgaaaaaaagagaaacataattaatttgtatatttcatggatttaagaattttgcattccctctacactatataataaactaaaataagacatttttaaaaaattaaagcaatctgcaacatgtttttctcttagcagtgctgaaatgtgaataatgtaattaattaaaatttactttcatccttttctttctttgtcccagcacgtgacaaagaaacaagtgaaagagaataacttgttaaaaaagatttaacttgttaaaaaaagcaagtaaaagagaataagggagggggagctaaaataatggcatacacacaaataagcttaagtctttaagtcttgaatcttcaaagattaactccgacgtgtaggtaaaattaagccgatgtagccagttcattatattgggcccaggggcataaggaactcggttcaatggaaaacttcagtaggactgacagtggtctactacaagcaaggagagcaagaatgcacaccttcatcacaatacaaaggcttttgacttttgctggcatttttaacctataaatgatttggaagctaatgattattctagcaaggaaatagagcagtacaacagttatgacccatttcatatttatattcacttctttctcacttctgagattcatttagccaaatggctatagaaaaatccctgggactcttgcacttataaagcatgttaccttaaaggaccactgaaaagtagtttttaatccttcctctctcttctagcatttggtaagatacggtggtctctagaagttttccacatggtctgctttgtccctgtagatttatcaagaatcctatgaatcttcttgttttttgttgtctaatatgtattgtggtaacttcggtaaacacgagctatcaaatgtttggacagttagtaacctatttctgcactatgctctaaatcaatttgttcatatctgatgataattcagatgataattcattgtggaaaatgaacagttactactaaaggcatattctagtgccttgtcacatagaaaaaataaatgcaactgttgctctccattaaaaagtaaaaaaaaatctttaagattttaatttgtcttttgctgagatagttattttaaacaacaacaggaaaggaaatcgccctatgtattatttatttatttttgatagtctttgatacagtatctgtgaaagaacatcatttcctcaaattagaacaaatttagatccaattaagaaacacatggggaaaatatgtttgagacacattagacttcagtacagaccagagagggctgtcagtgcaggcttcatctcttaccagcttcttgcaccctctgttgcttcctccattctcctctgtatttctcctcccacttacccttctttattgcctctgtgccttgctcttccagctcctgaattatccttgtaggggccctccccacccccaggtaaatgaagaaggtcaggccagcaggggccaggactttttgcctcatgggttagcatattactcaggaaggtgttcaataaaccacaaaatttattttcaagttctgaatttcaaaacacaatgtaaaataattcttactggcacaaatgtctaagtgtgactatttcaccagaacaggttttgtgtttcatattggcatgattacttttaaatataactttctaaatttgtttgcaaataaaattgtatggtttggcaaaacaaataatatttgatcactaatttaaaagacttttgtgatgcatctggtgatatgatgggggcacattaagccattaaactttgcattgtatttatcagtttgcattgtttgattatatctaatcacaccttagcatatgcaaacagaagttaaagcttgcaattacttagtacaatgattcacaactgaagtgctaaaataactaagcaatttgaaagatagatacatttttgaatgttaataaatttttccaaggagatttccctttgcaatggtgacatccttcatttttctttttgaaattggaaacagcaatcaattattgtcattaaagaaaactgctcttgatctatgtttttgcaactctgcatgataaatggtgtttaaaatcctaattcctgatatagaatggggtttggtgggtggtgggaccttatctttctattgacaagttcaccaaggcattagcatgccatcagatggtctttttatcactcaaattgtcatttttatgaaattattttgtatacttgaatgagctgttcttccactgtaatcttatatatatattttggttccaaagttaactttcaaggtaagtttgtagtttctaggtaatttttcgggctggttttatttcttcagtatagactgttaatgtatgtgtatgtcgtcaactatgaacctggcacaccaaggataaagtaagagtatcattataacctgatgacaatggaaattcagcttttgagctttgagaaaaagattgtaagaaactaccaatcttaggaaataataaagaaaaaaacatgctagtggttaaaaaaaaaaacataggctatatatttaagatcaggaggggaccataagggatcattaaactccataatgcccagcacgcatcattctgctaaccagaattgttagatgtcctgtcttgcaatgatccttaaaaaaaaaaaaaactcttggcaagatgcatttactgaatttcttctcactaagagtttctgaccagtctttctggttttctcataaattaagcttaaagtaatagattttaaatttctgtctccaccccacctaggaaagagttgcctaaaatgatctcattagaccagagttctatactgtgtctaatagatgtggaagttattataattctaggctagacttgaaagtgattttggatttatagggggaagatttgacttttccaatactcagtttcattaatactgtgaaaagaaaattggaattgtagcctcctggggtgtttgtgaattgagattagcacacttttttcccccatttgaaaaaaaacaactcaaagtttattactttttcccatttttttgcttcaatacagtgtaggccagaagaaacaattatgatgcaatcattcacaagaagccatgtttaaatactacatttgtaggaaagcagggacacaatgatttatatgacatgcattaatttcgactcatgcggtggttttgtaagaagtgagggatgctgactgtttcaaattccttcccttctccctcccaccaattccacccatgcctgcacattctgaagtacacttacggaggtcagacaagtcttgagagaggacatgtctgacacatcttagcccttccccaatacatcggagatttagaaagaacttggaaatcaataaacctttgctacctgcctggctgctgtctccgatattttcctctgcttctttcaaaaccaccaaagcatgcatttgaagggcagttaaggggccaccactctgatattgagacgttcattatcttctccagagatctaggtattgaatgggaagggatgctagacacggaaaaactcatcatgtgcctgcatgatggagaaacccaactaggacaggctgctacctcatatggtaccacatcgaacagaagagacaatggatgtccacactctgtatgaccttggtgacactgaagacaaataaacagaggaacatgcacaatctccctcatctccaggggaagccataggatcatggtatttacaaatcttattcttcaattattcactatgttgtaaactatatgtccacagcttagtcatctataagcttcatagactttttacatagtcattgtatccttgtggtttgcatctattatggtgcttactccagcaccatggtccttactgttcccatggccattcatagtctgttcacagctacctactccaatttgtcttccatatttgtcaaaggaagttagagccataatattattgctgtccccaactcctcacataccaaaaagagttcaacctttatgccttgctcatataaccttttatctcctgcctgtttaaatagtacttatttctcgaagcttggctcaaatgtcccatcttttatgattttttttctctaagaaaatcccctccttctatcaacgagtatataatgagctatagttaacattccagggactatatgaggtcctgagggtataggagataacgaaacaaacttgatgtatatgtcctcatggaccttaaaatatagtgaggcagagaggcatacaagaaggaatcacacagttaaagtaacagctgggatatgcatgatgaaggaaaactgtaggtaccatgcaggagtaggacaaaggtttctgattgcaactgcagaatcagatctttctgaattagtgacacttatgataaaaatgagtagagagtcgtcaagtgaaagtgggtagagaagtctacgaaaaacatgtcgaatgaccttgaggaaacaaagtttacttttcaggaattaaacaacagttagagtggttgtagcacagtgagatttaagggagagtgagaagaaatttcaaggtggacatgaaatttatcacagagactgtagactatggaataaagtcataataaaaagatgagcgtatttaaccccataaataacaattttatgtggcaaaagccataatatcattaacaaaatgaaaatgacaaaggagggaaatatctgtagtacatatgacggaccaagagtaaatacctctaaaatacagagtgtgtgtcaactgataggaaaaaagacaaacaacctaacagaagtatggagaaaactacacacaagcaagtggagaagagatctcaatgctggtgagaatattcttaataattatttgattgttattagaaagtaatccaataacatctattaaattttttaaaataaataaattctctcaaccgtatatcacatcacaaattttaacattaattctatactattgtaaaatctcacttaaatgtttcatccaatagttttgtcttttttcaactagactgttggtcctttgacagtttcctgtgactctgtttctctttcttattagttctctcaccttccaaactctaatgaagattgaacacactggctgaaaactgcatgttttatgtatagttagatgaaagcttttgtaacttgataaattttcaagggtaaactaggttgaatctaatcattaagaaagtgtgaaagtgtgaaagccaagaactgtgtggctcacacctgcagtcgcagcactttgagaggctgaagccaggtgttcaagaccagcctgggaaaaagaacaagatactgtctctagaaaaaattaaaacaaatattagttgggcatagtggtgcacacctgtagtcctagctactcgagtccgaggtgggaggaccatttgagcccaggagtttaagaatagagtgagccacgatcatgtcactgccctccagcctgggagacagagcaagaaagtgagagacctttgattttaaagttttgagtaaaggtgctaagcaagggggttgaacactgacattaacatctcatatttctttaactcactacttctctaaccctcaacctttgtaatatctgcagtaaaaacgataaatgtaatatttacttcattaaatcagaaatcacttcttctgtgctttggagaattgggatcaatatacaataatgaaaatactgcatttgctttccctatgcttcaaggtaatatgtcacttaatcccaatgactaaagtcactaagctatttaaagttaactgagtcatcagtttgattcatttggatgccttatttacatcaacatcatctgacacccacagtactgcaaatagttgacagctaacttgagctcttttttcaattcagagtagttgtagaaatttctagggtgcttttcagtcctgttgctattggaattgaaaagggtctctttactcaggcccaactttccataattgtcaagcagaagaaagccatataggcaataattgagaaaatcagtttcaaaactagggaccccagagagtctgtatatgtttttcctcaaaatgtattacattccagaaaaatgcaagaagagttatattttgaaatgtggatgatactccttattaactgatttcaactcaactgagcttcttgataccaaaatagcttctcttcctgggagctcattgactacaacacccaaaaatatatacatccagaaatcacttttcttaagatccatttccttttttatatatagataattgaataatctatctttacaaaataatgagatttattccacagaattcttaaggcctgaaactagaaatttttggaaaacctggtttatagtaagacaaaaatggcaacattatagctagagtaatgaggagtatgtgtgtgcatgtgtgtgaatgtgtgtgcatgtgaatattgcagcattccttccaattctctctcagaagttgctgagtttgctgggcatggtaattcatgcctgtaatcccagtgctttgggaggctgagagaggagtattgcttgaagccaagagttccagactagcctgggcaacaaagggaggagactctgtctctacagaaaatgtaaaaaaattagcctggcatggtggcgcatgcctgtagtctcagcttctggggaggctgaggtgggaggatcacttgagcccagcagtttgggggtgcagtgagccataactgcagcactacactcctgctgggcaatagagaacccaattaaagaaaatgctgaagtcattcttcttatcctttcctttccttttcgctttccttttccttttcccctttcacctttctttctcctttctcctttcctttccttcctcctttccaaattaataggtaaagccaagctattaaatagttccaggaaacctttagcaataacttgggggtaaacttacttaactaagtaatcaaaaccctcatcaaaaccttctttcttacattcttccatatattttaacattactcaattgtcaacttatgcttaacagagctactatgacttccctgtaacatctatattttgtttcttattttatgtagttaacagctattatttttactattattatatggtaattgctgtgctatacattttacacataaatttcatctaatttatttctcataacactatgtggtgtaggtattatcattacaggaaagaaaactaagtctcaaagagcttagcctatttagactttataaatggcacagccaaaattcaaactcaggtctgtctatggctactaatattttatatactcagtgtgtctgcatttatcactgtggatcaatttgttattgcttctgattttattcctgtgttaagtgtaaaaacacttagcactttaggtgtattttctttttttgtttgtttatttttgtttttgtttttgtttgagacagagtcttgctctgtcgcccaggctggagcacagtggcgcggtctcagctcactgcaagctctgcctcccagattcacgccattctcctgcctcagcctcccaagtagctgggactacacgcacctgccaccacgcccggctaattttttgaatttttggtagagaaggggtttcaccgtgttagccaggatggtctcgatctcctgatctcatgatccgcccgcctcggcctcccaaagtgctgggattacaggtgtgagccactgcacccgggctttaggtatattttctaagcagttgcccagttctagcccttccagccacattcctcttcacctgctgccaactctctgtcctttgctgtgggagttaacattcccacagaatcttagaaaagcagtgaagagtggtaaaaagaatatcgaattatgcattaggttctagtctaggtcctgtccttaactttttgagtgacagtttgcagttcattatcctctgctaacattcctttatcagaaaccatgataatgacacataaattatttatatcccaggggttactgtgggcatcagatcaggtagggcattcagtatgaaagtatctgaggaggatgaggactttgtaaaaacagtgattatctgattgttttctctacatcttccacacagaaggtactgaatcagcagctgtcccaacaattatacagttttgcaatatgcactgcacacagtgtctcaatcagctgtggcagtgaccatcaaggacattatctccccgggagtagttgtatttgaggacttccctttcatgaaaagaggccttgtgaattcaggtggcaaaaatggtcctttgcattgtagggcatgttgtttcaggccattaactgtggtgctgcatgtggagcttgtttctgtttttctgtgagacattctatctttaatggatcagtgctctctggctcctatggttggagtgaattacatttctctctctttcaaaattttattatgatattttatgttttaggtgtcataaaatcaatcatctaagactattctttggtaataaatagctgacagcaaggcttattatgttggtaaaaactcctttgattaggtttcattgtttctttctaaaattgttaagtcaattttcccccacttccttccctgctctggaattgcacagtgtactccggatgaaatccaaaggagactttccactgcagaggtgcatgctgggtcctaggtgcacccacccctccaccagggtgcccgcacagcatctatataaacctgagtcattctgtgtaatggggcagtgtacaattttcctgatttagaattgggtctctttgctttgggtgatcatctttatattgctgtcatgaggctatttctgtctcaattttcttttgttgggaaaaagatcagattctttttggtgaaaatgcaatagctaaggtgaaagattagataacttcccctctgagcccattagagggaagtgtgtcaagtctagcattaggaaatacgaaagacaaggcatccatcatggtggggaggctgtgtgggtaggtgtgcctggtaagtcatgctgctgggagtattcctgagtgtcttaggaaggaagcaggaaagttaatcatttcttctctcgaaagcactctccctttctctctctctctctttttgtttagtataaaaagcccaatttttttccctccaaaaataaagtaagaagagcagatgatacgtgccctcctcctaccataggaacctaaatttatccagctaaagcactgctcctgtcttagtggtcactgagaaaagttttatgctgatagaatttagaaatactttgaaaaacttgctagatgctgaagtatccatcattaacatttccctttcttgtttggggatatttccatttatgatatggtttactatttagttagtttgctactactactaataaaagctaatttatgttatcaaagctttcctgtggtagactatgttaagtgctttagatgcattgtctcatttttatcagtacagcaatgtcatgagtattgaacattattcctttcattttgcagatgtaaaaagctgagtacacagagattcaatgacttgcctctaattacacagtaggtggccaaattgagatttgaacacaggcattgggatttctcaagtttactcaataaaacaaaatattttagtgtgctcttagatgtgacaacgtcagtatttttctttctcctatttttttttaatgtaattaatggcctctggctatactggcatctttaatacaccatttttaacctggaaatgtaaagtattctggtctttgctattatattgccagtgtcaggcttcttataacattttgtttatgagtaaggagtaactcatgatgagagtgatctaatcgacaagttactgtgttgagatgagagctgaaggctaaagccaaatgtagcatttgctgccccttggagcatatgtgccaacaatgaaagcatattggctcctcatggaggcagcatgtcctctagattggaattcagaatatgcttgctggcttacctctgatatcatctgagcaaatgtaattaatgaggtaccaagagaacgccacaggaagccaatttcattatcaaaacaggtatttgacacaaattacaagacaacgtgactttatccttcctggatttcatgttttcataagaggtaaacttaccttatatttttctaaacctgtgctacattcctcccttcaaggtggttaaatatttcagagcatggatgtgcatcttgttatcttcttccaaagctcaacaggacatgtgccatactgttaaaaggctattatattttagcatcttccaataaaaaattgtgatgtgaaaccgattattaatgctctaaggctggatacatacaggctgcctaaaaacttatgctgtactcactactgaacagagttttctgttgcttattgtaggaggtttctgtatcagcagccatctattttttacagacttcaagtaaatgcttaatctcacttagcaaactcacttatatgctaagtaattattataagtggccaatcatatgttagttaaaacattttaacagaacccactctgtctaatacctaaagagactgtgctgattttttactcagatcaaatgcataatgccttatgagcgacctcactacaaggcagaataatgcctccattggcacataaccagtgctagtagcagtgggtcctccacctgtcattggatgtgtgataattatttgttaaacccttagtatgtggtatgttccagacactctgccaagcattgtgtatgaatcctctttttccaatctcataattaaccgtattctccccattttacagactaggaaactgagcatcaaaactactaagtaaatttcccaagaccaggaaagggctgcgtctcaaattagttctatataattccaaagtccttgccataactaatattcatttctggtggcatgtcacagttcttttaaaatgttgttaagagcttttctaaagtgtagcaaccattatattgttaaaaaaaaaaaaaagttcaaacctcagaaaagggtcaaaatagttcaattaaatacaaattgctatattctaaaaaacaaaacaaaaaacatatgtacacacacacacacacacacacacatatgaaataccttttgcttgtgattttgttttctgctgaactcctagtagaaactaattttgttgaataaaaactggttgctgggaaagttgatgtcaagttgaccaaacaaagataggcttcttcctgcctctgggcccctggccttccatttcttagggcatttgtaatttcaaatactttatctgtccctttgatgtgtaaatatggaggacttgggagccatctcttcgtaatataaacatcagagaagatagcgcccctatctcctaatttctgtggaaagggtgggagcctaactttagtgggctccatgctccaaactgtaaaactatccccctgtcatgaaaacatgagatagtttgtttacatttcctttgggtgaagcccatttgcaagcacagttggtcccaaatccatccatcccagcacttaaataccctccagccttttttgtttgtttgttttcagtgagttgccctcgggctgaaatctggcccacctctcctattgcaatagccttgactaaatcttccttgcctgtttaactttgttcaatataatttttattctgacattactgccttcagaaaagcaggggaaaagtgagtaaaaatgatgtgtgataaatctcttctactttaaccatgtactacttatttttattccagtgttctggacaattaaatttatatggaaaaaacatttcctacaccagcacgttgcacactgaaacccagctagcacatcagtttccaactccagctgccccatcccgcacctgaatgatgagctgggccctcagcgctgattctagcctggtacacaggagatgctctcgatgttccctcaaatggaacactcattgctactgtttttctggctgcagctcaaaatcctccattttgacagcaatgtgttggctattacggactaattaaagtcacttttgaataattacataataaataacacacatttaaatgtagaacaaaattattttctaatcaagctctaaaaatatgacccagcaagacagtccttgaaatgattgtgatgacttatttaatgaaaaggtgcaccttgttcaatatacatatctttattcctaatgtgtttaatggtatcaattgaatagaaatcccttgaccttttctcaaaatagcacactgaaaaaccactgaaaattgcatggtaattgcaacaaatttagcttaatagtaatacatgtaaagaatatgacatgaaattatttaaatgaacttttgaaaaatcgattctatatttgtgaggtgcctgaattttagaggaaaaaccttctgtgttccaagaaactataagcccaccttttctaaactagagaatacaccagctctctcatattacatgacataacttaatctctctgaatctctttagctatgaaaatgcttcatagtttcataaaataatgagatagaataatgtttgtaaaggactaagaacaatgatggagcgcagaataaatcttcaccaaatactagttattattgctatttatcattgcttatgtaatctgaaccttgatcaacatgattcctctgataggcaatcaacagttgtcttttgagtggttgtactgatgacctcacctcctgtgttccagctaaagagatgccacaaaaatgggtgatccttttcttcccccaatgactaatgagatattttattattcaatggaactcttcttttcctagttttacaaaagtttaattgatttgagagtggcctaatatcccattagctatccatcccctaaccactcacagagaattgacgtattattcttagcactgtaaatctaacaggaaattgtccttcctaaacagggctccagaaaacaggaggcaggtctggttccctttgtaacaaatgataaattagagttatttattagggagctactacagcaaagagggtctttatcttcatttaggatcttgaatatcaacataaaactcacctttttaaaacttcttcaggagttttcagaaagggttctatttggaagagggcccccaaactaagagatactgacatgattaaagaccttcttggaacttaagtggttttgcagtgttgccattttgtcaatttactaagtggatctaaaatgtaaaatttcaaagacattttataaaaacttatatttgtgtgaaaaacaaagtcttggaaaatatgtgcgtgtgtgtataaaaataacaaatactaataacaggaaacactcatatagcacttattttgagcaaaacattttttctataacatacttttcatatattaactccagcaatcacatagcaataactatgctggagcaataactccagcaatcacaatttttttctctaggctgagaaaaatcacggaagctgtaaacgttttttgagaaaaattatgaaaaaaatgttatctatctctcatgtgtctacgcttcttaaactgggcactttaggacaacactggcctgtaacattgttaccaatagctggttcaggtttctacctgttcactaagagctggggttcaattagccctcctccatcacatagccaacattttgtattctgaagccatccttttgtattctgaaactgatcatatcaatgtgaagttatcatccaatgctaactgtgcaggacagtgtggctaaaatcaagtataattgagttccatgtgttcccacccaggatgttgaccctgatctagttttaacatgcacagttcccatcaggaggcctgagtggtttcatcagttgcccaccaattttcagccaggaaaagtaacagcattatgtaaaagggaaaatagcttggaatattctttttgtataactgaattgggggaaaaagccaccatttatgttctacattatgccagacattgcaataaatgtcttcaatatattaattaatatagaactgaaggtataaactttctatttttgctcccagagcttagcagagcagtaggtatatagtgacactcaatacctgatcaatgttgaagctgataacccaccaaatatataacttccctgttcattaagagttctgaatggaaccacaggtaattccaatttatcaaacatttgataaaaggaataatttactagtactcaagatgatgctagatttttcctgtttcttccattaacagctttaggaaggtacctaaataaggaacataggacattttcagagaaaaagccattttttgaaggtgggggagggtcagagtgattagaaaactcatgagtaaatacttagggagagtgaggtactcagaagatttgggcaacgcatctataaaggtaatggtgcatctccttacaaagatttgctctcacttgcccaaggactagcaaatgtgcatagaagatacatctgtttcagaatatttacctcaatatgttagttttataaaaagccagtatcccaaaatatagcctaatatgtgaaataatttttatttaagtatttctaacatctaatagcagcagctagaattatccaatgtctaataacagcagcagctacaattattgttatattattttatgtttgcattcaagatggattgcaagcaggaaaaagaaatttaagaaaaccagtacattaggaaacaatgacctgcaggaggggcagcccatgatgaaacattattcagacttaaacaggattcaaaacaaaaacaaacagaaaaacacaacccatattccaagaaaaaagttggaaaataggaaaacatcatataaactaagaatttcattagaagctatcacataaataaaaccaatttctgcccaaagagccaccttcatatgaagcattaaagacaggcttgagaaaaaaagtaatagggaggtggacagaaaaagctaatgtagaaagagatttaacatcagaaatcgaaagtgaaacaatttatggcatatattatcaagaccgggggagataagatcagaggacaggtttacagtgaatgatcccattaacacaaaataatctgaagttcttgttttaacaggaattgatgaattgaaaactgaagagtgaggagggacaaactgaaagagaggagaaaaagttaaactaggcttggtacaagagtgttaaagtagctgtcgttagatagaatcagtagctggtgtgttttgtattttgggtaacagactttggtgcagtagaacagaactaaaattgacagaacaagtccatgcaggcagcaagaaaaacagggttcctgcttcatggaatttaccttgtggggagattcaagctatacattaatgaatgaaaaacaaatacgtaaacatgattgtttcagatagtgatagtgtggtaaagaaaacaaaggtagaaagattccctggagtatggcaattaataagctgctactcacttttcattgtgctatgatatttaacaaagcagacaaaaatcgggtgaacaagcagaagacgatggcaaaagggttaccccatccgccttttctctcctctcctctaccttcttcctccaccatcttgttcttaggtctagtgtcaccagagcaaaagacagacagtaaactagtccataaggaatggttaatcagacctataagcaatggctcgaagaactggatcattcagctgagctcacgaagaaaaagtgacaattttaagtgcaattagttactgtgattcactaggtactcaaggtaaggattctgcaacaagagtatgatagcctatacttagacagtaaaagagggattcagcaagtcctgtaattagtaagaacttcaacagttttcatcgctgtattaatactgtgtaaaatactgaaaaatggattaccctgaagaaaacactaattgagaaaacaaaatcaactataaataacacacaccccaatatacaaagaccagactttgttacatggataactcatgctagaggatgtcagagaagatgagatagaaaaaagaatgtcctggtgcaaaagattaacaccaggaaggttgggcatgtgagcgtagaagaaatggggaagggaaatttgagggtgggaaaatgcagagatgggactgatataatgacagaaaagcaatagcaatgactttttttgttgttgttgttgctaactaacagattaagcataccaatgaaaaccaaggcaagatcttagtaaaggggcctaggatagtgccatgatgtgactttatctgtcacgacaaccaagagggaatgattgcagaggccaatgagctgggagaatggaatggatgatcgtgacagagctgatcattgtgaatgatagatgtttctgggagctgagagtcctgactggcactgtggagccaagaggaaagaggaccagagcatacccagcctggtctcccacgccctgtcctgttgcgaggtgactgccgagctcttccccctccctggcactcagcagctgctctctaagcgctacagtcagtggttacaatcagtgggggaagtgatattcaaatattcaaaacgagatgcacgacatacatcccgatttgctctaaagagcggatttactctaaaatggtattcttcacaagaatgcaaattcattactttcttgtgacatgaaattctcctgggattctaggtgatgtcaatagacaccactagcagatagtggttagtccatatccacctcactcattttgttaatgcaaacaatattattattattattattattattttattattattttgagacaaaatcccactctgtcacccaggctgaagtgcagtggcgtgatcttggctgactgcaacctctgcctccaagattcaagtgattctcctgcctcagcctcctgagtagctgggattacaggtgcacagcaccacacctggctgatttttctatttttggcagggacagggttttggcatgttggccagggtggtctcaaactcctgaccgcaagtgatctgcctgactcaggttcccaaagtgctggaattacaggcgtgagccactatgaccagcaaagaacattattgaatttaaatactgctttaccaaaaaccaaaccaaaccaaaacaaaactaatggaaatgagcctaacacttgaagttatgaatatttggaatcaaatctaggctatgaattcattcatttttcaggggtctacagccaccacttaatggtataagggctgtatggtaacagtatttacgttagtcacatcagaagatgcaaacatatcataaagaagtaaaatgtttcagcttgaattttagggaaacatggcaagactcaaatatttctctattaaagatatcaacgagtctacctgctgtttgttttactactgctataatactctcacttccgaaattcagaaatatatcacttaaggtaatttgctggcagagtgagtggtggggactttttgtcagtagaaaggtcaaataattttgcacaatgtgctgcaaatttttagctttataattttactataagtgacccaagggaaagctcattatattgttacacacaaaaattatgttgtgagctaatggaaagtgaacagtaaggtagaagccctgtgtgctatacccactgctttttctgaaatacataatcttggcatgttttgtttttaattttttcaataaatgtggaaaaatttatgtaaaaaataagagtcctcatctcacaatcaacgatggtataggagggtagccttctatacatgaatataaggcccttctaaggaatataacatgcaacaaagatttacagtaaagccaaggaagtaagaaaaaaagttgactaacctaacccacctgagctcggctcacaggggtcaatgtcctcatcatcgctgggacactctgctgaggccacaaggatgtcatctgtggtctgcaaaagaatcacattcagtagattaatttaaagggtcctaacagattctctcatctttgtctcattgacaagtgaaatacaatttgtttatcaagaaaccaaattcactatttccctttctaaagacacagagcttacattttagatccttcatagaagtaactgcctatttgtgaaaacttgattacactttagtttacatgaggacgcagaaatggtgacagccaacttgtagatacccatccactcaaatgcagatagaagctgcacacagtatcatacagaggtttaaaacaacctggcagaaacagatgatttgaaatttattacagcctggagtgctacaatgtatgcatcagtgggctttatgtagtacttgtgcttggcttcctaaaagcagaaaagccataaccttttacactcacgactatgtagagtttgatgaatctttgagatatagcttgttattggaggaaacacagattaagtagagaattagatagctctttcattggtgcaaaaaggcaaggaaatacaatccatttaagacactttcattttcattatgatttcacacttgaagctcatttttgtaatgttcagatagcaggtattgcttcctcatcatccctttcatcattatggtttcataataaatgaaaagtgtattcaaagtgggggaggggaagaggtggcagttttctctgtgacattctagttgcttcattgcgcttacagcaaaaaagatacctatctctgtaataaaaagcagagtccataaatcctagcagttagtcacataatcaacacactgataagcacgaaaagttgttctttattgccactgacaagctgcagtaaattcagcatagatattgcatggaatctgtaaaggcttccatcagagttggctctgctaaggtaaaacagagaatccaatgtatacaaataaataaaaatatctcattacatctactaaggactaaagagattagaattgttcaaacaattctcagaattgcaacattgatacagttctcatttaaaagtggaattaaaataacataggtcttacttcaaagaaaaagcaaaaatacgatatgagcacctaatattaaaggagcacctaatattgtcacagattaaagtataactaaatttttaagaaagttgtggcattttgaaaaatggagacgaggggtgatgaacttttatagaaagtattaggcttaaaaatctttcaagtgcagagtctttaagaacaaagaatttgttcagatgcgaatgctttacaatataactttaaataaacacaaacctttaaatagcattggagatggtttcatgttactctgctcttacttcttctgagacaattgggagagtttctggattcatgcattttgctgctgctattttagaaagggaaggtgaaaatattggtttgcctggaagtgtaagtctttttttttaactgttgaatttattgacaaagttattcataatattctcactttttattcttcaatgtttgtggcatttgtagtgctaactcccctttcattcctggtatttgataatttgtgggggttttctctttttttttttttattatacttttagttccaggatacatgtgcagcatatgcaggttacatatgtatacacgtgccatggtggtttgctgcacccatcaacctgtcatctacattaggtatttctcctaatgctatacctcccctagacccccaccctccaacaggcccaagtgtgtgatgttcccctgcctgtgtccatgtgttctcattgttcaactcccacttatgagtgagaatatgcagtgtttgattttcagttcctctgatagtttgctgagaatggtggtttccagcttcatccatgtccctacaagggacatgaactcatccttttttatggctgcatagtattccatggtgtatatgtgccacattttctatatccagtctatcattgatgagcatttgggttggttccaagtctttgctattgtgaatagtgtggcaagaaatatacatgtacatgtgtctttatagtaaaatgatttataatcctttgggtatatacccagtaatgggattgctgggtcaaatggtatttctggttctagatccttgaggaatcaccacactgtcttccacaatggttgaactaatttacactcccaccaacagtgtaaaagcattcctattctccacatcctccagcatctgttgcttcctgactttttaatgattgccattctaactggcatgagatggtatctcattgtggttttgatttgcattgctctgatgaccagtgatgatgagctttttttcatatgtgtgttggccgtataaatgtcttcttttgaaaagtgtatgttcatatacttcacccactttttgatggggttgttttgtttttttcttgtaaatttgtttaagttccttgtagactctggatattagacctttgtcagacagatagattgcaaaaatttcctcccattctgtaggttgcctgtccattctgatgatagtttcttttgctgggcagaagctctttaattagatcccatttgtcaattttggcttttgttgccactgctttttgtgttttagtcatcaagtctttgcccatgcctgtgtcctaaatggtattgcctaggttttcttctagggttttttatggttttaggtcttacgtttaagtctttaatccatcttgagttaatttttgtataaggtgtaaggaaggggtccggtttcagtttcctgcatatgtctagccagttttcccaacaccatttattaaatagggaatcctttcctcattccttgtttttgtcaggtttgtcaaagatcagctggtcttcaaagaactagaaaaaactactttatatttcatatggaaccaaaaaagagcccatatagccaagccaatcctaagcaaaaagaacaaggctggaggcatcatgctacctgacttaaaactatgctacaaggctacagtaaccaaaacagcctggtaccagtaccaaaacagatatatagaccaatggaatagaacagaggcctcaatgtaactcttaatgtcagtgaagatcgttagcaattggcacgataatcatgtaggtatctttttaaaaagaaagctttaaaagcaaagacccattctccttttggcacaactacatcttgctgggtaatatacaaacagacttgataatgacgtgttattgaattatgtagtcttgccggtcagttgctccaattccctccagaggagataatcagctttttgtttttttccccccggaccaacatctagcggaaagctacttttattctcaatttcaaattaatttcaaggttacagataatttctcattttctttgaggaatgttaaatatattgatgaaatcaatatagtgttgttcctattggtgttttattcttgttagagggaggaggatataaataaattctttaaaccaatggctctcacatcagcagtgatattgccaccttttccttcctccacctggaggcacgtttggtaatatgtggaaatatttgaggtcacaattggaattctgaggtctgctactatcattgtctctttttgactgctaaacattcttttctttcctcttcctctcttctccttctccttttttctttcttttttttttctttttttttttttttttgtagagataaggttccagctcagtctcactgtgttacccaggctgatctagaactcttggcctcaagcaatactcctacctgagcctcccgaagtgctgggattacaggaatgagctaccacacaatgcctaaatattataaaatacacatgacagcttgaagacaacaaagaatgatctaacctgaaatgttaataatgccaaagttgagaacccctgctcaaaacatttaaaaacagttctgtcttattgttctcctaaaaatatggacagcataatagtatctattgttacaaggatgaaattagtacatgaaaagtacctagaaggggacaacactgtaaatgtttattaaaactttcaatattattatcaacttttttcaatatttcatgaatgtaataccaatttaatttttgcactataattacaaataatataattatagatattaaaccgaaacttgtacatatgaattattcttgaggtctcatgttaaaatttgtatcaaaatacagtagctacattggtattttgttgaactaagtaccatcttttactgtccaactttgaccttttaaaaggcaaacatcaaatataaacttaaaaaactgcttcttaaaaaaattcatgggctacaactgtgtgactcagtgggtagtgtttcatgcagactaaattatttacgcaatacaagttaagctttgttttaaaagctgacctattttcttttggaacaattctacactaaccagaacgtgtgagaatgttctcagtgttaccttctgcaaaacacaattcctaaaataacaaaagatgtcatacaatggtacttcctatagccctcttacagtagaaaaaaataactacaaatgcgacccttttgtaaaactatattttactttttaatgtaatttccctggtataatgaaatacgttcttgattttcatatatgtttttcctccagaaattaaaaaccagcaacaatcttgagaataaaagacctcaaatcaatagatggcttggcaaaaatcatcatcgcagtatgaaaaatcaggaagtggctcaagtgtaggggaagaaaatcaaatttcactttagaagctgaattaactgcacaattttctagccaaagctgtgtaatttaaatttaattcactgtgtttggagctgctgctatgacttgctgttgagagagtggtagaaagaaactcaaatatgtcacattaatcaattctattctttagtatacttttccctgatgtttataacctttttgagaaaagagacaacctgctgaaaaagacagaagcgtgatcaagcagaagcattagctttacataacagtccatttagatgagtgtctctaactgtgcatttaaccacccacaggtgaaattgctatgctgatcttccttaattcagactggtctgtacatgcacatcgtaagcatctcttcttgttgaaaatgtgcactaaaatctaagtctctatacttttaggaagaaaatgatttgaacagaattcaagaaataaaggctgtaaaacttaatccatccttttctatatttgaacaccaatattttgtagggtttgagaaatatgtcaggacgggggcaaaagaatgttcttaatgaatggtaagaaggtagaccaagtgatttaatacccagggatattaaaaagagggagcatttggttggggggaatttagagaaacacagatgtatgtttgttattttttctcacttataggaagccttttatttttcaacatcattaatggtggaattttctgtatatgcatttgctgtcactttaaaaaatatagcttaactgcatatctgtgtggtaaaaatatacaaggaaagcacgaataaacccagtatgtaatattatatccctgctaagaataacattccaagactttattccttatgataaacagctttcctgaagactaatatattccaatgaagacgcttacagaaaactatactattaagacaaatctgttttgtaaggaaaagagcaatttccaattgtaaaataggatattcattgtcagtatatgatacccacaaataaacccgatttattctaaaattttaattgaaagtttatttctaaacagcaacagtgtatcctgctatacctctaaatacgaagccaaaagaattgtctcagacaatgacatgagcattgtataacattatttagcctaatatttaactgttgtgactgatatttagactgaattgatagcaacagttagtgggtcgaggacagtgctggctgaaatatgatatctttggttaactgatgggcacttgttcttgctgatacttttctgtatgcaaagctgctttggaagagagagcgctctcaagtgtggttttcatgaatgaatctaatagtttctccagaaaatatttatcactaggtgaggttccttgaaaaaaaaaaattttaacaggattcaggattagtatcacaaattcccaagtaaggtccaacccagtgtcctgataacctatggagcaagaagtttctaggaggtaagggaagtcataattctcaccagaaggaaaaactgcagaaaataatccacttgtaatgtgtatataggtatatgattcccaaattgcggtctatttgattaaagcaaatcagtaaagaaatagatcaaattggcaatttcagttaatgaacaatcctattaaggtgcaagaggaatttagaggctgtctagatcttattcttgtttccactgtctcaatgaagttgcctcaattgacataaagatgtcaatttcatggctcactatttaataaacataaaaataataagctgagatccagtatgtggaggatgaattttacctccagcacatgaataagaaagacagtgaggcccaattactcaacaatgaatacaaagcacctcatctatgcgtagcattttctgataggcataaaatattctcagtacacatgaaggtataaattgtggttccgatatgcaaataatttactgttctctctctgttctgaggcaaatgaacaaataactctttaatacaaataacaatgaagtaaattcaaatagcttatttttctcggaatgtaacaatgttcccatatccattacttcatttacaattcaccaatagcatccttatctggaatgcagatggaggtactgttattcagagtgttatagttaagtgtctgctaaaaaaaatactcatctgtacactcatctacccaatttgaatgtgtgaacactggctttcatgaatatgtagggcaaagctcaaataccccttaaaacagccactttcacatttctttaatgttctttcccaattgatgccctaggctattacaaaaagtgaccataaatcagctgtctgcttgggaaaaaggcagacttgaaagccattcaattttcttcgaatttttttcagctgtttaaaaagtatgcaatggttccagaaccactaaagtgggtttgagtagaagaactctgccgtggtaaagaaatcacatcttactcagtctaacgttcatttttatgtacatttgatactggttctcctaacaggcaaaactcaaaggaaaatataggaatatggaaataatgtcacagaaatgcactttaattaagttatggggaaaagaataaaactgaatttttgagtaatcaaaaaataacatattttagcaaacttattcaaaatagaaaacctacaaataaggaacctgctgtcagggaacttgaaattaaatttatgtttaaaaaatatgttttttattatttctttatgctactgatgacctctatgctcatattgcatttccatttttagccaaggcaatgtagaaggactggcaaaataaattaatatgaaatttaaactttcaggaagccatggaacaacctatttttctgaattctcactaattagaatttgagaatgtcagacctccaaagactgctggtaatggagtagaggtactgaatgagtgatcaactgtgtttcccgtctctttgtttcgcttttggacaaagcactttctgaaataattttggccatttccaaattaaataaatattgaaagatgtttacaaatgtaaatttaggcttctagctgtatcagtatgaatatctagtcctattatggattagtcacacaggttgaaatgaaaagtagggttctaagctgtatcaacatgagtatctagtcctattaatggattggtggactaattaatagattaattagtcacacacattgaaatcaaaatccctttcggtaaaaggccaaaataaaaccagactttatgattgcaaaatgcctatgatggataatttcaactagcatgactccaaatccaagctttcattgttgccatgttagggaatgaaaacatgttttagttaagcagtcatatatcttcttgtactgagtcagatcttagagatcattaatctaagctcttcattttacatattgggaaactgaagctagaaaattttaattggccacagttataatgctagttaatggcaaatctatgagattatccgactcccagtagattatgtttttctattatcccagatgacttctacctatccattcatctatccatccatcccaaaccatcttgttctctaatgaattttatgtgatttacgaagatacatgataagataaacttaaaataagtgaaaaggttgcaaaggtagagtactggattttagataagtaaccactaaaattgtcctgaagaaatacacacagacaggaggtgcatattcacagcttctgcaccatttgatatggcagcacatcatgtaacactaaaaggggagcacaattaatgctagagttcaacttttaaaaatccaattacagaaattcaaatattgacataattacagttattttgaaatggagttaacccagagagttctttatttacttgtgaaaatcttttctgaaattattgttttaaagaccttacataccatgccctcagtctctgtacctaaatgcataactaattttttggtgacaaaaagaaaatgcaaattattgaatctctttctgtctttttatctctttgacttagaacactgcaggctatgctggctacaaaattaaatcaatgaactccctgctctcttctcattaagccactgattaaaatccttccaacttccaaggtctctctcttactaactactgtcttcacaatgtaagtgccaatgagatattcatctttgtttctctcacacaactatcattagagttctgtcagattatttcttattacatcttgggaataaatacatggaagtgatcatttattagccatattggtagtttctccagaaacaatttaaacatgtattgatcaactcagtcttattgacacaatgaccttcgaagtgaaggttcaagatcaaagatgtagaaggagccacatttacctttggacaagcagccagttataaaaaacatttctctgctactgggtagtactatgaccaatgtcacctgataaactttaacttggggatagatgagaacttccattccacacgatgcttggagtatagaacagcaagaaatatggatgtggctggaaataatcacttagttaacagaaggtgtattttctgattttgagttgattcatgagttgaatatatgcaagactcaggactgcatgcccccaaataagccagtatctgagtagcatctctatgcttgtatctatccagtggtgattgagaataaacattatctggctcagatgtcacaatgttatcttgttcatgtgctaagaggatccagtgtcttctagttctagttaaactggaactccaagcttctacacttgactacttcattccttctggtgcacattggttctttaatacatatttacgatgttgtactgctgaaacacctcagtttaatttatactatgctgaccaataatgcaaaataaatactactccagaattcaagtctcacttttagttttcatgagcagtacacatcatcttggactggtttctgtgttctaaacatgacatatgaatatatacatattatacatttaaatacatatatttatatatgtaattaattgtgtctcacaggatgttaagggagtcaaatttcatatgtgtgaagacattttggaaagtgtaaaagtgcccacgatgcagtgtttgtataaattattattatagaaaacacatggacaccgggagggcaacatcacacaccacagcctgtcagggtgtgggggacaaggggagggagagccttaggacaaatacctacttcacgcggggtttaaaacctagatgacaggttgatgggtgcagcaaaccaccaaggcacatgtatacctatgtaacaagcctgcatattctgcatatgtatcccagaacttaagaaaaaataaaaaaattattattataactaataatttttgttcctcacatgatgctacaaaggagagctccggatagtgcttgaagaggacaacccaatgtccatttacctgaatacattttattttaatgtcctgaaatcctcttgtccctcagttgaataggatctgtatctctcacttacactagcccctcacacagatgctgttcttgggctgcttcctattatgccagcattgaattcattttggcattccttatttagggcatatgtgtggatctcactggtaacttacaaggtaggtagcaccaatctatgtctggcattatgattacctttcctccgaccagatctcctggagagcttagtgcacagactcagggatacttgagctctctctaaattctaagttctactcattagattgtgagaacctgatttattttatcactgcatccagaatttaccactctgttaaaactacagcatataaatgaacagatgaacagggaaaaacagaccacttagcaaacaatgctaattaaaggagagaaagagagagaaaaagggagagggagagagaaagactgaatctctaagtgtaattcatgcatgacaatgctccttacaataggagtggttgtatttgtagttataatatgactttacctatggtttgtcttctatacggattaataatatgcttatcaactcctgttaagacaatgagctatcttttcttagtgcattagaatagtgggagtacttgccttttgaaatcatcttgaaatctaaaagtatgaagactgcttagtgatatgttttattttatttcatatgctgcttttgggtacagtttatgttttatgcccccagggcatctatacaggaattcagtagagctgacttaaaatgacataatcactcaaaaacctggcttatattcttaaagcatttgcgtgaataaaaggattttttgaaaataattatgacttgaaaaataattgttatgaaaatacagcttagttaaaagtgagggattcatcttgactttaaaaatagaagaaatattatacatgacacttgaatttactagaatcatcacattttaaataatcttactcttgatggtcatccactctaagctcactacatttttggttatgaaaaaggcatgattgtcacaattgctcatttataccagctaattaaatctcaatataaaattgaacaagtatagattattttctaggaatacacctaagagtgggagatgagaattgtggcaaaataacactttttcaaagattttatctgccttataacatctctagaagtaacaatgaaactttctaactggcttccacattataccccatggctggaaatgtatggtagagaaatagcaaaaagtgacattatctttaactgaaagagagaatgactgaaggttagaaggaaggcaaagctaaaaatgtcttgcaataagttggtcttcctgcttttatgaagcattcctgtcctttgagaaagcagtaagataaagcctactctgtggaagggactgagaaaaacatagttaactatcattttgggttttttttttacctacataatattcctcaactatctctatctcttacaaactctcttgcaatagtctattgcattataaatgcttttacttagttgcaaaaaagaaaaaaaaactattcctttgtaatgttttccttcaaaatctaactacaggatgaaagctttatctttttcctgaaagaggccagccataagattcacaccaagaaatagtgtaagacagaatgcactaatcaaatctatatctactgattctgccattcattcattcatccatttgtactcatttgttgaatattttcatttaataaagagttatacaggcaaggaataaaaatacaattttctgactcagaacatttagaatactgtggtggcgcatgcaatccagtttcttttgggtttggagaaggcatctatcattttatgcattaatcttttacccatgtattaagtgttcacactgtatattcaaggttgcatccccagggcctgccacagtacctagcatgtaagagacaaatatctggccaatcagtcagaaatgattccagccagtataatcagaaaaatagaagtaatttgataggaaaaataagtccaacactaccccatcatgctagacaaaacaaaagtaccttagagttttacaaaaacgtttccaaatgcaagggattgacagaaccaaagatgttctatgttctctgatacttcagctatcagctgattagaaaaggtatcaatttgaaaagcaacgagaagcattgtcatgttaacttttttggaaaatgtgactgctaccaccattcactgtaaggcaatttgtgctccttcatttttacaactaataaatggtgccagtgtttatttttctccttttccctttgatttcatttttttcatctcttcctatttcattcatggtgtcccaactcccagaggagctacctcaggaaaaaagatctcacatagcaagaaaagtccaaggagcaaatgctgtttgactctaaccaacataccgtagcaccttaggtccatgtataaatttagggaagagaattacatgctctcttccagttattattatatgattccataagtcaaagaaatctggaaatgtttctatgagtagaaatttgtgataaaggagatagtcttttttactctgctaaaatattttttggtacaaggaaggtgccctgtatataactgttgatttaatttgagatatcatgagccctgacacttgacttttagttctccaatttaagttactaagctgcctacattcgatcaggataatttgccatataatcatgaatgggtaggggaaattggcagcttttaacggttctcaaaggtaattcctaagagaggtgagttggaactgatgaaattgagatagatgctaagtgaccaggcatccctgctttgaattgtgaaattgaacttcaatgtgtaacaaatgcaggccttctatgagcagcaagttgctttttccactactgagcatggaaggagcatgaatgttggagctgaacagactggtcttaaatcccagctctgccacttactagctgtgtaaccctgggcaagttccccaacttctctggatttctttcgatgtaaaagtgaagttatttacacctattttgcatgagtattacatgtattaaattatctagacctagataggcatactatctagcacagtagctggtatatggaagatattatcatgaatatttattacatagatacaaccagctttcaaaatgaatggctcttgtagacattttcacattattctcaccgcaatatggaaattaaactttattcctagcactggactccctaatctttagagacaaacacacccttcacagagaaagtacaagtttctcacctaaattcacacatccatgtttaaatattctataaacagagaagattatatgtttgataggacagcgcttgtaaaagcacctcaaaaaatcacattatcagtatattgaaaatacaaggagcatctcttctctctagctacacgatgtaatcaagcatttgtcaaatcatatttggaggctctttgaattatgtgctccagttcccttttaggtaaagagaaggaaaccctaaattggcatggtcaggtgtgggtcagatgtacagtaccaaattactgcactgcactgttcaggagggacttaggagtatatcccagtttcctggctctccatccagttggcgtcttgctccttctactcctcctagtttcatgtttgggtatggggcagataaaaataacagcgggaataatttactacttttcccaagtttcttatacataacttgactttttaaattcttccctatgtcttactgaaattttaagtaaggcctttgaaaaatactagggaatgatgccgtcactcacagctgccagactggagagcactcagtggctggtgcaaagcccagtaaaatccaaccaaagaacacaagtgcagaaacaggacaagaattttgctaattgtcttctttgagaactaggagcttcattagagaatttgcctttgtgcatgtatttaatgagatgggatatgctgctgaactcttcctgcaggtatttcagtgttttatttagttatgatattgcctaatgacctctttttttggtccactattcagacatttttgggtcatttaaaaagttgttataaataaacatcacttacataacatttagatttctaagtgattaaacatatcctctcttggatagctttcctcttgccagccttgcatttacagtctgtctcactcaattctgacatatttcattgcagttgttatcacgcctctgccatctgggtttgtccttttccttcccgcacacctctgcaatccccgcctgccctcttcccttcgttatcattgcttagatgcctactaattaaggacaagaaagaaacctattcaacataaatataccttttatcatcatgcgaacttacacagatgtagctttttaaacagttcagaagacaaacttttcttgatgatttggtgtcatttttatgagcacgagggctggaaacacagtagtgatctcaaagagtattgctgactattctccataggtacccaagttgctcgtttactttttagtctatgaaagctcaatctagcttttgtcttttgtcagcctttatagacctctttcttccttccaatttgccccttcggatctgctttgagctggaaatccagataatcaaagttctccgtcctgagaaatgagaaattggctataaggtaaaggatatcagagaggttctcaaatgagaaagcccaggtgcatgagagcactcagtcaaggctcatggcttaaaatacacaagacctgttagtttcttccaaatgcaaagttcttcgtgaaggtagtatatttatttctaagcgaatctcagtaatattttcactatgataattttcaaatgggcttttcttattttattgagtccaagcatccttattgaaacaagattccacatttctaaatttctattttccaagatctattcaaacagaagccaagcctccttttgtgttccactgagttggctgggagggagggaaatgaagatgaagtaatataataagaaaggtggctgtcttactgtcattgactgctttgctacctgaaaaactcgaaggtacactggtttatatttttacgtagaacctgatgcagccatgcaggcatccagctgtatctatccagagtgggtgattcacctggtgtaccctgaagagacagagaaatgctcttcacggtagcatctttttggtttcctaggaccagttgtttgcttgacaaattgagaagccctggtacaggttatgggatcttacaatgctgctttccagtgatctgctgcatgggcattggagtcagacttacccaagtttaaatctggactgtactatttagagctggtagaacttgtgtgatttatttaacctctcatttgtaaatgggagggatgcactgccaatctatgcagtagttgtagggattaagaaaatcatgacagatgatatacttaacactgttcctggtgcgtgataaattcaaaataaatattggctattatcaccttcattattattttataagacatacatatgttacctccagcatgctgaaaataacgtttcttaataaagtaggcaaaaccccagtatcctaacattcacaagaggtagacaatccacttttgtccttgcctagcatattgtgaagtggaaggggaaaaagccaaacagtgcatgaagaatgcaaatgtattttttttcctgaatgttctcttttgctttttgacttttaaactctactttatttcaaaacacagtcccaaccattccaaagcatttttgaattggaaagccttctttttttgtttcataataagctaactgcaggtgcaaactcaagggagacagaccttggaaattttaagtatgttgccatggcaatggtttgcaagaatgtgtatgagtttcatcttagctttcaagcattcaactgagttcatacgtggaggttcaaatcactaggcacacaatgtttgccactcattgtgtcctgaaaggtttggaaataactatctgtgttgcttatagcaaccagaaaccacaaaattctatttatttatttatttatgcaaatgtagagatctagtcattcatatctgctcttaggtggcctatctcaccagtgtggctgctctaagagaagctgtacacataatttcaacactaatcattttcaccattgttgcaaacacagttgtactcccaatatggagtagctataaaaatgttccactgaatatcacattaatttcctcattcaaatttgacagatccttccagaagcatgataattatttaaagatgttgcattaaagcaaaatttcagtctaatgaattgtggagtatttccttaaaagtgtctcatcctatagtggaagaaagaaagtgaaagcacacaatccagtcattaaattaacaccaccctccccagaaaaagcaccagcaccggcactgccaacaaaaagacatgcaaaaaacatcattttatcacatattactaccccagtggttcttaaatggttcagctaatgcttctaaattccaaaacctgcacactgaactcatgcttcattgacagaggaggcaatggttcttgacaaaagcattcttttccccataaatggaatccatagcatactataattgggtaagttttaaagctatctattgggtacgggaaataattattaacaaattctcttcaaattacaaggctttttttcatgtaaaatgagtactaaacaaataatatcatttttaattaaataaatgatttatttaattaaaatccagcaagaaaaagctggatttctaggggtgtatgttcttcatgttttctagcgaaaacttgctgcaaatgattcatcatgatacagcagaatgccctacataaaaacatggccacaggagaccccagtatctcctgcattttgttactgactgaacccttcacaaacgcattattagctaccaaaccctggcagctatttaaaattcgcattgttgctttaactttgacccatcttccaaaatgcctgcgcacgcatgcacacacacacacacacacacacacacatcaatctctcaatctcccgtcctccttgttgtaacattttgttgacgtacttcaaaactgcagtagagcttccctgccctgaccctccattctaagaagcttacagcaatgctggaattaaacaaatgagaacacaataattagctatgcaaactgtcaactagatctaaaaagaaaaacaacccagaaaacacaacaatcagcagtttcaagccctaacaagaatctgcattgaattctcatttattttaaacaaaaatagattaggccttttgaaaaatattcagtgaaatttctatggaaataggacaaattagcctataggtctttacatctctaatttctgtgttgctgatacagtagaaaagtccaacactctttccaaataaatgctcttctactctttaatagccagatttacttccaaaggtgagtagcaccaaaaatatttccaaagtggatatgaaacaggttagtggatcaaattatatggtgtgacaccgcagttcccaactctgtccccacaacctcaccctaatcattttatcaatggtaattaaaatataaagggaaactgtaagggaaaaataattcttgaaatatatggtgtggctgggtatggtggcacacacctctagtcccagccacctggaggaggccgaggcaggagggtcacttgagtccagcctgggcaacatagtgagaccctaacactaaaaaaaagaaaaaagaaaaatatctggtgtgtttgtggtatatgaaggggagggaataggtattcaattctttgggtggagagtattgattatataatttgtagctaaatctctcagtttcttcatagataccaatcaactgcctcctcacccttcgggaaccatcctgagttctgatgaagcaacatggattatctctatgatacagacactttgaatgaatactaatctaatgcttcaattgactgttaaatgttctcttaacccatttgcatcccgtaatagaaatttggatttttttaaattgagaattgtaatgactctgtaaaagttttgttgcttcaagtcttttatctttaaacttgctgaataactgcctactttataaattgagaatgtaatatgtaatgcctgaaactagtgtaggacaagaaatagtaatctaagttttgactaagagttctatgtaacccattgacctggggcaaatcactcctcatcctaatataagtaggttagagtagatgacctttcatatttcccatgcaatgatggagagtaacacaagggagtcctgtggtaacggtagagggtaatatcttgattgtggtggtggttacaagaagctacacatgtgataaaactgcatagaggccggacacggtggctcatgaggtcaggagatcaagaccatcctggctaacacggtgaaacctcgtctttactaaaaatacaaaaattagccgggggtggtggcatgcacctgtagtcccagctactcaggagcgtcaggcaggaggagcccttgagcccaggatatggagacagcagtgagctatgatcatgcaactgcactcagcctgggcaacaaattgagagcctgcctctaaataaataaataaataaataaataaataaaatgaaaacaaaatacaaataaaatgaaactgacaaaataaaacaggaaatatcacggattcactaaaaattaaatatccatatttatatcccgaggatgctgccatttctgcccagttagctacccctacaatgtgtaatcttatttttcaatcctcaaatcctgcagaatccttatttatctgataattcaattgtgctcaatatgcttccttttaacgtcacagaattcggtgaattttcctgacttccatgtggtcgaaaaataatggctggtgacttagaaattttactgctatgtattggcttcaaaatttgtctttcaagtgacaggaatggggcagaaaaagacagtagatgccactagcagagttctggtgtaggcaaagtagaagaaaagaggcaaaacaaacaggaaataactaagcaagagaatgagcagaaggaaggagaaaagctaagaaaagagttcctccacctatgtttgggcggtggcagagtgtctctgtccattttacaagtgacatctatgatacagctatttcatatttaggaaagtagaatgaatcacgcaatgagatgtgaaataagtcttgattacagtattctagaaaggggcttaaaagaagcaaaagactttactcctggtaaacaccaaaccttcagacacagaacagaaatgtgccgttagaagatccctctcacccccatcctttaacatctttcaccaaacaaaacagggtaaaacaaactcaggcagtttctcaattactttcattaaaatgtctatgaacggtgaattaaatgacgaatctctttcagaacccattaatactttttccagagctaatactatcagtaaattttaaatagtgggaggaattattataaaagaataaaatatgtaacagatgctgaatcggtcatatgtcccagagctgctgtaacatacccaggcccgtacttcatgtgtccataacgaaaagagctggctgagaagttatgaggccacacctcacaacacctcaccctgctctctccctagtcccacagaggcacaatgcttctaaagctttgaagcctgaagttcagggaatgctttaaagatgaagtgtttaagctattttctggaagccaaatctatcattttaagattacattaaaagctacacttctactgttcatatcaatttacgctccaaactgctggtttctcagagcatccattgaatcctggtgggaggtaaatagtttctgtttagattttgacagaaaattaaaatttaaaacataatcactacatcttccatatactaagaagtcttcggtggctcatgctgtaatcccagcactttgggaggctgaggtggatggattacctgaggtcaggagttcgagaccagactggcaacatggtgaaaccccgcctctactaaaaatacaaaaaattaatcgggtgtggtggcgcacacctgtaatgccagctactcgggaggctgaggcgggaaaattgcttgaactagggaggtggaggttgcggtgagccgagatcacgccattgcacttcagcaaaaaagccaggcctggtggctcacatctgtaatcccagcactttgggaggctaaggcaggtggattgcctgaggtcaggagttcgagaccagcctggccaacatggtgaaaccatgtctctactaaaaatacgaaaaattagctggacatggtggcgggcacctgtaatcccagctactagggaggctgaggtgggagaatcacttgaacccaggaggtggaggttgcagtgaaccaagattgtgccattgcactccagcctgggcaacaaaagcaaaagtccatctcaaaaaataaaaaataataaagtcttgaaatgataaatgtaaaagttctttattttattttttgagacgagggtctcactctgtcacccagggtggagtgcagtggtgcaatatcagatcactgcaacctctgtctcctgggctcaagtgattctcccccttcaggcccctgacaggtgcaggtgcacaccaccacacctagctattttttgtatttttggtagagacagggtttcaccacgtttcccaggctggtctcaaactcctgagctccaatgatccacctgccttggcctcccaaagtgctgggattacaggcatgagccactatgtccggtttcaaagttctaattacgtttccttgtgtctaagaaaaaattttttctgcctaaggtttctaattattatagacaccagcaggctataaatatgtatatatattttgagacagagtgtgcctccgtctcccaggctggagtgtaatggctccatctcggctcactgcaacctccgcctcccaagttcaaacaattatcttgcctcagcctcccaagtagctgggtttacaggtgcccaccaccacgcccagctaattttttgtatttttagtagagacggggtttcaccatgttggccaggctggtctcgaactcctgacctcaggcgatccaccctccttggcctcccaaagtgctgggattacaggtgtgagccactgcgcccagcctaggtttttatatataaattgtgaacagtcataaaaataatttgtcctacacaagtttttgtgcctactatagactttcacactgatagaaaaaaaaatgcttacaaagcctttttctcagaggatctcatttggcagttttgaaatttacttttccacaaatctttatcagtggtaagaatgtttctgaggctgtgctgtcaatcacttatgtcaccactttccttcccacttcattaggaaccacactgtactttatttcttaaaggagaatctgaaactgatttggggaagaaggacttttagtccagagtatgcagcattgtataaaatatgtattgatataaagcctaaaaatacacacagtaggtacagcattcacatacgcaattatttagcaggttcagctggtgtgattttacaccacagtgttcttcttacgaataccagagagaaaatcaaagtttcttgacatatggtaataaatattttcacttacagtaaataatttttgctcttttggcatccattgtataaaagctagtttgaaatcattccaaattagcaaagctagaagtttggtaacacaaggggaacgagcagtataggcccccataccttcgttttcactgaagtgtgcttgcttttgagatacaacactgagaaaacttcctcattttcaagatgaagagatgttatttcttcctattgtgtttctaggactcgaaatgagcatctgtattcttcattatggaaatggaaaatgagtttgccctataattaatgctagacatgacaatttttctggcactaccttcaaaataaaaattttcaatatgaaaatctcataagaaaatctcagatgcagattcatctcaaaatccaggtgacataattcaacaaaatgaaaagcagcctgtttataagaccaattttctttaaagcatttcttttttttttttaaggaaacacatttattcacactctaaaatcatgaaatgttagacctgcgaactcctcaccttacaaacaagaaaatcaggtatcagatgattaagccattaagtcttcaccagtagatacagaactttctccagtacaatgtcttcacataaatcaattaaaagaaaatgctctaaaattagataagctccaaagagtaatctgttcacactgggacatgttgaatttgaggtgaactgatagcagttgtaagggtaaatctgaagttgagaagagaattctgggctggggatcatatagatttcccaacgaaaccaaaagagaaaaggagattctgagaccaccttcagaaaaatccaacatttaaaagggtagaaagaaaaagcaggtacaaacaaagaactgctttcctgttaattgtttttactcctaaaatatttgattgaatgtttccaagtggaaatctgaggagcccagtgaagaggattctcttaggcaattggtggattctcttaggcaattgatcgaacccagtgataaatttcccaaagtagtcttatgacacacagtgcatctatgacacaaaaactgtaaagtaaatcacttttcaaaagtaattcaccttaaaaattgattaaaattaactgaatgttaatttcttagtattgacagatatacaacggttatatgacatattcacattagggaaaaatgaacaaaaagaactctctaaaatatgtttatgacatttctagaatctcaaattattctgaattaaaatatttatttttaaaataaagcatgctgatctgattaactcccatatattacatataaaatgacaaagctgtgatatttataaatacattctcttttaaaaaatgatggagatacattcaacaaagaaaaatacaaccacaaccaaaacaagcaacctacaaattcctccccacttttgttacgtttatagacataaaacatgcattatccttgtttgaatggcatgtctttgaaaatgtcctcccattttagagtttcaaataaaacaagcatatacttttctacttaatctcatcaatttaaaccttcatatcttttcttaaagtactgcaaagagtagatgcatcatttagggattgctaggtagagtgaaataggctggagtcagtatttattttgttattgcaggagtagccttctgtttaaaatgacaccttctcttgcaattgaaatcttactggctatgtggaaaactagaaagtcaggaatctagaaaacacttgttgcagtggatgtcttaagaagtgtcctcagcttccttttctctagcctgaggttttgtaaagcaatcaagagctattcagtttaatgttttatacctaggtatcatttcagtcagttttaatgaatggttcacaaaatatcccataattcttcaccatattttaagctgcttactgagaaaataatactattgatgaccattccagtatcaagagtaaatggtttacataattattattacttattcaaaattgtttcacctaaggccagattctcatttactgcccagacccactcacactcacctacccactccatcccaccaaaaaaaaaaaaagaaaattaagagctggcgaaggaagtagaataaggcaaacaaagaattattgctacagcaatttataagaacgctcaattataccctaagggtctgagacagttatgcagttatgccaaagtgtccaatttactttttctgaagaaaaacacttagcaacaatggctaattttaatgaataaagagaatgaatacaaactaaatatgcagatgacttttaaacaaaaagttgcatccattttgcattacttttatatttcataaagcatgaaaccggcttttaagaaatcagtatgttgtcctgagaacatgtagaacaataggaaacaacccccttgactgattttgagacaagctacttgggtcctctctggatattctagtaccctcggtgtccgtaatgccattttagaagcaggtattgatattaagggatgtgtagcctacctgatttgacctgattttgtgttaccttttatttcgtgactggataactagtgctgctcaaacacaggaaacatacagcgaaataacatgaatgtatctccttgaaccacattaaactctcctttctccaagctaccttgaaatatatagaatacaatgagcaaatatattgacaagacaatgagcaaatatatattaagtaatgctatagggtaaaatagttaggccttcagtgctcctctagttttatgcctatttgtcttgaatcctcaattgaacttttaaggcagcaagtgtctcatttttctttgcataacccatgacatctagcagtgttctggcatagatacaatcatgcagtacatattttaacagatcttaactaacaatgtacaaaagcactgagaggggtgcttagtaattacttatatattttaattttcaacattctggaaagagatagtaaaattcctaaaggctaagaaacctcttggcaagtccaacagtagcttatccccggccaaatttttggcttgctatatgtacttttaagcctattagttaatagctacatgtttaacaatgttttacatagacacacattttatacaaatgttgtagtcccactacaaatctaaagagtagatgatccactcaaatctagctgtgctaatggagggatgcatggtatataattaaaacaatgattttgaagccaatggagggtaactggtccaaaaagcacatctaatcatgcaaaataattcattatgtagacagttcatacatggaaaattgagaattgactcccaaggctgtacatatgcaacttctaaataaagtgctttaaaaaaatcaaaattctatgtaaaaggtttgatctgacaataaaatggttttgaagtcataatggcagccttagttttatatatgtaattacaccttattataaatacattttattacatatatataatctatacatttgcatataaagtatttttttcattataggtaaattcatttcactggacgactgattaggaaagaattttgtctttgatatactctcccatccgagtactaaccaggatcaactctgcttagcttctgagatcagatgagaatgggtgcattcagggtggtatggccgtagactgatatactcctgtagagttttcaacttgaacgatgttaagtcagccaggtaatggcatttccccatactgttaagccttcactgtatccatgactttactaataaatttaggctgtgaacttatgtaatcatgttttccatcaaaaatctgaaataggcttagagccaagatggtggaaccctacaagactcattacattttaataaaaaagcagggggaacaaaggtgagagcacaaagactgcagaactaatttctttcgggaactgacttattttggctccccaaaataatattcaagtcattcccaccatgataaatagtttttgtctttcaaagtaatgaataaagtaatggagactttataacaaaaggctatacattatagtcatgggaaaatagtaaaacaagtatttgaatgttttttattcccaagaagatgaattgtggcttaacccacagatcaaaaaatatatagcacaacactgaaaaaaattatcattgatttttgggaaatctgagctagttacttatgattaatcaaatgaattaaaataaaggtgaaaatttgaggagcaaatggaaacgggtagtgataatacacatagtttatgatgcaaaaatataaactatctctcatatatttctgctttttaatagttgttactcagtttgaactcatattgtctttaatgtgccaaaagaccctagatatatccatgaatgtataattgtctgtgactctctccaatttttctgtatactggaaattgcctacctactccacaatattgtccttagctccattctctatgctagagtgatgagggaaggaggccttcaggagattcaaatatcagctgtcaagtaaatgtaaataagatagcagaaggtaaaatcagtctttctggtcaatactggtaactctagtgtaaattttaaaaacttaaatgctaaagaatgtataaatctaaacttagtgtcattatactatcttgaatttgcacaaagattattgtttatgtctttaataatctcaagttctgaagcaaatggatgccatttttttctatctattggtgtttgagtccataaaccacaggtaaagcaacagaggaataaaacactgggagcagggaaaatgggaggtaaaagagaagactaaataataaaaggcaccacttgatctaagtatgattaaatattcattaacgctgttcagctgtggattttggtagtgctcataatactagaattaacagcactaattttgatagggtgaaatctcatttaaatgtcattttctaaatgggcagagtataagttcttaaatatttaaacttaatatagacaaaggcctaaagtacttggctacatgcttttttcccatttgaaaactaaaaagtgtcagctaagagggcttttcctatcaattagcattctggttactgaatccatcatatagttaattgattgcccttgtaccttatcaatgcacccagatgctgtggtatgaacacatttcataaattaaagaagcatatggaagtgacacagacagtagcatttcatcccagaacatctttaatatgcgatgctacatcactaattattttgtaaatatgtaagtatttccctagttaatgtgttggtgagaagtttgcttggcagttgagcccaaatgttattgtaaccagacatttaataacagttcaggactcttgtagtttcattccattctgcccataaggagaatgtgtctcttagcctactgggcaaccttgattgtgcaaagtcaatgaaaatatttatcctttattactgggtaattttccttaatgaacagcagtctactctccataatataaatatctgtccaaagatcggtctggagactctttctaaaaatgttacagggaatttgccaagtgaggagcatattgctgcttagtgaatttttttccattaatttctaaggatagaatatgaaggaaattgcagcagaaataagttggctttattcttcaactttgggaaaactagtataatgatctgagtatattatcctgaatttaccttaaggtaccaaaagtaaaaatttttttcttcttgtctaagtcataatttcttgtcaagccaagtttcaaaagttaagtcaaaagaactttttttgagaatggaaactttctttggagaatggaaattctctacattaattaatgtattaatacaaaatccactagataactgacaagtgagctgcgggcaacccaaaagattgcatttaaacattttaaatttgtgtttctgttacattttagaagcatgatttttgtcagattaatttgcacttaggactgaaaactgtatctgggttcaactagaattttgtaagagtcattaaaatcagaggattcagaaataagttgattttcatcctccttcagtcctatgacttttctgggcaaaaactgtgtccagttctctgggagctgggggtgacagagggcttgatggaggctgctgagagattaatttcatttcagaatttgaactgggtattggtcaggctccacgctgcatgataaaatcaacaaatacttaaataaaatattcaaaagttattctgtaaatggccatctattaaaaagtcagaaggaaaataatagtagattagtttgcatggctctaaacattttcagaattgaaaacttatttagggaaaaatttggtaagccctatagatgcttgaatcatccaaagtctagtaaataagtttagtattaattgccacttttatatttcgatgctactaactaaaataatacaatagcctactgttaatttctcttctgcttttcctgagcttggcaaagagaaaaatgtgacaaacaccacaaatagacaacacaccatttgtaatctggtaaagcaacttctattcatggaatttcttccctttatgaagcgagggctatctaatttaatgaaaatagttgtcaccacagatatgacattctgtctcctaattaaatgaagatgcaatcagaacttcccttgaaaagagaggccaggcttccttcactattaagcacactcttccctaagggcaccctcctaccctttttctgatatgcaatcccttctgtcctccatctgctccacccccacctattgtctccactcactccaagcatgccaatcccatctggctatactcttgcttctgctagctctaattctccacaggcctagggaatgtttgaatgccaaggcatttttgcttttctcgagaataaggactagctaggagggtatcaaacaattccccaaggaattcacacacacatgaacatgcacatggtctctcacatacacaaacagcagtttagaatcctcctctaggatataatttctttaaaaatgtttttaattatttcatctgggaggcattttagaaaattaaaatcttactattgttgaaataatcaaaattaatatttcagaaataaacactttcattatcccagacacgcatttttttcagtaagcagaattaatgtaagtaaatgttactcatatcttatcatgaaatatttacattaatcaggtttaatcactgatcactaatacgttttctgttttagcaaacatgcatttaattcagacattccatctttacaaatgctcatgaaaatcccactctgccacaaaagcatgcatggtcagaatctaagcatatttaagcaaaaatttcagcaagtcattaacaataataaagcagtctggcaagtactgaaagcagcttttattcatgcttttacttgaactaagttaatacatatatacatacatatgcacacacacacacacacacacacagacacaagttttggttgtttttgccacaagcatgctgataaacccctgaagctcacacaaagcagcagacaaaactagaagcaaccatgctcagggtttaaggacattttaaaatttaaaacaacctttccacatttcacatacagcgtgcataaatttgacatgcaatcttcaagaagaaatattttaacataaatcttaaaattagtttatccaaatgagtttattcttattttcattattattgtttttaggcttctggtatcttaaaccctgcatgctgcagatctaagctgtgctcagcagcggctgtgacagaagaagctacctgcaagttttcacagtgccatctcatatccatgtctgtctggctaccctgcgtgcttagagcttttttcttaattcttaatggaaatcctaggaaatttagtccatcctctgaaatcaatactggtgacaggagagctccctgactcagtgggagatcaagatgataaattgcctgcgcatcagcccggcctatcagtgccctgcacacagatgggcgagaaaagacacagaaaacgctctgtcagtcacgtgtcactgaggagccaatggctgacgcactacggcaggaagggatgctgcagttccgtctgcagttgacgaggctgttggtacacagcccagcccggcaccactcaaaaagtctcagcagtcgttgcttttcaatttgctcccctaacgagaccgcataggtaaacagacctccctctaacccccgaccgaaaaaaaggcttattttcatgcacgaacattttctgtatattacattcaaatccagtgtgattgctaaacacagaggggaaacttttttttccccagcccttaaactgttatgtgtttttcttgagataattatctttttacctaatattaaattagaagacttaaaactgtgcaattagcatggaaccctcctagtagaatctcctcgaagccttgtaattgtaattacaattttatttgtaagttaatgaatgacattttttgaatgccaagtttataatgagtatttttatgggatgagtttgtaaagacaattatgcaacattaagaaatacattcttaggcttttttttttttggccaattacaactgttgctctttaaagacaatttaagtcccaataaatatgccattttatcaatcattaaaaataaaaacaagcaccaaaagatgcacatcctgtttcccaaagcctgaagaacaaatgtattattcaatgatgaaaatatgtacttatttgctgccttttctctgaaatttacaataattatttggtaagcaaagactacacatctggaataccatatggaactatatccccaaatacatctgtttccagtgatcatactgtaataacagatatgtttacacacttcttcaatgtgagatgattatatatagttatatatacatatacatacaattatatattatatatatgattatatacagtctgacagggtaggctataagtgatgagaccggtgtgtgtttcaaatgacagtatcacggagattttttttttaaagctcaaaagtagcataaaacaatcttcaggaataaaatttctagaagaaaaattaccctagccaccctggcacttttattgcttttcattgcccagttttcatactattcatacatttgaaagaattaattctaacatcttttagagtctggcaacactatttagaaaaaaagtgtattggaataaacattgataggtgtgcctcataagtaaagcttatgagttgtagaatgctgaaattccaaagctcaatttgtcttggcaactatttttttaaactaaacacattcctgaaagattgaaccctgtcaagtttttttgcaaattctttctttcattcaatattgactatcaggaaataataaagcatttttcaagttttttaaaatagatgttgtcatgtgtttttttctatttattcagactattcaataataacgtaattctcaacaaactttattcttaaaaaatattatgactcagagcacctgtcattaaaaacaaaataataataaaacatcaacactaaacctattcattagagcactgtaatagccccaaactagaaaccaccttaatcactgatagtaaactgagtagataaactatgatacagccttacaggtgaaatactcttcatctgtaaaatacaatgtggtaaatcatatgtccttatatgaagagatttctcagatacatttgaatgaaaaagccataaaatttaaattgtgtataggctatacttacttacataatacatgcatgtatacacacacaaatgattgcatatgcggaagaatttttttttttttttttttttttgagatggagtcttgctctgtcacccaggctggagtgcagtggtgggatctagactcactgcaacctctgcctctcaggttcaagtgattcttctgcctcagcctcctgagtagatgggattacaggagagtgccaccacgcccagctaatttttttttttttttgtatttttagtagagatggggttacaccatgttggcctggtgggtctcaaactcctgatctcgagtgatccgcccaccttggcctcccaaagtaccaggattatagaggcatgagccaccctgcccgacctacaggaaatttctgtaaggacataaactatcagttaatagtggccaaatagtggctacatctgaggagactgagttcaaaggtaggactgagacatagttttattaggtatcattttatacattttgtttaagtctatggtttacttttctaatttaaaatgaattaagataatgttatcgatgttcatgtaggtttagaagagcatgactggtatgttttgagggaaaatcttgagggaaaggaaggaagacagagggaaggacatgtggcctgctttttttcatgtaaagaaaatagtgtaggtgtgggcaagaagggaactgtaaaataaaggttctggcaatctctgctgaagaccttcacatctcatatcaacttgaagttcttttatctatgaatgcaaataataatacagacatggattaagagctttacaatttagagtgacgattaacccaaattttgtctgattcttccaggaacgaatgtaaaaggctgagaagtaaatgatttgtatatttacccagacatgggcaaattaacctcttcaagccttagttttctcagctggatgcaattagcaaaaagtggccaagctaaacttgaatttcaatttagggtattgttcactgctgcttcaaaggcaaaataacatccatgtttttaccaataatggtgtagggctaaagacaaaacaaattttcacgtgtttcctccccagaagcagcttatgttgtccaaaactgaaaacttggcttatagattctattgttggctcttgttgttattcagattcttgtaactttaagagatacaaacctaaaaaaaaaatgaattggccaaattaagtcaaagattacaatttgaataatttaagggttttggggttttacataaaagtgctgtaaatcagtggtttcggatggtgattttgctccatcccaccccccagggaacatttgacaatgtttggtgacatttctggttgtcaaaactggagggtgctagcagcatccagtggatagtggccaagaatgctgctaatcattctataatgtacaggacagtccctatcacaaataattatttggacccaaatgtcaacagtgctgagatagagaaaccatgttctaaatgctaaacttttctaccttctttccgaaagattaaataaatatattctgtattatgaagcatatattgtaacgtgacaagatttagatggagaagagaaggggaccaaggaccaagccctgggtttctccaattttaataagttacagaaaacaggaaaaaacagcaagtgaggatgaagagatgggaggacaactcaaaggatggtgacctggaagtcagtggtaaaagtgtgttagtaaagagattagggtcaatttgttcaaatgctgtgataggtcaagttatctgttcttcataggttttttaaaagaattaaagtgagaaattaacctaattgaaattaacagtatacttgaagtctttattgctctgcatgatatttgcatttttaaaggtatggacagaaaatgtagcggggcggtggctcacctgtaatcccagcactttgggatgctgagtcgagtggatcacgaggtcaggagattgacaccatcctggccaacatggtgaaaccctgtctctactaaaaacacaaaaattagctaggcgtggtggcaggtgcctgtaatcccagctacttgggaggcagagccaggagaatcgcttgaaccagggagtcagaggttgcagtgagctgagattgcaccaccgcactccagcctggtgacagagcgagactccatcccccacaaaaaagaaaatgtagtaattacagggatcacaggaggactagctgaggaaatatataaaggagaggaaacttctgtaactctcaaattataattctgaggctactttctctacaaaggtgggcttgtgagcaagaaagtgaacaaatcctatcttggaccaccctacaccacagcttgcatgggagacagagtgccaccctctccccttagaaactatgtctgcagttcttgtcctcgggctctcacgaagtgtctctatccatagataaggtttctgaaaacagagttctaaggactaacttcaggtgcttttcctcctgggactcctctaatgctaatccccacactgtcaggcctgtggtgttcagggttagtgcagcaaggctcaaagacagagccagctggaggactaggacactggagcagctttaagcaaagctaatgcctttgttgcaaaggaaatgttagaaatctcacagaaaaacagctgggggagggagggcagaggagagagagagagatagccataaaaagaaaagagaggccacaaaaaaaaaaaaaaaaagatgaccacaaacccatggatattattacaaactctatggtgtgggagaaaactacatgtcacaattctcttaaaactagatagatttttacaaattgaatagtccaactccttcgttttagagatggattttaatgtagagaggttaaataatttgttttaaattttaagtgaaagtgacattctttaccattcaaagcaatcagtgaacctgatattgacaaatttcaaggtgctttcaaaaatcatcatagataacaaccagggtaagacttaggggaaggaggtcgggtgcgggggctcatgcctgtaatcccagttctttgggaggccgaagcaggtggatcacaagatcaggagttcgagaccagcctggccaacatggtgaaaccctgtctctactaaaaattccaaaattagccaggcgtggtggcatgcacctgtaatctcagctacttgagaggctgaggcaggataatgccttgaacccaggaggtggaggttgcagtaagccaagatcatgccactgcactccagcctgggtgacagaacaagactcaaaaaaacaaagaaacaaaaacttagagggaggggaaaagttgatgttcagtaagagataaatctccaaagccttctctttcccatgctgatgctgtattaaggcacggagagcctttgctatcagggagaggaagtattatcttccaaaatattccaatgagtatttataggttatgaaatacaaaagaagaagccttgagtattctcctttcagaagaatttaagtggctgctgaagttttttttaaatgaaaattctcatctctatttgcactacagtcatgatgaataggatgcatggatgactttcaaaagacatatgtcagaaagtaaactccagttgacaggaactatagcatagggaaatattttggactgttttcagtttttaagagatgggaaaaatagaagtggtggaaaatccaagcagattgtcttagttttttattatttttcctttttctccttataattgaagcactactttgagactatggagtaccattaaattcctattaactattaatttaatatttgcaagtatggattagagataggatggaaattaatgtccaagtgagtaaaattccacatagtcttatattgtttttttggttttttttttctgctactgtattcttgtgggttttgtttttcttactctggttgtttatctaggtatatatgctttgtaaaaagcaaacagaaacaaaacatctgtggccccaggcaatcttttcattaacattatatcctaaaaattattatgctaatgttaaaaataaagaaattgggactcagagggattaaataacatatatatccatgaagctagcaactgaaagtctacgactacattttgaatgttctctccaaatcagaactagcgttccagaatagttgttgttaaagtttattatgcataagaaccaacaaggcacacgttaaacatccagatttctgggcccttccatggagactgattcctactctaactcagatggattccaagagtctgcattgttaacaaacattccatcttccatactttaagaaccttgggaccatattggagtttcagcttcggaattcttctttgggaaaagccatatcaacaagatttcaatgaatagaaatgggaagctttaaaaaaatagaaaggaaagttggtaggagtagttttttaccaagagagaaactggagcagagaatagcttcacagcagagaggaaaaatgcagatgacttagagccatccattaagggatagtttcccatattgagttagataaagtatgaagtattttagttgaaaatatttttgagcaaggaagattaatgtgcatagaagaaatgtacaaatcatagcatttagaataggatgacccttttgaacctacaaatagggcacttggctgaattggttcctacctccactgctgcaattagaaaccatgaatgtgcagatatacaggcaatgtcattttgtatatgctagaaaataatttattttcagaggggttttcatatgatgggtttctagacctctagagagaggtaaagtttcctttataagatgagaacctactgaagtcagatgaaaacctccccaattgcttgacaataaatcttcccagagaaaagtcctcagccatttcatgtgaaatgatgactcatgaaaatgaaatagtacactgtacagaaatcttgcaattctagtttttctcctagctgacttctaggttggaaagcttaaggtcaaagattagtggtgccaaaacatgctcattttaggctaatctctacatttcctactgccagtctctgaccagtttttaaattttctgagctttttggcatgctatgtatttctcttactttgacagaaggatgacatactattcactttgatccaacctcaagacccaaaggataaggttaataaggaactgaatctttcaggacaatgcagtttaccaaacagtagtcagtgactaaatatttttggtaactgattgatgaaagcactcatcaaaaaaccatagtccatggacaagtccatcagaagaaattaaggaaaattggaaaaaaggaagaatgaaggggagggagggaagagggaaaagaactaaaggaaaaatgaacataaaaccttacatgtagttgaggcacaacaatggactatacgagaaacttttggcttgtcagtgaatacagcttgtcaggcattatcaagtgtaaatcctcttcccccccacttttcccgctcttgataatgacccaagcaataatattttatgcaacaagaatgacttaaataagacacctatgaagaaggccacagatgacttcataaccctatgcatatgtacatacagaacccacatggagtgaatgttgcctattaacaaaactgtgaaatctgagttagaaacaaagctcagcttggactgaatatataaaaaaatcagtgaacagaagatattttcaaatggacacttacataaatacagcattccaagggaaaattccagcctcagatgcacttatttcatgaagactcaatattttatagcaatggttttccaaagttaagttgcttaagatctagggtgcttattaaaaatgcaaagtgtctggacccaccctgatctaaggaattataatttccagggatgagagtgaaaatctatatgtataacatgtactccaggtgatcctgacgtaggttgttttagactttatttgagacacacactctccaatgtacataaagtcaagaaccagattcttctccaaccatttcctgcagatagtcacaccagccttggacatgccgggtcatccaattcaattattaaacacaatgtctttcatttggagagatagaagattgataaatctagaaaaagattaggaatgatgagatgaatagattatcaatagatttcatgaaacaggttcgattcaatttgggccttgaatgatggtagagttaattattttggcaaaggcattgaggtataaaatgtttttctttaaaactgttagaatttattattaaaatgataaacttctttatcttttcagctggagggcttagcaatgcttccagcacatatgaaatcaccaataactcttagttgaattagtaaattacatgaccacaaaaaagtaaatctacttaaaaaaaacacacaaaatcccaccaccttgacaaaacttcatgatttttgttgatgatgctgttgttttgatttttatttcaaattcttcatttcttatttgtatagtttgaatagttatagtaataaagatataattttctttggttttataagttatataatggcacatacattttccatcttgatttagaatattcataattattctagtagcaaaagaataaataaaatggatgtattgtaatgtacatacctattctgtgttttttagataatggacgcatttctattctgcatttctgctttgtaaataacaattttcttcctttgtatttttttcataacataagtgaccataaatgagattactagactaaagacatagtgtttttatagatcttgaaacaatctgttaaactacttttcaaaagacttgttctaattttcacattgtctcaagcatgctatgttctataacatctttactggcatgaacatgctgtcttttctatctggggacgcccttttcccatttaaataaaaaatcttggtaaactcctacacattgttttgtactaagctcaaatgctattctttcttgcagcctttccaaatcctctaggaagagttagtcattatttccattgtgtttccatagtactttgtaataatactatttgggacacttattcaaatagctctgtgtttgttatagtttgtatatttcttttctttttcctagattattagcaactcaagggatgagccgctgtccacttcatctttggaacatcagcttctagcacaggggctggttatattagacattcaataaatgtttgttaagcaaatgaggaataaatgagtaaatgtcaatgtgatactcaagtcaaaatctgtggctgtatgttgggtaaaaatgctttctttccttaagtcttttataggtcatttagtactaggaacatttatatttttacgggtcttttaaattatatttttatacttttaatatttatatattttgtaggtctacatttttaatacctttgctgatgactttcaggcttagatagcacaattctatgatatgctgtgagtcagatctttgagtcctttagataatgacttttaggtattctggaatcagaaaatgtctttttctagttcatacagaaacaacttttgttaattaagtgttaggactagtaaataagattagaaaccacctgtggagaacacagcatgtacatggccccactgtagatggaataaatgttttaaaataactgctgataaattatttaacaaaatataatcaataattattctaacatatatcactgtgcattttgttgcattacatatattctctcattttctctctaccaaaactggtaagaaatacaaagactggacactgtggctccttcctgtactttgggaggctgaggcaggaggattacttgaggccaagagtttgagatcagcctgggcaatagagtgagatctcatttctactaaaattaaaaaaaaaattagctgggtgtggtaatacagcacctgtagtctcagctactcaggaagctgaagtgggaagatcacttgagcctaagaggctgaggctgcagtgagctgtgatcatggcactgcactccagtgcggtcaatagagtgagacctggtttcaaaaaattaagaaaaaaaaatcagaaaaagcaaatacagacaaagcaagtataccataaatgtaatttgaaagataagtaatctaacacacagaaatgtggctagcaagtggaaaaatcagaaccagaattcacatattttaagccacattttagccttcattctagtaaaatcactacacccaactgaattttgctaatttcaaactgagaaaatgagatctgacgtcgtataaactaaacaggtgttttaaaaacaaacagaaacttctctagcaataaaaactttttttccaaaataatgcttatgaataattcaatataaaaaacaatatcagaggactcatattgaagtgagtggccagtgaaggggggctcctttctctcctcttttatggctcttggtagttcctagagcttgcactcaggaaagcactgtattgggccatttctttacttagtcattcagtcattaatacatcttacagcctaactaggtacaaagaattgtgggaaagataaatacaagacaaagtcctttgagaacacacaaacacacacacacacacacacacacacacacgatagtatattataaatgccacagaagttatattgcatagtagtaagcattctgaaagttcagagaagaatgatgtctagtcccataccctggattgagttccacatgtccacctaaggacacacagattttgtttcttatttggtgacttggtacaaaccatttaatctgcctatttgggcatccattcctgagaaataaaagtgatcaatgttgccaatccaatgcatgtaatatgtgactatagggagagaataacttagtggagagaatggggcagtgaaatcagacagatctggttttacagctttggcacttagattgagctagttagttcaacttctctaagtcacagctgtttcacccataaaatgagagtaacagcaatatataccttttgaaaatttccataaggtatcaataagataaaatataacacctagcagagaaactagcatagattcaatggtcaataaatagcagaaatccttattaactattaagatgaagaagttacatctaggatttgcatagactattttgattctacgattcaataaattttatttttgacataactcattcaccgtggaagaaattagtgttctatatttaatgaagaccaaagactttggcttggtaaatactattcttagaattttcctccttttcaagctgtatagattcatgtgaagcctggaaaagacgctactatgttttattttgcaatgcactagattttgcttgtactctttagaaaatgttaggctttatttcagtcgtcatttgtgcataaactctagtcagatcaagcaaaaacaatgaagtcattagtgtgcactgagtttagtcacttctttaaatgctacattaattgctttgagattctctacttccactgtgacaagcaagacaaatggagtttacctgcaggacacatcaccagtcaccttcccagcaagctggctacaacctcatctgctccttttcacttaagaaggcatactgtcatgcaaatgagtgagaatgataacacagacaaaatcttgaatctacattgcttgatatttacaacaaaaaaaaaatattcactcactttggaagttaaaccattattagtaatactgacaacacatttcacattcgatggggccataccaatatgtaacaatttatggtacagaatcacttcatggtatgacccaaggaaatgtacttcatttgtggaataattaaaagtccatcctttctgtgaagaaaatgctttatactctgaagaccactatcatgaattaaaaaatccagtatcacaaattgtagacaacctaaaagaatgttaacttaataatatgtgacttcgatctaaatgaagtgataaattggccagaaactcagatgccacagggcacatatgttacataaataatcacataaataatctagcatttctctaaagcagcgattctcaattttggtcttagatcttattgtcactgttaaaaataattgaaaactccaaagacatacatattgtttatgtagattacatatgtggatatttactctattagaaattaaaggtgataaaagttaaatatttaactgatttaaaaataacaataaacccattaacataaatttaaaaaggaactacattttcaaaaacatacattttaaagaaaataatactgttttacatttttgcagatcttttcaatatcttttaaattagaagactggggctcatatttgcttctgcaatctattgcaatatttcatgtcatgtagtctttaaaaaattccactgtatccttatgaaacaatgagaatgaaaagggtaaagttttttctttttttgttgacatataataactacatatttatgagatacagagtgatattttgatacatgcatacaacatgtaataatcaaataagtgtaattagcatatccataatctcacacatttatcatgtctttgttttgggaacactcaaagtcctctcttctagctttttgaaaatatacattaggttgggcatggtcactcacacctataatttcagcactttgggaggccaaggcaggtggattgcttgagcccaggagtttgagaccagcctgggcaacatggcaaaaccccatctctacaaaaaatacaaaaaattagccaggtggggtggtgcacacctgcagttccagttacttgggaggctgaagtgggaggaccacctaagctgggcaggttgaggctgcagtgagccactgcgttccagcttggctgacagagtgagaaaaaaaaaagaaaatatacattaaattattattaaccatatttaccctgcagtactatagaacactaggacttattcctccttatctaactgtaattttgtatctgttagccaacttctccctattcttacttccccctttacctttcccagcctacaattctgctctctatttcaatgagctaaatttctcttagctcccacatatgagtgagaacatgcagtaaaattttagtattattttgaaaataattttgacctcactgaaaaggtcttacaacactcctttcccctgtcctaagccttggcctcccaagacttctagatcatattttgagaaacactgctctgtttttataatatttagagcatatattatttattattttttgtgtctaatttacatatatgtcctattgttgtttccctatttgaaattttcctgatggagatcatcattacaaaccttaggtatcactttacagcatgtggtaagcctgcctggaaccacagtgtacctcaacatgtaatattgattcaatgacccattgatagattgaagcctatagtgtcttatggtccctttaatgacctttaaaatatgtgatatagtagtatttttatagtttgtcaaattttgagcccattatgtcaacattctacctaaatagaaggatgagctaatcatacataaatttattctagatgaaacaacgtttttttttttttgactcagctgtgacttttggaaaagaaactagaattctagagaagttattattatacatttttttcctataaaatttatcctaacatatcaggcaatattttaaggtctaatcaatttatatatttagttgtaatttcacaattacaaaacaattgaaagcaaaaatatgaaaatcatcagtttgaattgatttgaagctatagtttcctatgtctatgagtggaacaaaaaaagtaacaaatattacttttatgtgttctactgccaaatcagatcctttgaaaggcacccacttagtaacttggaaatgaaacatttatacattcatccctgctaaattgctgcaaaatgtgatggttgggaaatatatattaaagagtgaaacagtcctcctaaattaaaggttttcttacataataaataatttctttgactctttgaaaatggttccattatctcctgatctaggaaacccacagagaaagacttagtgtctgccattaccttggtaatcagataattattctgactattctatcagaaaaaaaaaaaactgtacatactgaaaagaagactctttcctgctaaaatctgggtaaacaaaatagctgctagactgggaaacaaaaagaggggtcacagatctgagttgactcttcctttttcatgagtcataggacagcagatatactagttgtcttttgctttcagaagagttttacattacctaaactcatggctgaatcacaaagtacatggccagaagacttagtgacttagtaacagagttctcttagacattttaccctccttaaactaattttggtcttgacacagttaactattaaaaaaaaaaaaaaaaaaaagccctgaagcctgcctattcacctctgatcactgagaatgaattgaattatcaccgtacaaataaatttgggaagcaagataatgggagggaaaagagatgattaatatttgaactgtaaaggatatatgtctgaaatttaattattaacaaatgtgcattgatgcaattatgtaccattacatagcagagttaagaaatctaaattaagtaaattgcaaatgctataactaaacttataacaagttattttaaaaattaaaactctcatcagttgaaaactatatccaacagaaatcaggcaggaatttctaccacctgttcatatgcatgtacagtgggaatctgaagcattgcccagcacaatgtggcagccagactctagattattccatttgagttctgagtaactgtaattgtatgctattttaagcttatgaatgctaagattgtttaattcttaataagctgataggtagcccttaattgcatgatgaaaatccaagtccaatggcttgtgtgccacttgcctataaaaagcaaataaaggacttacatttctggttcaggttgtaatccaccaagtgaaaccttggggtctttaagctaaggatctttacttgaaaatcactgttttatagcttattaaatttccatgtcaaaaatatcaaagaagtcattcaacaaacatgtattgggtctactaagtggcaggtctctttaggactctgcagatgcagtagtagcaaatgtgataacaaggctctaagtgaattcatcttctatttgaagaaagtcagaaaaccaacagccaaccaacaaaccggtcaatgcactccagggaaagaccatgaggagcatacctttacttgaacaagtgagtttattaattgttgtagcaaggaagaacacacaccacacggagccatgaagtatcttagtaagatactaagtaagggcattagtaaaggcatattaaaaagaattcaggcttattcggtgattctggggagggtttaagaaaacaggactttgttctgtactggatgctgccagaaagtagaagcaattctaggattggatagctcaataaatcttatctatagcaagagcagactagagtgagaataaagttatgattggtaggaaagtagtattcaacttaaccaataagatggtttgacattttgtgggttatatagtgacaccaatttttatctgttttttaatgaaaaaatgacatagcattattttcactcactttattatggtcttagtgtgactgtgtttcatgttggtactctatgaagttatttctctctaatgggtgaacaatatcatctacctgtgggctccaggccagcttctaacaatgctgaggcctcacttacggattagatcagttcccagacaacaggggctacttttccctttcaatcatgcaaccagccaagcaataaatttaaaaaaaaaaaaactatcaaagagtgatagaacatagtaaaagggatggccctttatattgggtgttcagggaaaggctgttagatttgaacaatcagaaggagccaacatatgactacagggggaaaaacatttctgtcccagtgaataactactgccaaggccctaagataagaaagagtctgagcatcaaaagaaagacagtgtgatctaagaatgatctaagagcacagcgaggaaagacaaaaggaaggagggagagccaggtggccagatggaagttgtgtagggtaggtagggtattgtgactttattctatatatgataggaaatcattgaaggttgtaagagcagaataatgacataattttatttatatatttaaaagatcatcctgtatgttccatggagaagcagagatgtgagtcaggaggttttgcagtttaggcaagagataatagtggcttgccacaggtattggtggtggagaaggcagagctgactgttctgaagtcagtgttcataagacttactgataacatatcagtaagtaatttgggaagtgaaaagcaggaagaaatgagtgaaggatgatcttaatagttacttggttcttaatgtcagtgataatcttattcatcatgttattcctaatacctgattcacagagggcactagatatagaatgaaagaataccttttgtagctaatgttggcactattagcaagcttcaaaagtatctgcatttattaatctccagttggggtttggttcctaatttcttctgttgatttgcagttaactcagtggtggtagcaaggtacaaaataccccaggactacacagaacaacacaatcaaggtagaattgacacaaataactcctaagaaaatgtttcctacatatagagtaaataatttactaaacatgcttaaaataaataaatttggaaaaaaataaaataaatagaaaacttcctcaaattgataaagaacattcttaaaaacttattactaacatcatatgtaatagtgagaaacttgacacttctccactaagactagaaacaagacaaggatatctccctttcaccaactgtttcaacatcatatgggaattactagctactgcaataagacaagaaaaaaatagtaggaatacagattcagaaggaagaaataaaactatctttgcttgcaggtgacacaattgtgtatgcagaacatctgaaagaatcataaaaacctcctggaactagtaaatgattattgcaaggtcacaagatacaagtttaatatataaaagttaatctctttcatatataccaacaatgaacaagtaatattcaaaataaaaaaaacataataacatttacattagcacccccccaaaatgaaacacatagatgtaaatcaaacaaaatatctaaaaaataagtagttttcttctatataaggagaactacaaaaccttgaggaatgaaatctagtaagtaaataatggatagaactaaataaatggatattccatgttcattattattgtcaaaatgtcagttcttcccaacttgatttatagcttcaatgcaatcccaatcaaaatcctggcaagttattttgtggatgttgacaaactgattctaaagtttatatggagaggcaaaagaactggaatggctaacaaaatattgaaggagaagaacaaagttgaaggactgacatcatctaacgtcaagccttactataaagttataacattcaagacagtgtggtattaatgaaggaataggcaaatagattaatggaagagaagaacccagaaacagacctagataaatataatcaactgatctttgatatagagcaaaggttacataataaagcaaagatagtcttttcaacaaacggtgctagaacaactagacatccatatgaaaaataatttagagacagacaattgacaaacattaactcaaaatggatcaaacccttaagtgtaaaatgaaaaaccataaaactcttagaagacgacacaggagaaaaacctagatgaccttgggtatggcactgactttttagatacaaaaccaaaggatgatccatgagagaaataattaatgagctctacatcattaaaataaagaaaaaacttttggaccgggtgcagtggctcatgcctgtaatcccagcactttgggaggccaaggtgggtgaatcatgaggtcaggaaattgagaccatcctggacaacatggtgaaactccgtctctactaaaatacaaacaaaaaaaaaacaccccaaaaacaaacaaacaaacaaaaaaccaattagccaggcatggtggtgtatgcctatagtcccagctagtcgggaggctgaggcagggaaattgcttgaacttgggaggcggaggttgcagtgagcccttcctgcctagcaacagagtgagactctgtctcaaaaaacaaaaacaaacaaaacaacaacaatacttctgttatctgaaaaactctgttaagaaaatgagaagacaagccacagactagcaaaaaatacttgcaaaagacctatctgataaaagactgtgatccaaaatatacaaagaactcgtaaaactcaacaatgataaaacaaaaaaagggccaaaatcttaacagacacctgaccaaaaagagatatagatggcaattgagcacatgaaagatgctccacattatacaccatcagggaaatgaaaattaaaacaacagtaagatatcattacacgcctattagaatgaccaaaatctggaacactgacaacaccaaatgctggcaaggatgtcaagcaacaggaatgctcattcattgctagtagaaacgcacaatttcacagccattttggaagagagtttggcagtttctaacaaagctaaacatacttttaccatacaatccagcaatcactctgcttggtatttactcccaaaagttgaaaacttacgttcacacaaaaacctgcaaagagatgcttatagcggctttatttataattgccaaaacttggaaccaaccaaggtattcttcggtaagtaaacgggtaaataaatggtggtacacccagataatggaatattaatcattattttaaaaaatgagccactgaaccataaaaagacatgaaggaatcttaaatgcatattactaagtgaaagaagccaatataaaaaggcaataatatggtataattccaaccatatgacattctagaagaagcaaaactacagagacagtacaaagttcactggttgctaggggttttatggataggatgaataggcagaacatagaggatttttaggtctgtgaaaatactctgtatgacactataataatagatccatgccatgatatatttgtccaaatccacagaatgtacgacattcatgtaacctctggcctttggttgattatgatgtgtcaatgcaggctcaccaattgtaacaaatgcactactctagtggagggtgttgataatgagggaagctatccatgtatgggggcagggagcataaagaaaacctctaccttcctcttaattttgctgtgagcctaaaactgccctaaaaattgtcttttgagaaattaaaagacatttagaaatcatggaaaaaatagaaaaacgtaaggcaattgctcatcatagcagataaaaaatccaaaggttctgaattctgtcccaaaataccctcaatagggtgtccacctttacctcattaacttatttgaatggtacatttgtatctcttgaagaactcttagaagaactggctgtggtgatgttttctgccttctgtcaacctttcaaaatcacatgcccatcagatggcattctcaaatttcctgccctgtaccccaagagaactgtcctcaggaacaatacagaaactgcctaactaagtatagtcaataaaccactgcttcagaatcacaccggggatcctctgtttcccttcacaagcagagtctctcaggaagcagtaatgaagcatagtacgggggtgctcctccttaatgcctatgaagactcataattggaacccaaacttgctcttcaatgtgttgatgactctgcagacaaacctgggcttctctggtgtgctttcttattgtggaaaccaacaggtcaaaatattaatatgtgcaggcagaaataggtgtagaatataagcaagaggcctctttctttctctattggtatgtttgaagcaatatgactaatagacgaatccagtctgttttagaggtttagtttgggaaagtccttgtaaggcattaaaggagtagttttaattcacagataatacgacactcagatacaatgccagaatatccaaaataatttattgcattctacacccatggattcctgaaggttagagtatatttaaactacaccggtaagagttgttgggaaaaatacaagtatctcagagatcacatggtcacaacctacctataaggacctcaagccatgtaaaaacatcacagctgagggaactacttcaaggaaacaaagacagaacatggtcatcctaaaccccagaggcaaacttacagccattaaatagactcctttggccagtcatgctcattcattctcatttaaaataattatttgatgatacagtcaaacaagaaagtattctgctttttgtaaggcaaaaggtgagagtgaatttctagaagttaataaacaggttggtagttttcttccactttgctcataacatcatggaaaaatcactgaagtgtgagaaacaggattctgtcacaccagtgcctcacatccaatgctgcgagagaatgaaatattgacaatttaggtgtagttctcataatttcacccaactcaaaggaatgactgaaacactccttgataacaagaaaacacctgaggaagggagagaaaataatcattctctccaaccttctttgcacctttcgatttcatatagctaaggatacacatttctcacagtgattgaagagggtggcaacatctgtcaaatctgtagagtcaagacatgaaattcaattttaaattctcagtagaggagaaaaatgagagaaaggtaacttgtaatttcttccaattagatatacaggaataactaattgaaatgaatgttttataaaaaaccttcttttactttttaaaaactgaatttctacattttaataacattgtcatgtgtaattataggggtgttgaaattttgtttcctcttttctgagccctaagtttgccttctgagagaaaatcttgaaaatgtagtcatattttaaaaagtggtaaagcctactactgttcatatcattttcaaccatcagtagaccttaaagataggaaaagaggccgggcgcggtggctcacgcctctaatcccagcactttgggaggccgaggcgggcggatcacgaggtcaggagatcgacaccatcctggctaacatggtgaaaccccgcctctactaaaaatacaaaaaatgagccgggcgtggtggcgggtgtctgtagtcccagctactcgggaggctgaggcaggagaatggcgtaaacctgggaggcggagcttgcagtgagcggagatcccatcactgcaatccagcctgagcgacagagcgagactccgtctcaaaaaaaaaaaaaaaaaaaaaagataggaaaagaaagaaaatagcctgtacttcaagtatgaaagcaccatgctggatagtaaaaaaaaaaaaaaaaaaaaaagaaaaaaggatttagagagcctaagtgtatgccccttgggtctcatgactctgtcaaaatgacagggtgatttccagaaattcattaatcctttcaatgaatatttactgagcatccacagtgagcagtgatctgcacaggaagctaggagtgggatggggtgagtatgatgtacaatgataaatgagacacagaaaatgcctttgaggaccttatggtgtagaaggggagaacacatactttctcctaccttgtattaaaattatttgtgtgtgagagtcatgagaagtataaataaggtattatgaaagttcacagaggtaaaaaattaattcttacagggaggaattgcagaagtagaaataactgtctttgcctggaaggatgaaaaatctcaggacatgtagagaaggtagaagaacattttctttgaaagggatgggataagcaaggacattaaaaagatagcatggtgtacccacaaatcattcagtttacctgaatcaagaggaggacaggaatggaaaggaagattggggatttacatagtatggtaggctaaatccatctactttctaatctctggaatttttaaataagttaactgacatggcaaagtctttgtaggtataattaagactcttgagttggagatattatcctggattgtctggtgggcccagtgtaatgacaagggtcctttcaagtgaaagaataaggcaaaagaatcagagtcagagagagagctatactaatggaagcagggatcagagtgatgcaaggaaggggccataaactgaggaatgcaggtggcttctagaaaatgaaaaagacaaggtaacatattctcccctaaagcctccagaaggaatgcagctgccctgcccatccatgctagacttccaacccctagaactgtaagcaaatttatttgtgctgttttaagccactatatttttggtaaattgttacagcaacaggacacagatatagagtggaatgttttgaatatactacatcttagtccaaataattatttatccattctctcttggtgtacctcaacttttacttattatttcattacaacatttatgttgtattttttatttttataaaatatatttgcctgtctgcttcgtttgagttataaagaaggtgaaagtactactaacagaatacagaaaacccacaaagagaaaaatatttaaaagcaagatgctgaaatctttttcgaacacagtacgtttgaaataccaatgggtcaacacggtgggtggacagttggagatggaaattcatgcctcctgcttgaagataagagcgcatatctcttggaagcaattacaaaaatttattatagctcacaaaagagaatcattgaagtgtgactattgaccattgggaaaatttaaatagtatgtattcatgagaagggaattatttaatcagggtattttgacataggttgctggaagaagtgattttatattaagtattattagctaaaatattatcattttaactacctgtgattacctataggcaaggcataaggcaatctactggagatgaattcacgaatggagaaaaagaccttttaaagaaaagtatgtcatctacaagtttcttggtttttgaaatatctctagcaggacattaatccctcaacttctcaagtattttctgagtatctactagtgcaaggtaaggtcctttattcatttttatcctaacatagcctttggctttgagaagcttattgtctccttgccatgtaaagttgtgtacttcctcaaaatactagaaatttagaattttcctaaattatgattttccccaagggtatataagttttaagtctcaaaagcatacatggcctatcttacagcctgttcctagagttcatctctctaagatgagtctgaggtcactctctgcctgggaatctgaggaagctgggccgccggggtgcaagggagacttcacatagggaaaggaggcaaggaaggcttaaagtgagggcaataaaaataacctttacctgtttcaagtcttgggttggcccagactaccaccacttcagggatttttataaaatgctgctgcattgcttttgctaaaagagagccaggtcagcagagtgggatgacctttcccaacagaaatgccatgatgtttagccatcaagcagaaatttcagggacaataagatactgtagtctgcatgcttttatcccaaagtgaaaaccatagaggtcaaaaatatgagttaagggaggaaagaattaaaacttttacctgctctaaactctgaaaagatgatggtgtgttcatccctgaaccttgtctcaacacaatttcagagaactataaatgatgcctcctaacagactactatatgacccgtgactcctgaagtagtacaatgagaaggataaccttcaccacttgcaaatcttaatgcccatgtatatacacatgtacatatttttaattgtaaaatgtgtgtaatgaattcccttcaagatagggaggatataatttcccataatatgtacttggttgctttttatatttttttagaaacgtcaaacttttttcaaaactttttttggaaatacccagtatttttttgctacccaaaacacatgtgaattggagcatacttctttatgtaacaattaaaatgtaaaatgaaccaatttttgctgaaaaaccaatctgaaatgcagtattcacttccctgccttcttaatcaaaggatgatggacataatttaacctttttaaaaaaaataatgtcatggctttcattattatgaatgataattattctacgtcgctgcgatacacagagacccttagggattgctgtggtgtatggagcttcttgcctacacgaagtagtgtaggtgctttttgttttttcattttgagccagctgttcataaatttttctctgtcttttctcactggcatgctgtatgtgggttgccttttttactactgtcgttgtagtcagtcttcctgcttccatcaactcctagccaaacaaagcaagacattcccagtgtgccaaagctcaggcaaattaccttgtactagcattttaggccgatgcttctcgtactttagtgtactacaattaatctggggatcttcttaaaattcagattctgctttggtagctctggaatgggaactaaaaatttgtgtttctatcagcaaccaggtgatgcctttgctgctggtctttgcaacacaccttgaatagaaagatattagctatcatgactttttagaattgtgtctagattaaaagaaaatttgttttgagggagtgattggctactctcctataaataagatctaaaaatttagaatatgaattttaaatatgctatctccaaaatgactttccttatctttatatccctgacaccaccacataaacatatttcccttctctatactaatatagcatttaatttcttcctctcttatggaatttatatatttataacttattatttagatataagtcaagtactgaacatgaagaggaaccaagtcttacatatctgtattttttgaaactataccttgctcaaaaatggttgttgaataactgtagcaattgaaagctataaggttctttccgtataatttcatattctttgttgcatcaatttttcaaataagtaatcaggaaatgagacaatagtataataaatcagtataaatttcaaattaactgttaagaaagtaaaacatgttttcagagttcctgcctctttgtcgtatacttatttcttcaatttgcctcctcccaccacacctcatagaacacacaaatagatataaaagcacatacaatctaaacatatatcatcttcatattctttaatttctaaaaccttatttcaagaaagggcctggaattaacttacactaaaatgtaatgactaactgcagcataaagtatatttcctaccttcaccccaagaagggcttaaacgttttaatagaaatcaaagcctacatagtggaatgaagctgtggaagaagatttttcggtttttaatcataaaacaaaaggtatattaaatagaacctctcctaatactctcacattgggtgatgtttgcactgaacttcccctaactgagaattgctaatccacagctttcctgcacctgggctgtaaagttgctacatagtgataaactgcttgtatcctgatatgatgaactaatatgcacagaaaatcctcactaaaagtgcaagctatagaaacagtcaaggctaaagcagggcaaacacaaaagtcaatttggcagctcatttgaatctacattgtgcttctttccaatggcagacagaatttatcatctactggaaaagaataaaacaaagccccaatttccattaaacatttgtgtaataaaaagaaatggaaattatataactagagataattcaaatatgtaaataaaattgtcaatggaagcagacatcatcatagcttttgagttaatattatgtgatatccattttactaatttcatccagcacacaaatttgctacttatctcacacctctaattaaattagtggccacctacatgaaattcagaatgcactcaataacaggtgcttagaaggaaaaagtgaggcataaaataagatagtcaacataatttacacagatttatataaagttgctctgcatcaacatattcctaaacaatagagattaataagaatatgactctagataatagtcccagagtctagagtcatttctcttgttaacaggatatcaatgtggtgaaaagtgtacaaagggtatctggatctgcctttcctgactctgtagattgttcgctgtgaaaatggctaggatcagctgagaaatctgagcataaaactggtgagcaaggcaggctggaggtacagatgagttctggctgagatgcggtgcagacagctataaaatgaagttcttacagtatttgctttcttggtcatccaggggttgttcaattgtgaaagtcagacaacacggccttaatttcagataagataaaagtcataaaattgttattttcttcccacaacaaaacaaacccaacaagtcagcatattttgctcaaaaggaaagagagaataggtactagcttggcagtgccttacaaatctcagaccattgtagtcagtggctttagcatcaaagggacctgggtttgaagtcacagcccaagaaagcatggctgagctatttaacatctctaatttcagatttcagtgtccttatcacaaactgtggatggtaatctttatctcacagagaggttataggataaataaaataacatttatggattgcttagcaaaatgactgctcaataaatagtatttataactgcttacattgaagacaatcatactgaagtacaaattttatgatcccttccagtttatctgaaaattaaggagatgaagtgaatgcatactaaaattctttaatcaccaggggcttaaatattaaagtatgtaaagcatttagggggtatataaaagagtaagctattatcacagtgagccacagaatgtgttaagaagatagactctggggccaaattatcgcattcacatacctattctgctgctgcccagctgcgtgctttggatgagtaacttaaatgctctctgcctcagttttctcatatgtaaaatgagaataataacatttaatttttaaataaggtaaaaacgaaatgggttaataaacataaataagagattggcacataccaacttctacgtatttacatatatatgttttagagcacacacatactgttgtaaacagaccttagactgataagtaatttctgcctcctatatctacatcttattggaattttctccctttaagcgtggacatgacctgtgacaggcttctggccagtataaaatggcaaatgttaggctatgttataaagactccatcttaggagaaaggagtgccagactctcctgctggccttcaagaagcaagcttcttgatgcaagctgctaatggagagggtcctatggcaggcagcctctaagagttgagggcctcagttctccaaccagaaagaattaagttttatcaacaaccatgcaagcttgcaagagggccctgagctctagaaaggaatgcagccctgccaattctgtgattgtagtctagtgagagccaagcagaggacttagttaacctgtgccccgacttcagtcagaccacatgaactgtgagataacaaatgtgttgtctagagcttgtaagtttgttgtcattcattacacagcatagaaaactaatacacatacttccatatagaattcagagaaaagaaagggaggaaacgaaaaagcttattttctcagtgctctgtcttagtttcaggctgagcagccttgacctggccagtcattgctgagtctatcattgtaaagtacatttaggacagaaagatcttactctagtcaagatttctcctataggccctattttagcctctggccttcatgaatggcaagaatattaggatgtcagtgatagttgtttttccagcttcagattccagttaaggaattttagcaaaacaatatgaactagaaacctttttgagagtgggaatgagagatcaaaatatttgtcttttaacgtcaaagtttactaggttttgctgacaaaactaatcttatgtattactggctttctgatgagcttctgtcatccttccctcatttttctgccctgctctgtccgccattcccgagaaatagactaggagtcaagggatctgtgtacaagtttaagcttggcttgtagttagttgtatgactaaagatgataaagatgagccagctcaactctctcttctgttgacctgaaagtgttgggatgggggaaaatagatgaacaataaatgaaaataaagttcttgagaaaagttacaagggcagaacaaatacatgacagtaatgttacaaaacagtcttgaaacctcagaggaatctaggcaactcttaaaaagcctcaagccctttccaaagtatgaacctgcttatgatttagagtctgggccaaaagatttataggatttgagaaatgagaaataagtttttctctcttagacaactcctatataaaagcagtggttttcgagatagttatgttctaaggcttggtggatgagaataccctgattaattatgcatcaatatggaatagggtccatatataccacttctgtcattagtcccttctgtacctacaacaggtacagagatgagagatcagaggcttggggaagagaaatagcttgttaagattatagagctagttactttcagctgtgggacataattacaaaggaaatttgtacatttggttattcttgttaagtatctctatttgtaatgccaaacacaaatttttgctacttcaaaagctgttttatttcttaaatttgtgatgtctctattatattttgccaatgtgaggaaatgagtgtctaatcttgtcaatgtaatatttattctcaattcctgctatattcattcctcctaatttgaaagttgataaaatctgttggcaacctccttgaagctgcaaagcagttactcaaaacaattttcagaatgttcagtataaatgggcacatgaaccattcttgaaaaccgatgtgcctttttgcttcacatgtttaactaaagtcggttataaattttaaaattatttatttaactttttcacatccttgttttaaaatttccataccataatacagtgttctttcaggatcacatgtgaaatagataatatttccaacatttcatgaggagctatggggaagaaatgatgagcaattccataaggcactgatagacataaaataagagtacatactttcatgtcattccagatagaaatatcaaagatggaacattttccttccccttgacttaacagatgcccactctcatttagaactatttcctgacaatgaaatctagttggagagatacaacataataattcaaacacattgaaataagttttgcactgaggtaaaaaagccacagggtatgaaaaggcatggtgtagttggtgaaagggaggtgaggtattacttgagtaaaaagtttacattggtggggtggcagagataaaagaagatggagatagagataggcaggagttagatcatagtgaaagtcttgtagttattttagggaacccaggaagcttaaatctatcaatcaggatagtgacagggtcagatacatattgtagagacactcttgtgagtaaggaaagactcatttataataaaatatttgtggtagtccatatgatttggtcattctgcaatacatttatcaatatctcaaaactcacaagaacatgtaagcaaaagttaaggtatatatagagagagtggaagaatctttagtattctctggtgtcaatttgtatgtgatttttaaaaattgtttttggaagcattttattttctgtttagtggttgctgtagttttcttgagtcttctccctactgctaatttaggctatttggcatattcagcctcatggttgcaaaactggggttttaatattaaaacttccattgttcatttagatttttccttctgaaaatttgtagaattattcaaggcaatcttttatatacactttctaccttcctttgcctcccaaatcaacaacctgaaggtaggccgaattaatacacactagttgtggtaataatgtagttaagttgacactgtgagctgtggtctaggcagagaatgttacgtgcagagcttctattgtcttctttctcccaaacacagtggtaggttattcacattcattccttgctacacgcatctagttaaaataacttagactttttcaggaaagacaaactgaggccaaaagctattgctcatctcattgctaaaactctggcaacattttctgaattccacagatccacagtttgagaagatgattgtttaacttgtggcatcatgagggcccaacagtttagaaaacagtgggacagcctgttgccctgcagccaggtgataatccacagtaaccaaaataataacaaatattcatgaaaccactgtctttctttttcagctcattattgaatatttgcactgtatttattatttctgctgcaaagaaagtaagaaattaccaaccaatagatcatgttcttatcaagtgccaggcaaaaataattcttataactacacactaggaagagagtaggaaactggtaggaagggaccaaaatgttatacaacaaaatactatgcacgacaaagatatggtatactatagaaagcagattatttttaaagaagcgatatagacttttctgcaaatgttaaaaattgattcttattacttgagaggaagacaacttgctccaattctaaaatggctttaaatcattttctctttttaccagtcaactgctttcctacaggccaataatagcattaccaaccgggacaaccatgagagtctccttactcacagttgtccaaagcctttaggcttcatactgtggaatgtatcatctactttttaccagcattatcttccagaacctagagcaaataacttctcattactactaaaaacaaaacaaaagcacaaccaaaaacaaaaacacactcttccagagcttcccattacctagagaattagtctaacctcttttatagagtttttaatattctctaaacatctgctcaaaattattcacttccctgcattctaattaccttctgcaccaaattctacagttctcaaacacactgtgcatcttcacaatctttgctcatgctgaagcctctgcctcagacgcatttctgctaattctccatctgacgataacttactgcccttttaatgttagcatttttgccacagttagatctattaattttattggaatcaactttgccctatagagaggtttctgaaagtataacttgccaccggtgtccgtgctattaaaaacactcatgcagagaatgcatgttgacacaccttggttgtctacctcatcagtgactaccattgttcttatataacataaatcaatcctcagtaagtatttgtagacatggaacttcctcagcttgttccctttctctttggtatctcttctctccatcctcaaagctcataatcaatggccaattaattcctcttgtttcggcaatgttcctcttgcctacacaatattcccacttccattaccctagttctaattttcattacctccttcttgaactaccgcacttgcttccttagctattgctcagcttctagtctctcccttcttaggccattttgtagtcagctggtgaagtcattttcccaaagcacagctctaataattccattccctggcttaaaaaacatcaattgctctctaatgcctgcagaccaagtccaaactccttagcaggttttctatcatctgcccaccatttgcctttgcaaacttttgttatacattcccattatactcattctgcatgccagtcattccctgaggcattctgtggagtctctcccattccctgacctgatgtatgaattctctcctttgatctcttaggttactcttttcctcaacattgcctgttgatatacccacctttaaagaaacaaatgaaatgcctcttccacaatgatgtatgtcaagaatgtaattttagatttttttgctcctagagtatattcattgtattgctaaaaatgtattactccactttactactattgcatacaaaactgtgcttgtgattcaaatccccctctctgcagggataaatcatgttttgtttacttctcttcctggggttgggccttaaacagtgcaaacacaaagcacaacttctggatcatcagaacgatttagcaatgaaacaggctatctcgaagatgaaaaatatttgaagagaggctagatgctcatctatgaagatgactgaaggaaatgcatgcactaggcagatggtgagattgcatgaccttttaagtcccttacaagtgtaagtttctgtgctatcaagggaacaggccaggtacagtggctcacacctgcaatcctgataccttgggaggccaaggtgggagaatcacttgaggccaggagtttcagaccagcctggataacaaagcgagaccttgtctctacagaaaataaaataataattagccagacatagtagtgcatgcctgtagtaccatctcctaaggaggttgaggcaggaggatcatttgagcccacacatttgaagtcgcagtgagctttgatcccaccactgcactccagcctgagtgacagagcaagaccctatctctgacaaaatgtggtggtcacattttgacgtttgaggggtcaccacccctcgacaggccctggtatgtgatgttcccctccctgtgtccatatcttctcattgttcaaatcccacttatgagtgagaacacacagtatttggttttcggttcctgtgttagtttgctgagaatgatggtttccagcttcatccatgtccctgcaaagaacatgaactcatccttttttatggctgcatagtattccctagtgtatatgtgccacattttctttatccagtctatcattgatggacatttggctgggttccaagtctttgctattgtgaatagtgctacaataaacatacatgtgcatgtgtcttttatagtagaatgatttataatcctttgggtaaatgcccagtaatgggattgctgggtcaaatggtatttctggttctagatccttgaggaatcgccacactgtcttccacagtggttgaactaatttacactcccaccaacagtgtaaaagtgttcctatttctccacatcctctccagcatctgttgtttcctgactttttaatggtaagtgttattctaactcccaatgctgtctacctaatgtgaaagttcaccattctaagtaaccagtcctggctttgttatgaaatttggatgctgaatccaagagattaacaacatgatgacaaaatttacttattctctttaaatgtgtataaccatcaacaagagagacaagattatttatacatcaagatccttgccttattaatttcgtctccccaagtatctagacattcccaaaataggaggttcaatgttttaaatagcattgatacatggttttccaagtgacttgggagtatgatgacatctcctaagcaagagtgattggacccatgatgaattcagtttctaatgaacagaacactagagaactgggtttggatctaacttttggttcttttctatatcctcttggaggtagttagcttcctttactgtttagatgtggaaagggccttgtttgctaagtttggggaaatacaaaaagcttggcagtcaggaactaagcaggaatccaatggactgaaaactcctttggagaaggatgccattttttttttttttttgagatggagtcttgctctgtcacccaggctggagagtggcatgatctcggctcactgtgagctccgaggatggcatcttatggttctttttgattccttcctccctagaaaagtccagaatatgactctgaacactatgtaagatatgcacatagtaatgaaaattaattgacaaaattttctgtggaatctcaattgccttgcaagaaataatacaagtgcagatcgagtttttaaaaccctgcataggaaggagaagaaaatgaacattctgcttcaggattggagttttctttctgatctgctaattctacaaagtatataagattactcaacacgttttaagtggaaagcaacaagcttactctacattatagtagccataatgtcactagggggtgtatgtttggttgtgagagggtgttatcaatgttaattacaaagtttttaagagttgataaatttcttcataaaacaatgacataaaatatctcttcaaggtaacaaatcctgagagtcaaaaagctcaggatggtttcaatcaataactttataactaccaactatttgtttttccaaaattattaattaacaactaagaaattgctgaaagcctccttggagcatttttacaatctttgtatagaagtaaatagtatttatgatagtatcgatatatttggactagactttaccatggctatgggacctgctatagttcttgatgatcccttgtcatgaatggaacttaggtagctattgtcacaatctctgcagtcactaagcatagaaagtcctcactaaatgcactaagcatagaacgttctcactaaatgcacaagattcaaataagatggtattttccaattccttcactcagtcacttatatgagggctaaagccatggtaacatagaggctcaagtaacttaaaaaataacatatttgaaatttacttgctggaaagggacaccccaccttgattttaatgaatttcagagcaaatacaagctgtcctcagtggctttcatatgaattccctgcacagtcttcttcctttagaaatgcaaaaactatttcaagatttttatgcctgcatggagaaaattgctattgtgtacaattagcatatttactaaggtttgtcattacttttggtaattaaaatcgtacaaaaagagagacatatccaattcaagaaaattacacagtacagtaatatacaatcataatagtcgcctgacaattattaaaatacaccaagttctcccttacagtaaaagtattcaccagagtagcttctgaataagatcattgcagtgctttctatttaaatgtttttctgcacagaaaattataattacatttgcataactactgtaatcaatctagaattatggctgaaatttttattcttgaaatcactgttctttctaagatagtaggagctctgaggcataatctaggtttgtgggccattattctaatttgtaataggattaaatatatttttgcactctctttacaacaatcaatcactctagagacatagcagacgatacaactacatcacacaatttgttttcttctgtcttgaaaaaacaaaccaggctttaatttaccaaatccattttgtccaaaaagcaaaacaaaacgaactcaagttaaaaaaaaaaagtcaaatttataaaaggagaacaccaaatattatttcatgaaacagactcaataagaagtcaagcattcatctctacatttagatgctctgtacttactgagattagctgggatggccgagataatttctgtcccatcatggaaatactggctaccataaaccaaagatttcttttgaatgttctcctttactcctgctgtattcaacaggcttccttggagcctgatgttattgtcttatctttttaaaatatccaagtcagatctgatgaaaacgataagcagacctaaatacattaatctgcaaccagattctggtagagctagccttttgcaacgataactctaagaaaatgccctgctagccccttcttctgaccaatgagctgataatgtaagaccctcacagacaccatctgcatgcattctctctcaggagtgcagagactcagacactgtagcaggccagagaatgaggtgttctaaaatcccctctctctggtcctgctgcaacttgtttttggttacacagcccagctcctcaagagaatgacatctccagggatcaggccataacaaaagaaattctcaatagcacaaacaatatatatttcctgagaagcacaacataaagtcactacagaaagctaccctgaagcatttctctaacatgtggtttcaaaatcatttccatgttatcaatgctaattataaagtttttaagacttgaaaaatgtctacatgaaacattaatgacataaaatatctctgcaaggtagcaaatcattgagagtcaaaaagctcaagatggtctcaatcaataactttgcaactaccaactatttgtttttccaaaattattaattaacaactaagaatttgctgaaagcctccttggagagtttttacaatctttgtatagaagtaaatagcatttatgacagtatccagataagttcggactaggctttaccttggctatgagacctgatatagttcttgatgatcccttgtcatgaatggaacttaggtagctattgtcacaatctctgcagtcactaagcatagaaagtcctcattaaatgcaatgtctttttaacaaagatattaaactgaactcaatattttcatacttttttactttggaagatttggagctgtgctcaaaattgtacaaggaactgttttaatgaccaattaattcagattggcagatacacagaaataaacatgttcagagaataacagcaaagactacatagatacccatagattatgattgacttttggtgagaaactcagataagctgaggacaaacattaaatcagcagtggaattataaccttacttatctttgtgctcaagtgtttgtttataagcatagataatacctacctaagaaaaatggagcccagcaggcagctagatttatatttatataattttataaaataggttcttgcctcaccatcagaggctggtcaagttgccagcctctagaaaacattgagatctctaggtatagatatatccttatttggaaggtgtatgaagccaaaataaagacaattccaagattcctcttctttaaataaggtgaagacccttaaagatggagaaaaatagtcaaagaagaaggcaaagaatcatagaaaattggagataggtggatgttaagcacattttattttttattttcattttatatacataaaaattgaggctcaaacaaatgaatattcttagtcatgattacatagccagcaaatgcattgatgaatatacagctaaatcactttccattatacaacactgaatttgaagaaataagatcacattatggatgtaaggcaaacataatagcccagggtcaatatggcagagaaataaaagttagcatttttctatcttaaaagtattctggattttccccccatcttcataaggttggtaacaacaataatggttcatggacaacctagaatatttcatatttaaactagagtcttttctcatggaaaacaaaccatccatgtcttgatcaaaacaggggcatgaattactagaagaataagagcaaagaagaaataagcataaaatgtttttcaaggaccatcttgagataatactattataactgcatttacaacttgtatgtctttttaaatctgatatttgtagtagtgtatagattagcatacttatggaacaaatgtgtttctctttgtttaagacaagtaagttataattcatacaaaatattagtcatggtgtcatctcttcaccaattctattatcatgtataggtcacaagctatttctggttttcatttttctttaaaaaagaaagaagagcttgaatagatatagcattttgaaaattttgtcctgaaagacttttccacctccattcatcttacagatctgataatttttcaccaaggaaacagtctttgtcctggagtctcatatggctcttgccataacagtatatccaaagattcattcatttatttactcactgaataaatgaaactctacaaggcaccaagttctgtaccatggctatgtatactgttaaaaacaagaaaaagaagtagttgaccttttagaatttacactacagtgaatgggaaaagtccattttttttataatgtagttttcatttgagtattgttttgtattattaatagttaacccatggaatggaatggattgcactcctgaagtattacttctgtgggaccttcaatgcttgtggctgtgtccttctttgctgtggcacatgctttgctagtggaaagaatttgcaaagcccttttgtgggggagaaaccctacctgcttgggatctgatctgaaaacaaaacctacatttgttcatcaccactacctcctctctaaatcccttaaatatccctctactaacagtcactcaagatcatgatttaatcatttcatgtccaataaagtattgatttcattttcattggttatcttttatatgatcatttagccattttaggcattatatcttcaagaagaaggagatttgtaaatactacaaaggggttttcgttttgtgttgttgagatattactattaaagtttctttttttttttttggatacagctgtgtaaaataaccaagatctatttctcattctagcatgtggtctcagcattctgtacaaatgattttactggcttcgtaaactcccaagttaaagaatctctttaggaagaatcttaattgacctcttgaattgttggcctggtacccagagtaaaagaattgtgttttaataaggattacttttgtcgtggtttattatgctttagcaccacacgctaattgatgtagttgcaggaaataaggtaagacatgccatggtttggttaaaagcttcattacatgtatttatgaagagtcttatggatgaaataatttacaacatctattacatatattgaaatgtatgctactgcttccatttcttataatctgcggaacccaggtctgaaaccacttggtggaaaacgtttttaaattttattttggtaccaagtggcaataacaaaagttcaatgactggctgagtagcaatttggactgatttctaaatgtgggcacagcattaatgaaagacatttcttatttttgagataaagcaaacctacatgaaagagaaattacatcatttgggtactagtttcagtgaatgcctgacaatgggggagtcggaagagtggtgtaatgacggaatgctaaagctaggtgagttaggaagggttatttggagataagccttgagtaggacctcaaagaagggaagcaatgtggataagctagtaggaggctgatccagaagttaaatattaaaagtatagcactagagatagcaacaaccatgtgtctagactaaagagcttgttttttttttgtttttgtttttgtttttagaaatgagtatggatggagagaggggattatagcagagcgaatagtgttgaagtcttggtggggacattccgatttaataagtaagtatagtttctttatcaagagtaaccattcgaaaatgctatttgaggattagttaccaatgcaactaaacttcataatgaatgatgatcatggttagcacccactaagtgcttactatgtgttatatactattttaaaaacttcatgtatgtccttgtgtttaatccaggattttgtaaccatgatgcaattgacatttaggattaggcaattcttacttgtgggggactgacctgtgcactgtatgatggttagcagcatccttgacttctattcaccagatgccagtaatcacaccaaaacatccccacacaaccacaagttgtgacaatcgaaagtgtctccagacattgccaaatactcgagggcaaaatctccctagttgagaaccactgatttgttcttaacaccacgtttcagttaaatttcattaattctttttttattgcctctttttgtagttgaggacatggatgctaaataacttgcccaatgtcacatggttaataaacaaattttaaagcctccctgtgaactccagcgacttaattctagggcctggatttgtaaccactattgtctattacatccccataatctttctaggcaggaatctagcataaacaaaaaaagaaatagcccagtgtagtaagtctcgtttgaactgatatatgaaaaaaatggcagacatttaaattttaggtaatgctatcacagccggtgtagtcaagacttctgtcttttgttttgcaatttatcaaaaggctgactttctcatctaatcctatttcagtggtatgttctacataatttttaagagattttgttgtatctaaccttaaatcaatatcacagcagttttatgattttttagtgcctctctcatcatttcttctaggctttggctggacaaggggaataaaagccctgtgtttttccacaactataagaaatgcaattatcagagcatatcttgtactttccaagtatccctagattgtacaatatgcctaactgtcctaacacaaggggacacttgctgcacactttatgattagagctgttccatgttcctttaacgatatgtggaaagcaaggaaaagaatgctaggagggaaaaaggtctctcctttctttgatgtggaagttttgcaaatcatatagtgagacctcctaagagttcatctcactctaggcacacaggagactgtggctggagtagggaggaagaaatgagaataacatagaaatgattataaatggtcacagcctgtctttggctagaaaaataaacagggatttctgccaaaaaaaaaaaaaaaaaaaaaaaaaaaagacctgggcttgggaggaggcagcctggccctctgtgtgtggcctctgtttacccttctgtataatattatgacaggtccttttcaatgataatgttccatgcatcagtaataatgaatgaaaaacaagaaagcacttgcagggtttgcctattaccttaaaccactgaacatcatagagaaggcagcagatgtgacagacaaaaagagattcatagattaatatagctgaaagcacactgacagccaaaagcatgttttttttccattccagaaagttctacctgtgaaatctgagactctgccttttcatctataaaatgggataaaactatcttgcaggattttgtgaggcttagataaaaatctccaaggagatggaatttccaacagtatccatcaaaatacaggcactcagtaaacttacacgggctaaatagataaatagttttcaagtgaaaatgtaattgtgaagtgcagtttagttctctttgcctctctagggctttgtagaacatgaaaaaaagaagtaaggatctttttattttattttttattttaacaagacccatggactaaaggtaaagagtaatgcaatttaaaggaccaatgcaactaggtaggtaaagtcctacctagactcagaaagtccagacaccagttacaggaaacaagataaaatgtatgagtctcaggataagaccgagggtttcaacattactcacagaaggcaagatgccattttctacaaacttaggggcctttctttgcgtttagtcaactaaacttgaagtgagagaaggaactcaaataggagaaatggctaccatttctttgccggtgatgggggagaagtgaaagcagtggggctatgtattattctgttctcaccctgctataaggaactgtccgagactgggcaacttataaaggaaagaggtttaatttactcacagttccgcagggctacggaggcctcaggaaacttacaatcatcgtggaaagggaagcaaacacatccttcttaacatggccgcagaagagagaaattagtgcccgcaggggaaatgccagatgcttataaaaccatctgctcttgtgagaactcacttactatcacgagaacagcatggggaaaaccacccccatgattcaattacctccacctggtcccactcttgacatgtgctgattattacaattcaaggtgataatcagagcgcagacacacagccaaaccacatcaggctatatggaaaaaaataaatcaaagaagtttgtcctcagacacagaagcaacatttcacgttccaagacattctacaatgaagtgagaagcctggcacttccttcctccacttccagacttaataactggtagaacaataatatccgtaagtaacaaagagcctggaatggatgagtctgacaaagcccatccatcctgccacctcacaaactatctatatttgttcttttttctccagctttggagacagaggatgtgttccagctcacagactttcaggaataatactggaaattgacatctaatcagcattttatgcactataattgtgtaaacttttaggcctgctgtacaataatccttccctgctgtgtggtgagcactttggggccctctggatgctagatgtgatatgaatgggaagcattattattatttatgccttataatatgtcaactctatgtcctctgccacaacagacacttatttcaaatgtgcagtaacagcccccaagtgatgtattgtcaaaatatttttgaaatgaaaaagcaaaattaaccataaactgcccccttgtctccatgaaaatggcactgtaacactaccaaggaaaagcaatgttaaataataaaagctacaacaaaataaaagtcaaaaaaaattggaagagctctgtgtttggaagaagtatgctttggtaaatcacaacaatgacaatttcgctttccaattaaagtgtaatagtgaaagagcaaaccatcaccccagggtatcctcaagaacagctcaatgaattctggcttacttaaaaagaagttttcagtggagctgtttttcttgcaaaagattttagaaaaaaacacagcctttttttttttttttttggatttacattacgcgaaccctgatattatcagatatcatctaatgactcatcaattcatacagacctttaaggttggaaagcacatatttaaatatatagtagacagcaagtaacaaatgataggaactacattttagtgggtaaaatccttctgcaccatcaaagactttctaagagctatgggtttattactcaggtgattcagtttccattttgggacaggtcatattaattttcaggatcttttcccagaatgttatttaattagtgtgactaaatatctgaatcaggatgctacggtatttttaaaaaggaagatgtcgatttaaatgtgatagatacttaacagtttgataaacttttaacagactgtaaccttgatgctttccctggtgtagggaggcatccaagggaccctggtgaactgaaaaagttaatgcacttctctaaacattttgagtctggcagaatctggaactataaaataacatttcttcattaacatacaagtcacaatgctattcccataaagcacctctagcatataaggctggacgtttttcagaccatcatttatagggcgggtttatttttctttgtcttgacattaatgagctatgtattcagggaaatagaagatttcaatgcctgtcaaattacctttcaaattaccaaagcttgcttttctcctactcaaagagcaagcagggacttcttttagaatgggggaccaatggaatattcagtaaaaagggtcatgaaaataaatgtgaaggcagtaatggatccattccaaccatgacttcatgacaaaatgctgtgacttcagcatttcattacttgccatgttctcatcctttgtattattatcacacctcccctctctcccacgttattacatctttttgggaaaagaagatatgtgaaaatttctgtagttgtatgataccttgttctaaaatttagactgctgatttgatatgaaacacataatgtttttatagatcaaggctgccagttatttgtaaccattctgttacaaaaatctttcctgagcaatcttggtatatcatcttctgccacatccttagcaattaactgaagctaactgtttcactaacatttccttttccatttatgtagaatgggctgaatgtgttaatgcaatataacaagagaaataggcacagaaaaatcctctttcatatcgatctcagaatcctgtctgtgtctcatttgggatgaagagaaaaaataatcaagaaaatatgtgttggcagggttaagaatacaaaggaaatattactggaaaatatttaataggtaaatatagatgagggaataggcacaaggttaggtaacaagcagattgaatttcaaatttcctaatgactctccctgttttgcaaatccttccaaaacattacctcatctgtgctttcatcatccctagggtatagggttcgattactcatcctatccctttgcacaatggagaaatttacatgtattcagccctagccgtccttctagtcattctctcagtttagtacttacttgttttcttatttgggttttggcctgttctccataagtttgaaagctgtttgaggacagggatatgtttattctgtacttttctggtatcctcgcttggaaatttagtacttaagagctaggtcgggctgggcgcggtggctcacgcctgtaatcctagcactttgggaggccgaggtgggtggatcacaaggtcaggagttcaagaccagcctgcccaagatggtgaaaccccgtctctactaaaaatacaaaaattagccaggcatagtggcgggtgcctgtaatcccagccactcgggaggctgaggcagagaattgcttgaacccgggaggctgaggttgcagtgaaccgagatgctgccattgcactccagcctgtaagaaggagcaagattccgtctcaaaaaaaaaaaaaaaaaaaaggaggctgggcgcggtggctcaagcctgtaatcccagcactttgggaggcctaggcgggcggatcacgacgtcaggagatcgagaccattctggctaacacggtgaaaccccgtctctactaaaaaaatacaaaaaattagctgggcatggtggcgggcgcctatagtcccagctactccggaggctgaggcaggagaatggcgagaacccgggaggcggagcttgcagtgagccgagatcgcgccactgcactccggcctgggtgacaaagcaagactccgtctcaaaaaaaaaaaaaaaaaaaaaaaaaagagagagagagagacctagggagctacgtcctcattaactattataaggtggtttcagaggagcatgtagtgcactattgaagctcaggtttatcttaataggtgtatttgtatacattcattaagtatacgcagactaggcactcctcattttacactcaaaactcaagtagctgtaggactaaattacttatgattttgatttataaacagcagaagaacaatgggtaatccatattaaaaatgattgtgtatcatctcctaaagaaagcattttgaatacgtgtttatcctgttcttaaatggttttactctttgttatattcattctaattaaactgttctagtgcaaaaatgctaaagcaatttctgtagtttcattttttattctaaaattcttaactgtatactgaaagtgagcttatgaaacattcttgatatgaaaactcacaagttttcaaacataattctttatctttaaacacaatacctacctgaaattttgccagacaggcttatcctcagagtatgctttagtaggttaatactctgaagaattaaatgtaattcacatattaactactggtagaaatccatgtgcaatcatattgtttacttgataattccatatacatctttaaaatcaaaatgctctgtttcacttctcaggagcagttctgacacattttatactttttgcagattcaggattagccaggtagagctagcctgtgttggcttcccagttaaaaatcaataaattttaaacataaataaaaagaaattctctctttaaaaagtattttgaatttctatatgtgtgtgtatgtatgtataattacagtagtaaaaattttattaaatctctaccaaaatctctcctgacacattcctttctctttctacttttgagtaactataataatccttctcaatttttctagaaaaagaaacatgcattcaaactgatctcagaaaagaatttttctcatgccaagtcaaacaagttagcaatggtaaaatatatttcattaaaattttaatctagtcattaggtagggaaggttaaataacttaagccttttcttaactattaatagataatgtcaactcttgcctagcagcttcaataagcttttgcaaagtgttgaattccagtaagcactttcagaaggggtaagatgtatacgtgatcatctacttaggtcataatactgcacaaatagtgctaatgtgaaatatctgctgggatttttagtacaggttgtttttatagtttaaggatcaagttgcttagagagtgttcacttctctaagacatacggaaaatatctatgaaactttactatctgaatgtgtactacctgggcacactatatatagctagtatagcaggatggaaacttcttttggttggaaaatgcgtagacacaaatgacaaaatcaagtgtaagcaaagacagtaagcatattggaaattatcttggacaaagagaattttgcatttcttttgaatatctcctatggaatatatcacatagttactaaatgcttcccgttgagaaatagtgaagaagtatttttctaagaaataaattattagagactcaaatattaacccttattagccatacttacaagagacaaggatgttagttaaagccaggagaattctttagtgctgtctttctagacgttagaatttctcaaatgtattcagtaattaaaaacattttgaaaaatttttaaaaatgtaatatacaatcattttaacacatattttgctaaatcatctattcagaagtcctctagtttctttatgaccctatacagaagataattcaaaaccatggctacaacatatatgttaatggtaatatttatttatttatttagagatggagtctcgttctgtaacccacactggactgcagtggcacgatctcggctcactgcaacctccacttccagggttcaagagattctcctgtctcagactcccgagtagctgggactacaggtgtgtgccaccatgcctggctaattttggtatttttagtagagacgagatttcaccgtgttagccaggatgatctcaatctcctgacctcatgatctgcccacctcagcctcccaaagtgctgggactacaggtgtgtgccaccatgcctggctaatttttgtatttttagtagagacgagatttcaccgtgttagccaggatgatctcaatctcctgacctcatgatctgcccgcctcagcctcccaaagtgctgggattacaggcatgagccactgcgcccggctacaggcaattttttaaaacctgataaatatttattccttattgttccagtcctggatattaacttctagaatttaaaaaaggtgataccttagtactttctgatttaaaaattttattagctcttgtacttaatgattagatacatagaatgacagatcttctaatacaattaactctgtaaatcaagaatcttttcttccccaaaataatataaaaagatataaataatttacaaaagcaggggattacatttagcaccaattcaaagttcttgtgaaaacaattaaagaatgtgtgcaaaatttcaaaactgggatacaaatctgaaattttatagaatcattgtcaaacaattgcagatgcaagaatagtatgtttgatttatttcttcatactttggaacagaatcaagtttgtataaaaaaatcaaattctcaatttttacaaaaagagatgttttgtatttagttatactccataatttcctttcactctttctatgaaatctgtgatgagtagtcactgaaatatcaagacacaacaatgttagactttcattcagtggcctgtaaatttactggttgccagaatatcttatatagtaggtaaaaatagagcttctaggaagactgaattctatccttagttaatgctgaggttcaggctacatatattcccaattgttgctgaaattaagtagtactacatcattctgtcacctgccaagggagtatgtgtccttccttcctcactgatacccagggaagaaacaagaatgcactgaagatagtgatttgcagcaggtgctgaggctcccttgatatatgtacatatacatgtctgactccataatatactggaacccataagaaaggcataaattactaccaagtgtttctctcattcttcctggaaagaaagtcctactactttaccttgcttagtaaatctaggtgctgctctttcctaaatgaaattttgattaagaattattatatctgaaactcctttaacctccatcacttctctttttcaatgccatttgcaaatatgtgctgtaagatataaagaaacactgataagattacagttcccctggtactgtccaactaaaaaggaacccaagaacatttaagagcctggtgtcattttttttttctgggaaaatacatcccattttttctcctgtaaatgctttcaacctggtgacctatgacagctttgcagtgaaaatcttgaactggtttttacttactttgaataaaaggttaatacaaggcttcatggaggtttaatcagcaccacattcaaaaatgagggaagcaaaggcaaagctaatgaattgaccttttaaagagcaattcaatgggataattgccatagcacaattcacttcggggccgaatatgtgtatatggctggtcttccttggatccaatccaaggacatttaagtatgtaagtaccaaaatcatggtgggttggatgaggtggacaacaacatcacatacaacctagtggacctcaaatacatttttcataaaagtaaagctgtgctttcacgcataattttaacctaatcaaccagttcatgtatgccaccaagaaaaattaaaacattattaacattatctgccatctgtgctaaacactttatatttgttattttgtacaattttcatagcaccccaggcattaggtgtttttattcctattttacagatgaagttggatgtctgtctagatacattgccagttcttcctgaaatcaagtagttattcatccttctgttcttccaaggaattgtgtgtcctacctttctcactgatacctagggaagaaacaaggatacactgagaacagtgatttgtagtaggtgctgaggctggcttaatataggtacatatgcatatcagaggggtttaaataatatgcctgatagaccacggtggatgacattaggaactgagactgaactttatctaacaagaccttagaccgtgactactcacctactcttaacaaaaaggacaggtttttgccctgagtgtttttctaaaacatcttacatgtagaagtacccccaaggttaaactcaagataataaaaaggtttccccttggtcttatgccctacttttcctacctttatatttatgagaaacattacaatatatgtgctatcttataggagaaagctaacagtttcctttaaaggggggaagattgggcttttttctttaaatcaattatggctgtggctaaagaattaaagtttgagtgcagagaatcaggttttagtcccatttctgcaactagctttgtcaccagagtaattctttttttttttggagacgaagtctggctcttttgcccaggctggagtgcaatggtccgatctcggctcgctgcaacctttgcctccaggattcaagcgatgctcctgcctcagcctcctgagtagctgatattacaggtgcacaccaccactcttgactacttcttgaattttttttagtagagatggggtttcatcacgttggccaggttggtctcgaactcctgacctcatgatctgcccacctcagcctcccagaatgctgggattacaggcgtgagctactgtgcccagacaccagagtaattctttaggttactcacctataaagtgaaggttctgggctagctgatgaatgagattcacagtagttttcagatggtgtgatttcagtactgttcactcagcctatatatctacaaacactgcactagatactgtgaagagatacgcaatagctgacaagacacaggttaaattctgaatgggtttataatttggcaaattgggggtcggcagtgagtgaggtagagagtggaggtgcagcaacaaaaaatgttcttttatgaaagataatctttactaacccactacacctgcgatgttccttttaactgcatattcctacaatacatatatacaactctatccaaccacggctttacaatcagtcccaggagatgatttgtaaacaagatttggggaacagtagcaaatatgagtaggtagagaaatgaaattttaaagtaagaagactggcttatacggcgacaaggagttagagatgaggagtcagacatgttgaaatgaatggaacttatatttagataggcacataaatgacatgtgcaatgtcatatgaaacaaagctgctataggtcatggaagccacaatcttcaggaaagtagctaaagaaattgaggtggcagtgggaagagtaaatcaggaccagagcgtatgtaagaaaaatatgacaatgtcaagtagcagaaaatttgaaaatgctttggggtatctacattttaaaacacatttctggaagtaatattagtttcttaagcatctatagtgccaggaatgttgcatgcatcatctgtcataatttttacaatcatcttgcaaactcagatatactttcctattttatgcatgcttaagcaggttaagtggcttgataaaggtctctagctagtaaatgagaaagccaggaagagatcacaagtgtgccctgcagctagtaccacgtcaagtcttactccccaattaattttgcaaatatgaaaagtaatgactttagcctatgtggcccaacttcaggccagtcccaactgggaagattttataataacttcttagaaactgctactggctctttctcactggcttagtagtggatattaatctctttattttccatatacaggcatatggcttgcagacatggcatactgtgtgcataaaaaacttccttagaaaatacatcatccaagaagcaggaattgctgattatttcattactgcagcaaactcatgtttctaccatcccaagtccggactctgtctacaagagtagaaaaaatccactagatttttaattcaacatctattcaagttttgaggcacatgctatctgaaacaccgtaatttttgagtttgaaacagagaatttttctttagcaactttggccctgaaatgtcctccaatctcaatgtcaggaggtttgctacaatggtctggagagtgtagtttttcataaaaatatgttctatttttcaacaccaaatgaatatctctttcctgcatattgctcaaaatagccatttccttcacatggttatgttttattactcatgtcatcagatctggcaatgtgagatttatttagggggaacatttcatcaattacaaaacataaagcatgtgctgtctctcaatgagttcagttacatcttaaataagttctgagctgttgggagaattacaaagaacacacttttcctgaaaaccattaaaattgcatactcatagaattttaaaaaaattctatgcctgaagttttaatatttttatcccagggaagtggattttttcacttcctttttagattatggccctgagaatatatcacccgaaaatgaagcatgaaaaacaagacaacttgagagcaactcacagaaattagctgatttcatgatatttatgtgctactcacttgcattgtttaagtcttttcttttctttttttttttttttttttttttttttttttttttttttgagacggagtctcgttctgtcacccaggctggagtgccagtggcgtgatcttgattcactgaaacctccggctcccaggttcaagcgattcttctgcttcagcctcccaagtagctgagactacaggtgtgtgccaccacacccagctaatttttttgcatttttagtagagacggggtttcaccatgttagtcaggatggtctcgatctcctgacctcatgatccacccaactcgggttcccaaagtgttgggattacaggcgtgagccactgcacctggccctgtttacttttttcattgactctccctgccttaagagtaaagctcaagtttctaccctgtcctgatttatttccttctttccttccttccttccttcctccctcgctccctcccttccttccttctccttccttttctcttttccctttccttcctttgttcgttcccttccttccttcgttgcttccttccttccttcctccctcccttccttccttcctccctccctccctctctcccttcctccgttctttcctttgctccttctctccttttttgagacagtgtctcactttgtctccaaggctggagtgcagtggcactctcatgactcactggagacttgacctccgtggctcaagcaatcctcccaactcagctcctgagtagctgggactacaggtgcatgccaccatgtcctcctaatttttatattttttgtagagacagggtttcccagcttggccttgaactcctgggctcaagttatcctcccgccttggcctctcaaagagtgggaatatagatgggagccatggcaactgcctgagccctaccctgtttttgcagggccctgcatattgtagtctctgtctcctaaacaggggaaacttctatcctaacacctttgctcaaactgtgcttgccacctagaatatcttcccacatgcacagttatgggaagcctccttataccttaagggccttgctccagttgtaaataagccccgattcctattatgttgtgttagttttctctgggctaacattctgtcttcaagatctttgtgtttagatcctttgtatgtttcaatgtgtcttgggcataagtactgagagcacaggttaaatgcaaaggtgagagaggctgtggagaaaaaattaaaaaaaaaaaaacttttggcatatttagaagtcactttgcttctcttactgtcaatgctcttatttctgccctagccataactgtaagaaaatacttaccagttgttcaaagataggttgttcaaagtaaaacattaaaatgttgctctttaaaattctttttgtggatatactgagggagcttttataatcctataaatatagagaattgggtgcacatttcttctttaaagacaggtttttacccactcttcctaggtatctaacaaggagacatcaaggcattttaaaacaaaagacccagattctaaaataataatgtctttttttacactcaagattccaaacacaatttgactgaccttcaacagtcttgtaaatagccatatctagtctcactccctatagagagaaaatcaacagcatagtgtgtcctactgaatattatataagttgttagtatcagcattaaaacaagggagtcttactccttaggtgctgctacacatcatctggataggcaatctctcagcacaccacctaggccttatcttctgcacattgctcaggctaaggccatgcctggcaggtagtcagtatgcaacaaatgagccatcaaatataacaatataatgaaaggccattaggtagtctctagaaatatctgtccttaatcttacatttgttttttctcactgtatgtctaaacattgctagtttatcccagaaacctagttgcttcttttctgacagtggttgtattaggtaagatgggattgataaaataatcttggaatcttaacatgtaattaggtgaacaataaaactatataaccaaggaaatgtgctgggttcaagcataatcaagatacaaaatttgtcttcatggagcttgcaatgctgttagtgagtttgatggtctgaatgtttgtgttttccccaaattcatatgttgaaacctaatcctcaatctgatgttattaggaggtgaagtctttgagcagtgattaggtgttgaggatggaggcttcatgaatggaattagtgcctttataagaggctgaacaaaccagagttcttccttttcaccatgtgagagacaacacagctaaaagacagctatctgtgaagcaggaagcaggccctcaccagataccgaatcagctgccaccttgatcatggacttctagcctccagcattgtgagaaataaatgtatgttgtttagaagtcacccagtttataccattttgttatagcagccctattggactaacacagtgaagcagtcactacggactgaattaggtccctgcccaaatccatatatatcaaagccctaactcccagtgagtttgtatttgaagatagcatctttaggaggtagttaagattagatgaggtcttaagcatgggatcctaatccaacaggactggtggccttataagaagaggaagaggatgcacacacacatgctctccatcctacacgcaggaactaaggaaaggccatgtggacacacagcaagatagtggtttcctgcaagtcaagcaaagaggtctcgaaatgaaacctactttactggcatcttgatcttggacttcttagcctctggaaccgtaagaataaatttctgttctttaaatgcccagtctgtggtggcccaagcagactaagtcagcagtagggcacattgggctctgaatttaatatgaataggtttcaccacttgtcaactatttgactagagggactttcttagccttatccttaataagcccaaaggtcttttgaatgaaccttataagaatatctatctacctcaaaatattattgtgacatttaaaggagaaaaataaaatataaaatgccagctccatgccaaaatataaaataaaataaaatacccagctccatgccaaaaatgctcaaagatgcaaatgcaagcaggcatttaaaatgtctgggtaactatgtgtcaagtgggtagcagagacaaaaggactgtagaattttggaggagaaagagggtctctttggttggaagaatcaaagaacattcaagatagacttaatatttatctcagcttgactaaaggttagacaggttgcttcctgactataggcccatgaccttcttttccttagagcctttactttagaaaacttgcaattataaattctttctctgccccttttgaaatgtatctaaacctccttaaaagcctctggccagttctatgatctagggagtatctctctcaaggacctgcatgccatacttttcagatctaattatcaagaaagatagtgcccccatctcccagtctctgtggacacataggagtctatcataagtgaacaattagaaactataaaacactttatgtcatgcatatgtgagaaagtttactttctcctcctgtaaggataacaggcaaacacaggtggcctatgattctcctacatctgctcttaaaaactgtccaacactttgtttcttcagagttgagttcagtttctctcccctattgcaatagccttgattaaagtcttccttgcctgtgaaactttgtctagcacatttttctttactttgacaggaaacattcatagagaatatacaacttgaaatatgttgtaaggtatggcttagatattggtttggcaatgtataacttaaaatgaaaagctgcatgcattttcatgttagcagtaactagttatggcatgtctcaatgctttactcaagagttttcttgagatctttttaatatatattatttcaacagttactcagcacaaagtaagtattttttcaggctcaaaatcctgcactaacattgtaagctccctatggcactagagtttgtatatatactttcaggcagctgaagacataggtaaatctttgcaaatggggagagagggggacaaaaaagggttcctggctcataattttaaagcactacccacagtgggactgttttctaaagaactcttaagtatgcagcatatatactaacatgtaaagcacaccttttgcactaatcaaatgtgaagttatataaatttaatatccaatgacttaagaaagtgggatgccaacactcatctttatgactaaagtatacaattttatgaatcaatgtaaagaagccagcatgcttggaaggaatcttttgctcaaactcagattatgttattacactgctaatcttggtgtgtttttttaaaaacgtaacatccttctaatcaagcatgattagttacaaatagaatccaaagaaatatctcaaatgactatatatctaaattatcttgcttattacttatgggatatttttcttatccatatccaggttaattacaatttcagaaattatctgtacaaatgaataaaattcaattctcttagccaatgagttactttttccagtgtaaagtacagtcatttaggcattcacaatatatggaatttagaaatcttttaacatgatgaagttgaaaaaagtaaacaaatattactttgccaattctccaccagtcagaagcttgtctatatactaactgtgtatttagaaaatatcaatgcataaggaagagaaatgcaatttgtctcatccaaacgcatcatataaaatgaccaagtgctgttaagtgctagagatgtgtctcaaaagactctcaatgtctgtatcattttggggttgtttggaagttaaacccttttagtaagaagtattggaagataaatctagttctcagcccttaattcgccattcactggtgaggtgttcttattagagagcatgtctcctggtctcactagttcctaatgaatgtgtctggcctttcctagcaatatataaattctgagaaattggaagacatgattgctccctacccaattctgaaaagagtgaatatatcattctttgtaacagatggaatgtattaaaaatatatcaatatgtgttttcataaaaaagaaaatatctaccattcaattagaaaagtattttggagaataataaaaatgatagatatgctattttactgttactagccagccattattgttagaaagaatatgattctaaatatactgaaagtctggtgacatgtacaagacaggaaaagcacctttattcactcgtaataaatattttcctgttcattccctacataaactagaacaattaatattttcctcagctttcctggagaatgagatatttgacctgaaactttctctattgtgatactgctagcattaattaagtggcagtattcaagattaattggagacaagaagactagttgggaaattgttttgtcataaagtagaaaatagtgccatgatggaaggaatggaaaggaaattcaatttcagaaatttcacaaaggaaatatggttagatcattgaggttgaatttgcagaatttagtaatatacaccaagattgcaatttgagagctaaaagctgtttcaagttcagtgttctatggactaaactgtgttcccggaaaattcataggttgaaaccctaacccccaatgtgacttatttgaagagaggaactttaggaggtaaagttcaatggaattataaaggtggggccctaatccaataacactggtgtccttatgagaataaaaagagacaccagagctctttttccctgtacacagaggaaaggccactcagagagggtggctgtctgcaagccggtaagagagctgtcatccaaaattgaatggatggacactttaatattggactttccaggctcccaaactgtagcataataaatttctgttgtttaagctactcagtctgcagtgttttcttttatacacacacataatacacacatacacacacacacacgcccccatatttatatactgtgtatacacattatatatatattttgttatatatacatgtatgtatacacacatatatatataatcttattaaaatcttatatatgttatatttgtctctattaactaaaatttaagtaccatgagggcaggaattttaatctattgtgttcaccactgtttctacactgtctaaaacagtgcctttcccagtcctaagcaaaaagaacaaagctggaggcatcatgctacctgatttcaaagaatactacagggctacaataaccaaagcaccatggtactggtacaaaaacagacacatggaccaacagaacagaacagagagcccagaaataaggctgcacacctacaaccatctgatctttaacaaagctaacaaaaataagcaaagaggaaaggactccctattcaataaatggtgctgagataactgactagccatatgaagaagattggaactggaccccttcctcacaccatatacaaaaattaactcaggacagattaacaacttaaatgtaaaaccccaaactacaaaaaccctggaagacaacctatgcaataccattctcgacataggaacaggcaaagatttcatgataaagacaccaaaagcaattgcaacaaatgccaaatttgacaaacaggatctagttaaaccaaagagcttctgcacagcaaaagaaattatcaacagagtatacagacaacctacagaatgagagaaaatttttgcaaactacgcagctgacaaaggtctaatgtccaccatctataaggaatttaaacacatttacacacacacacacaaacccaattaaaaagtgggcaaaaggacatgaacagacaattttcaaaagcagacatacatgcagccaacaagcatattttaaaacgctcagcatcattgatcgttaaagaaatgtaaatcaaaaccacaatgagataccatctcacaccagccagaatggctattattaaaaagtggaaaaaaaaaaaaaaaacaaacagcaggtgctggtgaggttgcaaacagaagagaatgcttatacactgttggggggagtgtaaattagttcaaccattgtggaaaaaagtgtggcaattcctcaaagacctaaaaacataactaccattttacccagcaatcccattactgagtatatacccaaaggaatataaatcattctattacaaagacacatgcacacatatgttcattgcagcaccatcctcaatagcaaagacatggaatcaacctaagtgcccattattggtagactggataaagaaattgtggtatatgtacaccatggaatactatgcagccataaaaaagaatgagatcatgtcctctgcaggaacatggatggagctggaggccattatccttagcaaaccaacacaggaacagaaaaacaaatatcacatgttctcacttataagtgggggctaaataatgagaacaaatggacacatacagggaaacagctgacaccgggacctagtggagggtggaggttgggaagaggtagagtatcaggaaaaataactaatgggtattaggcttaatacctgggtgacaaaatagtctgtataaccaacccccatgacacaagtttacctatataacaaacctgcacatgtacccctgaacttaaaataaaagttaagggaaagaatagtgcctttttcatagtaggtgttttacaaatatatacttagtaaaggaatgaaataatgccaatatttgaatgtggttttgtatatgactcaaacccatatagatctgtaccctatttctatcatatttccattcctttctaaaaatgtattttctatgttgacttacctgaatactgttattctaaggtccacttggataatttatatatagtttcataaatgagtagattttagcagaggtgattggcccatattagaatgtaattcaaaacttgaatttattattttaaattgaatataacagcttggttctatgtgtcataagtagagttaaagtcatatacctttcttatatttcattcttccgtgtcatcacacaacaatgaagggtacataatgctaaaatgagcacattcattgactgcacatctcaggaagaaataaaagaatataacctgattatttgaagttacagaggctagatatggggacatctaataaaaagtttgaataatttcaaaacatatctttttatctttgtgagattttctctggtatttacattttcgtatcagcatttctcatgatctaggagttcctactacttgaattaaactatcatgttttctaattcttacaagctagatttttccttcccttacagagtctcatttctctacccacttactgaaaaggtagtattttctgtgtgtgtcttaaaatgtttttagattgcaaaacaaacaaaaaaactctcaaaaacatgctgttaacttctgccagctgtttaattaagcagattttataggaatgtgaacaataaaaagcaaaattctggagctatattgcaatccagataatattcttatcctcagaggaaaaaacaatgaccttcacttaagttctgctatattattggctatgatttgaataagaaagcttagtatgacaactgcaaaacatatacttggagaaaaatagcctaaaatataaaactaaggacaatgtaggagcatgtgtgttaatgcataacagacccacagacacagtgggtatcacaagcccttttaatcaagacagaaatatgcacatatatatcatgaacattaatgaaacttgtggaactcctccatggttccaaattatgtcctgtctcaaaatacatttatgtaccttatggtaaagtgatctttgaataatgggatcactgaccattacagttcaccgatgaatacttctaaggaggaaaggagagaaagctaactataagacttaaacagcacctgctgtcagctaaacaaattagctgccctgaaatcacatgtacccacaaggaatgaatagcacaacctttacctaggagactgccttcggaggaaaatgcgcagaatagaaatagccagtatgatatggcttggttgtgtccctacccaaaatctcatcttaaattataatcccggtaatcctcataatccccatgtgtcaaggaagagaccaggcggaggtaactgaatcatgggggaggtctcccccatcttgttctcatgatattgcgtgagttctcacaagatatgatggttttatgtgtgtggtagtttctcctgcattcattctccttcctgctgccttgtgaagaaggtgccttgcttcccctttgcctttcaccatgattgtaagtttcctgaggcctctccagctatgttgagttgtgggtcaattaaacctatttcctttataaattaccctgtctcaagcagtgctttatagcactatgaaaatggactactacaaggcttctaattgttatcccaaatttgttcagcttttgacaaatctgtatacacatttgtctttgatttttagctgtttgtttgactttttaactttttagctattaaattttatcatttactaggctagagcagaaatgataatacaggtttttcctcatttcttaaggtgtgattaattacaaacatggccaaaattcttgcaattcctctccttgaatttgggctgaccatgtgacttgcttaatcggtgtggcaaaagcaatgtaacgtgagttctgtacctgagcctcaagaggctttgcaaaattccattttcactcatgggattctgtgattaaaccggccttttggaggatggggcataagctgttctaactaattcatcttagatagccagtctctagctagcatggcaagctgatcaccaacatatgaactagtccagttgagatcagctaaacctagcccagatcagaaaaaccacctactgaagcccagtccaaatggcagaaccacagaattatgagctaaataaaaggctgccattttaagcaactaagttttagaggagcttggaacacatcaaaaactaaatgacacaaaaggttagctgagaaacattttttaaagacaaaatgtattttaatccagcttaaacagaatatctttattttggttaactttaaattaatagatgaaataggtaatgataactatacagggctaaaacattttatatatggttaggtttgagtgtaaaatttttatctcctttgttcttttttttaagtcagtttctgggcttctttttagcaaagcaaacagttatttggctctaattacaatcaaaatttataaaaaaaatttttgaagtcaaagtaaaaaatccagaatattggaatatggctaataaccaaaatcttcctctccttctaacactactttaatatctcactaatatttctattccttactccctggaataaattgaaataggataacaagataaaattatacctggtttttcattctgggttttcttcattgataaatagagggttatgaagtcagaaatataagactattttctcctgagatttcattaaagatacgatattaggaagactgaaggctattgtgctggcttaccacatcatatacttccaaccatcagaagtgaatgacaatgcaataatgcaaaagaactcagctcttatcaaccacagaagcatttagaatttctgtgactgctctttgagtacaaacgattattactaaactttgtcaaactgggaagattaaaagatttttcagggttgtgtaagtgcaataccataaatactcaaccaagtagaaactgcttcagcaggttaaactaatgtggggaagacactagaaatatcagaattcagaaacactgactccaatgcattgtttttttcatatttcagaatctgctaaaagttgaaaaccagattaattgcggccatagaaaagccttctcatctgtcatttgaatgtgaaaagaaattacttgaaatgtagtgggcattctacatttcaagaaagaaagagggtcgatgaatgaaataagcagaaaaaggaacagcttagaatatgatatgtagagatacctgaggataaagaaacagtgagagcgaatctgtagatagtctggaaggagattagcagaaaatatacataaaaaatcacatcagttgacatccctctactctgtgacattgtggtggcgtctaagaaggtcatcagtgtttctcagtatctggcattcctgcccctatgtaatgtccttcgcttgcatgtgggctagacttacagcagccaggaggaagtgtcacttccaagattaggttataaaaagcctgtggctcctatcctgggctttctctctctctctctcatctgtcctggaagaaaagtaaattgccagctgttgtgaggatccctgcacccacatgtaagataataaggcatgctaacaaccatgtaagtgagcttgaaagtgaatggcatcctacacacacagctgaaccttccagtgagactgcaggaatgatcaccagtttaactccagcctcacaagagatactgagccacaggcacccagctaagtttttctgggattcctgacccataaaaactgaaataacatgtttcttattcatagctgcctaatttggggataatttgttatacaggaacagatagctaaataaccacctaaaatatagaaaagaatagttttctccgtccttccctccctctcttcctccctccctccctccctcctttccttccttccttccttcccaccctccctccctccctccctcctccctttctttctttttgccaaaaaagcaaaaccaacaaacaaactaaaatctagacagtctttcttttaaaagcaaagaaaggctgggagcggtggatcatgcctgtaatcccagcacttttggaggcagaggtgggtgaatcacaaggtcaggaattggagaccagcctggccagtgtggtgaaacctcgtctctactaaaaatacaaaaattagccagtgtggtggcgggtgcctgtagtcccagccactcaggagcctgaggcaggagaattgcttgaacccaggaggcagaggtggcggtgagctgagattgccccactgtactccagcctgagcaacaaagcaagactccatctcaaacaaacaaacagacaaacaaaaacaaagaaacttcccagcactttgggaggctgaggagggtagatcacctgaggtcaggagttcaagaccagcctggtcaacatggtgaaatcctgtctctactaaaaatacaaaaatcagctgggcatggtggtgcacgcctatggtcccagctactcaggaggctgaagcaggataatcgcttgaacctgggaggcagaggttgcagtgagccgagatcatgccactgcactgcagcttggacaacagagtgagacttggtctcataagtaactaaataaataagcaaagaaactgtgcaaagagaggtaaggctctttctgtggatgttctctatttgggcattagtttgtctgctatatgcctgctacttccaaagaaaagcctgtagctctccatactctgtttattctcaacctgacaagcagtccagactggtgctaaagaacagaagatacacatcgagatccctttggaggtaggttgttgagggaaagagataaggtttgatagaattaaaactgtgactgggaatttaaaatgatgatataataaaggcaagagattcaatacaagaaaaaataagtatgttgagtagctcatggaaaaacaaaactatagaaaacaaatatgattcaaatataacgcaaaataaaatgtcctgatttctgagcaactgataagtgcaagggaatccacttgaccttgatcctagaggtggaaaaattctcctttgagtagtccaggtaatatgatatttaactcataaaaaaagaaaggtaatcttaacatataactgagattagtattggataatatttacacagtaatggtaatctaaatggtcttcattgttttccactttagaatcctcataatccaaataaaatatgggagatttagttgtggttggttgtcagacagaatgttaaagttaacatccctggaaataaaatgagatcatgagatgaggaaaagaagagggaagctagaggaatggggaggagcataaaaaatatctttagcttactaatgtggatacttaagagataagagatattcttgtaaattaatggaacaagaaattagatgcaactatattacttaaagcaacaaaatttatatataatttacatatagttttatctaatatatatcaagtattatatatataatattttatacacatacagacataattcacaggagagaaaaaagcaaaagaaaggattaaagcctgagctaatcctcaattttcatatccaggattgtataagtattgtataaaaggaataaataaacaaatggaacataagcatattatttggagatatggagctaattaccaaaaagaattattaaaagacatttactctggggaataagactgggagtgatgaggggataaatgtggtatcgttgcttttttatataccatcttctaaactatattgatttgtttttatgtgcttgctttatattaatgaaaacaatgtatcaattattcccacttacatatgtacaacaaagcaaaaaagtgaattctgggagtaatctgttactagtttcaggaatagttttaaaaaggaaggtataactggtatttgcaatttgagttatcatccatttaaatatattgtattttctttttttttctatttccttttgctttttttaaattacactttaagttttagggtacatgtgcacaatgtgcaggtttgttacatatgtaaacatgtgccatgttggtgtgctgcacccattaactcgtcatttacattaggtatatctcctaatgctatccctcctccctcctgtattgataggacgtatctcaaaataataacagctatctatgacaaacccacagccaatattaatatattttattttcaaataagccacatagcaagaataaattcctttgacatttcctaggctttatcaagatctgtctgttgtgaggaattcattccactacccaaacttcatttaagtctttgcatccaattagtgttatcccaacatgtccctctaatctcttcttttgcttctctagttctttgtacttcattcccatttttatttgcctataaaaaaatcatagtttttacatgcttaaactctgcaatgagtgtcttttaaaaatgttatacattttccctatttcgatctggttttctagatgtctaaatatcaaccttatgcacagcttgtcttgtagccctgtcaagagtcactggtgcaaactggttctgtaatcattaggcttcctagagattttcgcctgtttcttccactccccctaactggctgaagacatcaaaaaatcagacaaactgaaaatgtgaattctcgactctttgaaatgggcaagctacttgcaaaattgtgaagtaagttttagctatttgtctgtggctcaccacagacagcaaggaaaaggtaaactcctatgaagacaataagagatgatttcctgtagagaatttaaaaacaataacaaaggtgactgaaagtcagactgctttttattattagagtgtgtcaacaagtctaaacaatgtcagtgataaaatattcctcttgagaggggaccattaacaatgcccctcctccaccttggtacggcactataacccaaaatgatgagactctagtaaacctctggaacagggttttacacatgttaatctgtaacctggtaggcaaaattatgccactttgggcccgtctcttttccttttagggacaactactggtgcctccttcctagtcttatgagaagaatgtcagtagcataaattgaaatgggaattttgcttcctgcatatcgcatccacccctttttcttaaataaatatgcacatgctttttaaaaaaccaaacaactgtaatttcaaaatgtctttatactgcataagaaggaagttaattcttttaacatcttgttatatataccatctttattctctgcaaatattgattaatctaggaaaattcaggactgatacggtttggctgtgtccccacccaaatctcatcttgaattgtagttcccataatccccatgtgccacgggagggacccagtgggaggtaactgaatcagggaggtggtttcccccatgctattctcatgatggtaagttctcatgagataaggggcttcccccttctctcattattctcctttctgccaccatgtgaagaagcatgtgtttgcttcctcttctgccatgattgtaagtttcctgaggcctccccagccctgcagaactgtgagccaattaaacctctttccttataaattatccagtcttgggcctgtccttatagcagcgtgggaatggactaatacaaggactgagcaatacacaacatttatcttagcatcattttatgcattctgtgttcattatttattcaaaaaccacttactaagtgtcctttttgtatcaaacactgcattaggtgctgagcatacacacattaagacaaaggtcttgactttaagatgcttgtcaaaaaaaaaacttaaggttataatctctaacaggtagatcattatctatctatctatttaaatgaatctctattcatctatcttttccaaagtgctatgaaaacaggaaacaggttctgcttggggttgttcaggaaatcataaagtgaaatgcaaagtctaaaatcttcctgtgccattaacactaacaaagctttagtatttttcaaatggagaagtgtatcattaactagatcacaggtacagtcgcaaaacaagaaaaggaggaaataggaacactgctggcagatgagtcagtatatcagaaagtgggaagttgcattttgagtttaggcaatgtgaacagtttactaatagcataccaaatacaaatttcagactagattctttatacatgtgtttttttacttttctgaatcaaattcccaaacaatgtagaatgcaaagttatataagataattgacaaagttacataagataattgagccattaaataaaaatggaaaactccagtcacaaaaatgtctgaaactacagtgaaaattctctctttggacagtggaaagccctcagttcagaacagaacaagttgggcacttaactttcctgcagtgtcttatcttctatcttgtattagattgccatgtagaccctgtcaagaaacattaccaactgctagttaatgctgtgcacggaaaagtcagacttggtaatgtcaccacagaatttgaaaggatattaatgggtccttttcatttctgaaaaaatagagattagaaccagagaacttcccttcaaggacaatttcttttggaagaaacttatattccctttggatccatgaacacaagtacctacatcattttctagctgtggactcactctttcaaaacatactcagggacagctgatgcaaaggtaagcttggaggtgtagaaaatataaaaatcagtttttctcaagtgtgttccagggccaaatttttactgctgaattttaaatgctggtctatgtttaaggaagatcttataacagctagcatagcatggcacaacacatagagactcctcacttggttcattctccaatattttggggaatctatagttgaatatatttgttacttggtcctggagtaatgtgggccaaatggagaatcatttctcttatttgagatttgggtcatcatgtgtgaatctgtagtgtctagaataaggcctagcatatggaaggaagaatgaaaaaaaagggagaaagaagagaagaaaaaaggcaatagcacagtggggatgaggatactaaggaagaacaaatgagcacctgctatgtgccagatgctatgccatgagctttatttgtgcaagtttatttgatactctcaaagaatgtggcaaaacaaacatgattttaaagttctcattgttattgcttcatactttactccatgtcgcagttaaacattgaggttcacaattataacagtcttggagttttctcaatagcatataatttattccatgtaaagatgaagataaaaaaatgtagcttcccccatatgcctctagggtactctgtatgtcctgctgaagtagaaaagtcctagaagggagctaagggggccgaggctaccaactactctattaaatctacagacttgatggtaatgtctattttagaagaagctttccgcaaatgcaacttagattttaaagacatcagcaagagaatgtggataattccagagtgagggtagtgtctagcacattgccaacacttaagacgtgaaacacttaagaagcatgtttccccaatatgcttgttattaaaaagagtctaaaatatcttttctcctttaaatttgtctctgagattcaactgtgttagtgatgctgttaataatatactctaaatctgtcatgtacaaaagctttgctattgttgatgtagggcactttataatttatgtatagattcactagtaatctaaggtgtgagaaatggttcttcaaaaaaatcctgaattgctaggtatttatcctcaagaatagcataataatacctagcaaagtgtgctacatatattagttgcacataagattttgcaaatttgtaattctaaatgaaaattttgtggatttacaggcaacatatagcatggtaaaaaaaatacacacgtacatacactgcctattttgttttgttttgttaattaccatttggaatgcttactggataaaccattggttaacacaagtgctatttgtctgcttgagatttcatataaagagaatagtgataacaagaatacagtgaaagctgtttggtaaatgctgaataaaggcagagaaattacctgagccttctcctgaggtcccagcctaatggtgttaatgtattttttattgctggagaacttttcagtgataccaacaacaacaacaacaacaacaacaacaaaactaacataggctctagatgataaaacatgtaagaaattaacatagagatttaaaactaatattgacttagttttttgaacaagcttaatgtttacatatatcatgaaggagaatagcaagtatggttaacacacacatacacttgtatacacaaaattatcttttttgttttgagacagagtgtcactctgttgcccaagctggagtgcagtggcatgatcttggctcactgcaacctccgcctccgcccaggttaagcaatccttctgcctcagcctcccaagtagctgggactacaggcgcgtgccaccatgcccggctaatttttgtacttttccttcctccttcccctcacagacaatgattattatatgtaagagatgaataaatcaacaggtgtaacacaaacataggtatgtattgaaaatcagaagttcacaaagtattacagaacaatttgtagagctgataaaaactaagacaattaaactaggttatattcttgctacttagacaagaactaattatttaataaaaagatattactttgtcctaccactgagactagacattttagaggaagtgccaacttcaccagtcctgagaaaattcccactgaaatcactgtcatgtatcgactaggtacacagacttcattcaatatctccaatgctgatacagaatatatcaaaagagatatcgagaatcatgagcccaatctagtctaactcacagctggaagtacttgaagtttttcattctcaagttgaaaaattagtatataatgaattcttaagctccttaatcaaaatatgttatccaggatagatacagaaatcatatttgcaagattcagtatcacaccatgaattaccttctgtgtgtgacaactggggaacagacacaagaaacttcctgagtgctcagtcaacaataatttgaagttggtgaggaagtaggggaggttgcataaaacagcgcaagttatgggaatccttggacagctcttcgttgtccaggactgtcccagcattgcagtgtgtgtagtcctcatggacctcacgataactctctctttgtgttattacctgccctccactgccgcttgcttcccatacatacatcccttaggggaatggtgctgcctcattcaacagagaattcagcttggtacatgccacacaattgatgtgctgctgaagaaacataaattcacagctactcttcaagggcagagaaaatagctttaaaggtaagaaagatgctttaatttacagtgtgtacctgaagaatgcttctcagacatgactttcagatgtatggtgctcacctgtgacaggtactttgaacatttctttatattttaagatgaacatatgaaatttctattttttatagttaaaaactggtgaagtggccatcatttcatatggttcctatactcttgactcctataatcctcacaataaacttatgaggtaggaaactgaggtctaagtaactcacagctagtacgtggtaaacacaatgctgggatataggtgggcattttggcttctggagtcaacgcccttgaccactatgcatagtgccccaacatcccacacaagctttcagaccttagactcccagaacgcagggcctcatcatctgatcatgttaggtgtccagcatggaaccatatttataggcaatgcctaaatagatactattagaaggagtaatacatgatacaaaactcaacttcactcatgactcaaacacttactgtgtgaccttcgacaaatggttcccatttctgagggctaaacttttcagtctatcacatagaatgtatatggatgcattaaggaagggaacaatatgactgtatttgcattttcaaaaggatagtctgacagttgggtggagatcacaatggaggtggttaagactatgagaaagcaggaggtgatgagattctgaataaaggcaatacgtaagagcagaatatagatcacctcaatgtatcctgaaaaaaagtgggcagcatagccttgggtaagttagcttttctatgcctcaatttcctcctttttgaggaggaataataatatcaagttgtactttttgagtttccatctcttcctcagacatatatatatatgtctgaggaacacacatatatatatgttctgcaggatatgattacacttctgatttaattagcaaaatatttattagaagccagaggaccacagaggccaggtccttctagaggttaggagcaggtaaagtatatcttggtgttgcttttgatcttttctctggcttccagtttcctaagaaagctaatgctgccagtggcactatccatacagggtgcagtccttctgggtctgaagaaatgcctgaagattaatataccaaagttttatgaaattgatacctacatctcgaatactttacgcacatccattcaaaagagatttccatttcatggttcccttccacacacaggcatccccctcttccttcctctgtttttttttcttttttcctgcagcctttgacatcccacactattcgttttcttgtctattgcccatcttctccaactagaacataagttcggtgcagaaaagtctaattttgatcaatgctgtatttctacagactagaaaggtagtagaaaggtacctgagatatagcaagtgctcatcaaacttggttaagtgaatgaatgaatgggtatatgaatatatttatctcggactagctttgtgagaagacatctcaaaaccaagcttgcatctaccaatagagcattttgtcatctagtaaaacctccagaccccaaagaaaatgcaccacgcagaacttaaaaaaaatcctttaaaatgcattactctagtactttttcttgccagtaatgagaggagaaaaacaaagtctgaataactgttgcttacacgcatttaaaattacaatacattacactcttctcaccaggcaccattaagttcaggagaacatgcctttgtatatattttaaaatacacatcaaagtgtttttctttgaaatatgcactaaaatttgctgtaaaaatgtacattaatttaagtgaattcagaagattgattggactagggaaaataaattaattattcatgtcaccagtattttttaaatgcacagtggttatcaggaacatatataattataagtaatgctattattttttaatagcaaagttacagctaaggttaattaatatttttaataaaaataaaattttgttctttgaagttgcaaaatgtattttgttagctctaaatatttttcaaggaaatgtgtgtgaattctgcttacatttttcaaacaaataatattcatttttcatgagtacctccaaagcctccaagcaagcaacagaagtgtccaatatattcaaacattcttttcttgcataaacattaattgggttctttttcagaaaacccaactgggaatcaaatgctactgactttaataggatgtctcatatgtgaaatgaatgtctcttacaatctaccaatgatatttcttgaactctcaatagttcctttccttgagtaggtttgctaactctaccctgaaaaaatgcctaactgaaaccatggaactgctccaatacatttcactcatatttactgattctgtctcactttataatttaatttcttcccaagagttgcaaactatagtcaaaaaccagaatctctcaaaattttattctctctcttttctcaacattgttgaaataagataaaaagaaaataaaaaaggttatggattctaaaaaccaggcaaggataccacagacaaattttgctctgaatataaagaacaggacataatatgtattattcttatgaagtatgcttttcttgcaaaggtaaattttggatatgctgtaaaagtagagtataatataatttatagaccaaatggcatacttttgagagtcaaaaatatactattaataattacactgaacatcaggtatgcacaggtactatccaggccaactgggctgcatggccacatgatggaagacagaggtgaaatctatgttttggtaaataatcatgagaagacctaattaagagcatcatcactagaatcaaagaaatcttagagctgagtacaacttaagagtttcctagttcaacctacttattttacagaggcagcaaggccaaagtacaatgatgtgacccaagttgtccaagtcacatgacgagataggtggttgtgttgaaagtggaaaccaggtctcctcattcatcatgctctttccattatactacaatctctctacagtatgtatgtattctctatagtatgtatgtagcttgtaaaatattctcgaaggaaagaacaaaaagatcgtaaaatgtgctataaagaacattccagaaacgatgtcacaagcttgatcgtaaaagaaacagcacagttcaattttcctttctttgtggacaggcaaaggaaggaagtgttgtcctcttcatgttggcttacatgtactcatctcataagacattgcaagtttaattagaagagggggaacatttagcagccaaaaaacttgcatgatactcctgccacatgccaagaagctctcagaatctcaaagaactttataccaccaatagtttttgtgaatatttgctttctgagattagccttctggaaagtttcataaaatcaggaggccttatggaaacatttaaaaattaaatattccaagtaaaatgaattttataaattttataaattttatgtaatccacataaaaagtactatcaatattgttatattcacattaaaaaggaacaattcgatcagaagttttggtaaatgtccctattatttcttgatataaatcacatcttcctaaagtaaacattgggctgaaaattgattatcattcaaagcaaaacttcttttttttttttttacttttaaaaggatatttactttaagtaggaatataaacaggactttatggaggatattttgatgaacactactatattctctgagtctgtgaaaactgaaatacatttcttccctattactatccctgcaggatggctgaacaaacctcatctcatctatttgaaatgagtccaatttaattctgcctgaccaaaaatctgtttccatagttttaaaacatgcaatcaccccaaggtacattgccattgtagcttaagtggctcagtgttatcactgagaaaaatgcactttgattgagaaaacagtccagtgtggcttttgaaaaatgaaatgaccctttctgatacacaatttagtaagacagttgataaaagcaggcggatatggccactatagacaacatttaaaggaagatgcttcatccaacctgtaaaaataggtcaaagtttacagtttcgaaattaacattagaaatttatctcatatttaaacttcctggtttaaatattactgtatttagaggacaattgaaaagtcaattacgaattatggaaaattttcaacaaattattctgtcactcaaatataaataaattgctttcttccctaatgttttttccccatacatacatgtgttgttatctgtattcatatatatatctcactacttaagagacttttaaaacctattagcccaactttaaaatactgttgctactactgaatacttgtaacatattaagtcaaattctttaattactgtcactggtttattacaaagctaacaattttaaatatctatttttaaatgaacctaataatcttttatttaagtcaatatctcctcaaatgaaccaagtattcactaattaattagatcatttacatctataaactgctgctgtcttcaaacatgtaatagcttataataaaagaggctcttttcattggcaattaaggagcagttaactctttaccttctgcattttaatattataaaatgcataaatctttatttctgcatttctacgtatttagctttcaaatgaaacagctgttttgtacttaaaaataatatttcttaatatatgttactaattgacaaaatacataaaaccaatgctgataatattttcttcttttgggacacacctggtttatataggagatttggcaactgtaatctcattaatgataaaacaagactactaagaaaaatacctgattatttcaaattatattcataaaagcattcctaactctgaatgtcctcttgtgaattattttagataaaggaaagtctatcaatttatttgtttcatttttcctgtatcagatttactgtaataacttgcttatcagtaagtgaaccataaatctacagcagtaacaaatcattaatgaaacattagcaaagaatgttaaatggagctattgggcaaacataaatctttctaaagtcacaagtctttatccaaggaactaagtgctatgatgttattggcaaccttataaatcctaacgagagaaaatcaacaaaaggatcacattgcaggcaaacagtcctactaaaatgtatattctttgagggcaggggtttcgtttgctgttaccaatatatcctcatgcctagaaaagtatctggcacatgtagacagtgatcaataaatatatatttgtgaacaccctataagacatcccattttattttgtagccacatgcaaataggaaacgaaaagaaaagagagaaaaatgaaaataagtgcacatgtaggtacaatatatccaacactacatttaatttgcattttttgtattttttgcccatccctcttctaggacattttctcttcatctattctgttcctctcacccttttccattcaaagtaaaaatcagagtcaattttcttcattttctgggaaacatgttaattcatatttggggtgctgatacaaacagaatttgccttctattattttccttccaaactggatgcaggtctgtttcaaatgcaagaagtaaaagcaaatttaaatataattatcattcttgcttcttcagaatgcatttttctggaaaagtagggatcgtgtatttggaaaagctttaaatggcacctactgaatatactcactatcagtaaaacagaacaaaacgaaacaattaattttggaccaaggataatacacaattctgaaaaaattaacaactggatacatacaaaggctgcaaataccaacaggaatctaatggcatttgaacagcatctaacagcatttcgaataaggtttttttttccctgtgttcttcactgatggaacaccaatattcaaaccagtgcctgaaatgtagtaggcaatcaataattatgtcctgattgaattaacatacttccaagttgtgcaaatgccacatttaaaaatcatattcttcaaaaattttaggcacaagattgaaataagctaattagagttaattgtaggtgagggcaattaatcacatacacaaaatacctcatattttgggtttgtgtgctcagataaaccaatagaatgtttttttatttttaaataaatagtgaaagagtatacccatcattcaccaagaaagccacatggctggctatcaattcaaaactttaaacttcaaaatactatagaagtattgtactattaaaatatctcttttaagattaaatttgccttgattttattttgaagtgctgagcttaaacagacaaggttttcaaatatttcattaacttgttcatttaaactaaaaagtgaaaatcctatgtaattagcagacgatctactcagcttgggccagaggagggttatggaatcaagactatcatttagcatctaacaaaccaaaacaaaatcttttgtaaaagtccacaaacctctaatgaacaacatacacacatttcatattcaaacggaatgcattatgttaagctagtttcaaaggaagctgtagtgcctaagatcagaaaaatgttccaatttagaaaagacgcatatgcagaaaagcccactatcataaataatataggatgaaaatgaaggaataaaatccacaggctcacctggctaatgggttcttttgtcgggggctttcctcttctggctgtgctagtagccagggtcgtggtagtctccataattgatgtggacatctctgattgcatggcagtggctgttgactcagttgtcatagaggaaggcacttcaccaaccagtctcacatttcccactatggcgatgttggcatcgttttcggctgccatattcagaactttcaagccattgtagtacagcccagagagctggccctggaagggctggccctgctctttcccgccaattattatggttgcttggctattgaagattgtgagctgacgccctgtaaaaataatattacatacatgcaaaaatgttgattgtgaactctatatctacaatggatgataaaacagatcttttatggggtgaataatgagagcaataaactataagagaggcatttgactcataattcattgcttataaatgaggtgtccatgaaatgcataattattggcaaatacttgtaaattctcaacttattataaatgtagtgcttttgctaaaagaccaatcaaagatatgtattacaaatcagtttttagtggatcccttttcccttttacatcaagatcttatattgttggtgtctaaagtctaaattgttaaattttaaaaatgtaagacaacatttcaagtatttgtcattctgaaattaccactgacagaaactaatacatagcagctgaaatctaatttaaattttatggtaaaaatttcataattcacataatgtccacatatatctatatgttattctttagtgctgtttattttttgaaggcaattattcattgttatttgaattattctatttttccggcaatcacactgaaaagaaattcatggtttacactgagcatgtcagagacaaaaaaattccaaaaatatttttctgattggctttcagcaagtctatcaaaacaaaacaaaatgaaaaaaaaaaatagcttcagatgtaaaaagcggcttcaggaatgatacacaaaccgatggagaaattatggcacatttccatcaaacagcaatccttaataacagtaccattatcatcaaattgagtatccagttttagcagattgctctctgctcataaaagcatgcacacaactttaagttcagttttaatatgggcttgttcccaaatcctcttagaaggttgcaaatgttaaagggacttcattatgactggcaattcatattgcccactatttaagattcctagagtttaaacaaagagtttttgtttttttcaggaccataataaagatatcagaactacatatattttagttaataatttagaggctggaacatgtaatatagtctatgaatgatttatcattttgggttaatgcttgctgtgagtaccctcatagattgagttagtggattatatttaacagtccctttaaccttaagttaactgggtaagattattaaacagctggtacgtctaaaaatgtatagaaattattatacaaggtatgcaaatattactatctacattttactgttttaaagttgtttttaatttagttttacggaaaatttattttttatgtttattagtgttacaatgaagtactacttggttatgttcaaattatttttttatttgaagttttaatcaatgttttttacctttgtcgagtagccattcatcaactactcgaccaagtcgatatggaattcgctgtctagcaatcgccaggcgctcgttatcattgtttcctttaaagtttaaagagacatttcattggttaaaatctgtaaggtcaaaggttaaaagttaatacttaaagattgagctatacagttgccacatgattttttgaaatttggaattttaaaaagttctacctagaacatttcatgtttcagacttgtcattcattcatttattttattttagcaaacaaaattattcctatgttaattgaaaattagaaatctgcatttgagctaggttattaaacttatgttatagacagacccgaacaaccaatttaaacagcatataatagctttacaaaaaatgaccaatgacctcagggttttgtctttttgatgtttcttattaactagttaaacatgttcaggtgaaacaggtttaagttttcaaaatacattcaacctcttattccagattaataatttatgatcaccaaacttaataccatatttggcacactgaagcatctacaataggcctagcatactttatttcctagtcagaaaacagaaattcttattcacctcatttaagaaaacaacaaagtccaaatagttcttgtgtatttcacacaaattgatttatcaatcacttggacatcacaagagaatgcatcttgcatcatccagatacgttattacaggaaaaggctttgacaaaagtcactttatttgagtgtccttgagtttcatttaaagcttaacatgttgaagcaaataacatttgaaaaaataattatatgtatgtttttatatagtcaaatatctgctttttattaagttattctttaaaagcatgacagcttaaggaacgaatataagccacaaacagtggcccctattcatagatctaacctaagtgagagccctgcttctttgcataaaaaattatctgctagaaacactgtttaaattgaccttgaatattgcttgcaaatagatgagtgttttcttgatctgtagagcacttacgaagaatctgagacaccatctcggtgttgagttgtgtataatgcaagaagagattttctattccattagagttaactaacatggaaatttaagccaagacattttggcattagctcagatgaggactcagaggtgaaagaaatgttgaatggtagcactatctgcataaaaagactggagtgttttgttagagaagataaatgaatagatttacattttattcctctgatttacaataatttataagtgctttcttttgctactcttataatacattatacttaccactaataagcccagcataatactgattacacacttttggagagatagaaaagaactatcttttagacctcatcaatttgtcatctgaatgtctatatgactgaaaatatttcacacattaatatttaatttaaaatgtaaatatcaaagtcaaggcaaatataaagtttaatgaaaacattaatatgtatttctctgtattctgtgatcactaaaacattgtaaaataatattttataatgtgggaatatagttttgttaaactaataatttttttaaaaggacacaaatggtacaaaattccaaccctgtcttcattttttaaaagtgtacaaaatttgtgttctctgttgtgtgtttgcatatatgcatatttggaatttttttttaatgtaatattagttactttaggacagtgtgattattgatcaattacatgtttttggcttataagtgattttatataataagcatgtttgacatgtgtaatttgaaaagcaatcacaaaatattttcaaaaatacataccctttgctctatagtcttatttgtcactcaatactcataccaactcacattggcataacacttctgacaactttatgattaggtggttcctcatgtttttcatgctagagtcttccaatcatcaggcatgacccacattctctcagacaccatccgaatctaggtcgcaaatccctcttgcccaattactactacagtctattgacagacctctctacatcttctctgtgattaatcacacccattttccatataagccaatatctaatcatgtcacttgtctagtataacccttcccatttctcttaggataaaatctcagacccttagtgaaatttgtaagtacttccacaatctggtcccttcctacctccctgtcccctctcacggccatcactgcctcactctgctctttttatccttatgagacttctttcaattcttccaaatcttttctttcttctctctgggactttgcacatgtagcttcctttatggaaaatactctcccttgttcccacctcatctctatctttcattagctaaccattactaattaatggaatcttcttggtaggaacattgcttccccagaaggtattccctgatgtcatcaggttacattaggacacttgactatattatttgtagctcctgaaacatgccctttagaaagaagcattgaacctgtaatggcaaatttgatagtttgccttcaaactctgaatatccctccatgaggccaagtactatgctactatgtgcagtatttattatttcttcagtgcttacttgcacaatatctatcacatacaatcctattaatatctgtagaatgaggtagtcaagaaaaccttgtttttagttctggtagcttctgttgcactattaacacattcttacaacctaacaacattaaaaagaaaaagaaagcaaatactagtgtccagagaataaaccacttgtagctaagcctccctttgcactttccaaaggaaacaccataaacctcacttataattttattttttgatgaattgtcactgatttgaacatctctacaatcagttcattatttgtttaataataaattccccatgtcacaaaattggtaaacatagttattattagtagggaaaggttggggaaaaaaaggtctaaacaagacaggtagagaaaaatcaaagctttatagattattttaatgacttttaaaaagatcacataaacacataaatacattcacacatacatacatagaatttgtcctcaaacatttgactagtactaataaaataattgtgtgattgatatagtatgacagtatgatgtaagtcaacagaagctttggagatccttgctgagactcagctaaagcaagaacataaacactgaattcccaatgattaacagaggtcacctaacaacaacaataaaacaatttagaaaatcgaataggcagtagacacaagttatgaaaatatgtgataatatataagaaaggtagccacacaagggggtcatatcttcctactaccccagaatatcagatgcctactaattcagtgagcactgttttaaactgaagaactttttaattacaggacagactttattcttgtatgggtaatgaatggaaaatcagatggtgcttattcaattcaatatatacctactttattctctaaattctttgttctcctactagaataaaaaactaatgactttgttctcctattagaataaaaaactaatgacttttctgctgcaaaattatatgcagatacattgtgatatggtttagctgtgtctccacccaaatctcatcttggattgtcgctcccataatccctacaagtggcaggagggacccagtgggatgtaattgaattatgggggtgggtttttcccatgctgttctcatgagagtaaataagtctcacaagacctgatggttttataaatggcagttcccctgcagatggtctcttgcctgtcaccaagtaagacatgactttgctcctccttcaccttctgccatgattgtgaggcctcccaaccatgtggaattgtgagtccattaaacctgtttttctttataaattacccagtcttgggtatttcttcacagcagtatgaaaatagactaatatagtaaattagtactggtaaagtggagtactgttattaagatacctgaaaatgtggaattgactttggaactgggtaacaggcagaggatgtaacagtttggagagctcagacaaagacaggaagatgtgggataatttggagcttcctagagacttgttgaatgatgttgaccaaaaagtctaggctgaggtggtctcagatggagatgaggaacttattgggaactggagcaaaggaaattattgctatgttttagcaaagagactggcagcattttatgcctgctctacagatctgtggaacattgaacttgagagagatgatttagagtatctggtgaaagaaacttctaagcagcaaagtgttcaagacgtgacttgtgtgctcttaaaagcattcagttttattcatttataaagatacagtttggaattggaacttatgtttaaaatggaagcagagcataaaagttcagaaaattttcagcctgacaatgcaatagaaaagaaaaacccttgtcctgaggagaaattcaagccagctgaagaaatttgcataggtaatgaggacccaaaggttaactgccaggacaacgaggaaaatgtctccagagcatgtcagacatcttcacaacagcacttcctatcacaagccaggaggcctaggaggaaaaaatgtttttgtgggctgagccctgggtcttgctgtttgtgcagtctcaggactcaggtgtcttgcatcctagctgtggctaaaaggggcaaatgtacagctcaggtcgttgcttcagagggtgcaagccccaaaccttggtggcttacatgtagtgttgagcccgtgggtgcaaagaagtcaagtattgaggtttggaaacctctacctagatttcagaggatgtatgaaaacacctgaatgtccaggcagaggtgtgctgcagggacagaaccctcatggagaacttctgctagggcagtgcagaaagaaaatgtgagtgggagcccccacacagagtctccactggggcactacctagtggagctgtgagaagagggccactgtcctccagacaccagaatggtagatccactgacagcttccaccatgcacctggaaaagccacagacacttaacatcagcccatgaaagcagccaggagggaagcggctgtaccctgcaaagccacagaggcagagctgcccaagaccatgggaaccttcctcttacatcagcatgacctggatgtaaaacatggagtcaaaggagatcattttggagctttaagatttgactgccccactgtatttcagatttgcatggggcctgtagacccttcgttttggccaatttctcccatttggaacagatatatttacccaatgcctgcacccccacggaatctaggaagtacccaccttgcttttgattttataggctcataggcagaaaggatttgccttgtctcagatgagactttggactgtggacttttgagttaatgctgaaatgagttaagactttggggaactgctgggaaggcataattgattttgaaatgtgagggcatgagatttgggaggggccagggatatggtttggctgtgtccccacccaaatctcatcttgaattctagctcccataatccccatgtgtcatgggagacacccagtgggaggtaattgaatcatggggacaggtttttctcatggtgttctcatatagtgaataagtgtcatgagacctcatggttttataaaggcagttcccctgcacatgctctcttgcctgccaccatgtaagacatgcctttgctcctccttcgtctttctgacatgaatgtgaggcctccccagccatatgtaactgtgaatgcattaaacctctttttctttataaatcacccagtctctagtatttcttcaaagcagtatgaaaatggaaacattgtgaagacacatctaaataaagtacagcgacaatgtctttttaatagatgattccccaaatccttccaccattaggtataaaatagttcagaatgtttaggttctccagcgactaggcctatatttttcctttacctcatgattttcataaaaatgttgcatactaaaaggggtaatggaagtatattattttaaataatttctcaagatgtattttatttctttacaaattcatggtgatatttacttgtaaaatatcattcagtagctttgcatgattttgctgattatatttaatactgtccattgttcaatatacatctagaccttacatgcaatataaaggatataaaccatttgattgggaaaggtcaaaggcaaaaataatttccaatgaccttttcttttctttggaaaggttcaggatctaatatcaaatatgctgggatatagaagctttacatacagcatttgtgaatggtcagtgtaagcaggcttaagctggtaggtgagatgaaaaacaagtggaatgtccctgaaaattcaaatcaaaacaaagttgaatctttcgaagaagacatttttaccttcaagtattctaaatcagaggtaaggataaagcaataaatgacccacttttcaaagatctatacattccgggctataaaaagggtccaaaaggaatttcatctctttctaaaagcataaaactctactatagcaacatgctgagcaaataggcttgatttataaaagcagagccttctcattgaatagttaaaagataacaatttagtctcacacttttcccatgataaaagcaagataggattttcctttgatttctttttcctccagttaattttgtgtggtttgatctgttggtaccttcactgaaaatgtcagtgacaacatacatgcctctgccgaagtaattttcaagcaatgaaactgcatgtaaaatttggttttattttcctttgaatttcaaaaagaattaagtatttttgacaggaggaaagactcccttccccccaatccctgtagtaatgccattgcaacaaggtacaatctctaattgtaaggtattaaatgtcattgtaaggtattaaatatcattaatacttcaaacaagtttcctggggtgaagaattcaaaggaaaatctgatggcttatatttggaatgtataccctctattttgattaaatcccagataattttatttgcctatttgtatagactgaatgtttgtatctcccaaaattgatctattgaaaactaattccaaatatgatagtgtcaggaggtaaagcctttgggagctgattaggtcatgaggaaagagctctcattaatgggattagtgcccttataaaagaggctccagaaaactcccttccctccttctgtgatacgaggatacaatgaaaagatggtcacctgtgaagaatgaagcaagccctcactagaaatggaatcttgtacttcctagtcttccgaattgaaagaaataaacttttattgtttttaagccactcagttaataatattttattatcattgcccaaatggacaaaaataccatgtaacaatatttggtcacattttagtctatttattctatatgaacaagcagacttccgggaaatgagagtaattacaaagaatcaaggtaagtagcacaaagcaataaaactcaaatccttgacttggagttaaatttcatggtgtgactcagagaacaaagataaatacaattttaatcatattgttataactatcgatcagtagagacaagctatatgaacatcactgatgtatagtttttctcctttcattttagttcttcactcttgtgtaatttctcctcagaaataaaagtgtcagcatttgatatgacatattaatatctatggggaaaaagtaaagaaaaacaatgctatgaaccaaacatttgtgcagaataatatgaaaataaaaataacaagaacaaaaagagacttgcttctttggaaggcttcttatttcttgagtttttaacattgggaaaagaaacacaaaaggattctgaaagtcatctataccacaagagaagattagtaacctgtgtacagactgatttttaaatgagaacaagacatttggatatatctaggcccagaaggcaaagtaatagttttgtaaacatactctgattttaagtgcagcataatcacataattttcaactgaatgcaatgtgtattgttgtcatatagaccctgcaaataccataatgcctcacttggctgataatgttccaaataaatagattttgaatatcgacaccttttgagaaacaaacttttgaaaaatatagctattctaataaaacatttgtcttatatattactttatttcctatatcattaaaatgtaaaagccgaatacacatatataattggctccagcttactccagtttcatcttgaactacttttctctgactctttaaattagtcactttgtaattttttcaattcctttagctaagccaatccactttgaacccgacattctcctttgcattgcgaatttcttgcatccctgtgtactcaacatctctgcccacctcaacagacacacacacacacacacacacacacacacacacacacacatctaaggctggctaaattttttcttttttaaatatcagcttatacatttctcaaggaagcattccctgtgtcccctactgctccaccaaattattctacttaatgaattcttccactatgcattcttaaaatacttagtagcaatatctataatcatgatcaaagaagttcatgtaattgattctagattctagattccttgtgagcaggaaccatgtctgtcttgttcaatgctgtacgccttatgtataacacaatggtgagcacatggtaattgcttgttaagtaatttctaaatgaaaactgaacccatacagttatgcaaaaaataccacttgaggtaattttttgcatgataacatagtggtatttcttgttcaagatccataaggcagtgagattgttagtgtccacttacatatatgtatatatagtcacaaacaccattggattgtgagaggaatagaactttgcaaaacgttatagtaaattttgcttggacgtcagatttccttttttcttcttgaccatttagtgtccactaattacatatgtgtgcatgtctatttagtttattcagtttaccagacactaaactaaatagagataaaatatgtgtctctatatataatatatataattactgattcattatatatataaaatgactcagtaactctgcttatctttcatcaattttgaatttgccattgtagtacacaataggacaaatcttttaaatcttatttttatgattaattacaagtcaatgatttatagtctgaggtgagctctactgtggtgcatacacattagcagaaaaattaataccacgtgggatcttctttttttttttctaattgtgtagagagctgatcatgacaatctttgatttggtcagggggaaatttctgcaagtgcttcaattctctaatgactgtgtacaagaaacagtcttggacttgatgaaccttcaaaatatgtatcatctccaagactatattttctagatgaattttagtggtgaattctttcaaataaattgaaatgttgatactctggtttctcttcacatcgtattaatcttttactaaattgaatcttttactaaactgaaatgttaaccctccaaggagcatttacttccaaagttcatcaataaatacatcaatgccttgtaaagaaagcaacattcatttaaccaaggcaaaaatgatacaaagttgaagcttataaagtcaggtagtagaagttatggatcttctagcctttgtaacatgagggcagagggcttctagaatttgcctgatttgtggctgataaagagcagcgaggggcttggattgtcttctggacttttaagacctcactgaatgatgaacacacactaccagaatcaaaggatggtttttgtcagacagcaggactagaccagacagtaaagctacaattaagtttcatgcatgctgggaaatccagtttttccgtatgaaagtggtctgtaggtaaagaaactgaagaaaacaaaggaccaccagaaaataagaaaataatgtattgagtagcttcatgttttatgcattgtgttacttgcttatttaggttatcttgtttaatgctgatattgatcccagaccataagtaccttttattttactgatggaaaaactgaggctcaaagagatgacataaaactaatgctgcatcatacatcatagaaagagggaccatttgaatcaagataaagctgactcgaaagttgttccatggaatagttataaagtaatatctcttaataccgtgagtcataagggccaacatcttctccttaatccttatagcactcttttgtataatgtaagatgtcattaaggcttgtctacaaagtttctgtcttctagattctggggtgagatcgcccttatggacacatgaaatcagtaatcttccctaaatcctcaacgatttatcaggaggataattttatcatctccattttatagattaagacagtgaagcagaggtaagtaaagtgatcaaagacctataacagtggagatcccagtgagaagcagtattttgttttttttccttttataatgatgccttgtatgcatagctactggaggcataaaatgttccagacattccttgtctttacctctaacctataagaaaagccacaagcataataatccactaacttcagtgctttttggacgttgaacctctccagaaacacgttggaaatggagagaggatcctagttgtgacacaaaagaccactgtacttcattgacttgtcagagaaaaagaatattgtaacatgttacagtaaattttgcttggacgtcacatttcctcttttccttcttgcctatttcttatctctgcgtttccttttacacagctccagaaacccagtgctttcatgccacctgtcaacaactcaaggcgtatatttacaactgcggttcctacacatatctcatgttccaaaaatacttcaccttccttcttctctagtgccaataattaaaccctggtttctttagtatagctcggctagatgttagaaaagcaatcggactcaataaagtcaatatataagcagtgcccatgtactctgaaattattgtactctgaaaggcacacatcaatacatcacatggattctattgttgaagagcttacacgttgtctagggagtcaaggggacaaatgaggaaagttaaaaaataaaagatttaagtaaaagttcaagataatagataatgagacataagtacgcaattaaccaccatgtgaagtgtagttgccatagaagttcagagagaacaatggattagagcaaagaaggtgtgatggaacacaaacgattgcacctagatcacaatcaaaatgtcattgaaataataatgagctaaaaatttttcataatgtgaatattaatcctcaaaaggttgacaattgatcattatcctgaacttcataatgctattcacccaacatctatttttaaataaatagactctccaataaaacatatttagtctcaaaatataattacaagtatgaccaataatggttaaatattcatgtcacgaaccatgaaaaaaaagaaaaaactctcataaaactactaagtaaaatgcactgaaaatcggcaagaatttgagggcaatgtgtaaaagtgaaatatttgtgttaggatggagaaattaatggtgaccttttttcaaacttcaattttatattattgatactgcatgtatgcacatttcaactttgttcccactgcttccttaaacacatacacacacgctcatttctctaaattaaatgcgatatattaatgtaatgctacaggaagagggggtggtgcaactcaagagttctgtcagtcattctcacagctagaaagagcacgcacagctcaagtagggtgatgcgctgttcgtgactaatgcttcagatgacatcccagctccttatgtgaaacagcaggcttttatatccagttaaacaatatattcatgtgagactgctgtgatgttgggcgtagaaggctgcaggctgtctactgcagagttcaatggtgctttggggaagaaattagaatcttagtgcatgtctaactagcttaagtaatttcttccttcacatccctctcttatgtggatttacattaagatatctaagtgttttacacaaagatttgtacaagcacttgttcccactagctacttacattcaaaaattttggtttggatattgtttcatcagattaatttgaaataaatacaggtaaccttgtgaattttggatctcattgcctgtgtggaatgaacagtgatttaaattttcttccctacacctttaaatgctgtttgtttcccattgcaaaggcactggagtatcatatcaaaaaccagcagcaagaaatgaaaagcagcagggacaagcaggtaacaaaatacagaacttactctgataaattaaaggtcatactctgttatcatgcatactaaagagttattttgtgccagttgtgtagcatttaagacagaagaatggtttaacagctacaaaaacaggcagagccattgatagacatcactaaatactgagaataagaaaaatgaaaagtaagagcagccccacattaccttacaaatggcattttgccattttcccagatatgagaatcttgagtactttctaaatcataatgtcataacatttaaacctatccgctctaataaaaacctaaatatatattttttctaaagtgtcttttcccagttcttgttttttgaaaattggaaaattatgtggttcagctgaaatttctacactccattatcagtcttgacttttaatctagtcttcttaatattcaaattggtccacggaaaaaaagataggtgaatgtttcatacacagtctgatgtggcctataaatggaactgcgaaagttccctattctcaagtggaaaagaaaagtctgattattatgacattctgatcttattttcaatggacttcaatctctctcttccagttgtaactggaatgcaagatttttttttcaattagaaagatgaggtttgtccattgtatgcaaataatttaagattaaatggtctggaattgcaaaggaccaagagttggataaaggtgctggataattgctagccccattcaattttataaaatgtaaaaccactgaagtaaaataaccatttttttctttttgtagataaattgaatactatggatatgaatttaaattcctaaaataactttcccctaatacaagttaattttctctaccaccaattatttcttaaaagtaattatcctgtggtcagaatcactgaggaaagagaacccttgatggttaagataatgagctctaattcctaggttcaaatcttggcttcaatattgactagctggatcagtagcataacatcttttaacctcagttttctcatctgtaaaacagatatttgtaagaatagtatccataatatatgccaatctcttagcacaatgcctggcacatggtaagcactcagtaaatattagcccttatattgtagtcatgtcattgtttattctctagtatgatgtgccttacacaatatatctaagaatgtgtacatcacaaaaaatattttttttacccatctgatcatagaaagttgaagtaaatgtgaagaagagtggaaaataaatctattatctttcccagaatgagtaatggccaaagagtgagccttattatgagtgatatcccgaacgtaggtgctttatcaaaatcactgcactttctcccaagcaatgtcatctttattctcagaggtttatgcatgctacttttaagtcaatgggaacaactgaaaagaggtcattagctggaagaaaccacacaaaaagaaaaagccaacagcccctgccctgagggaaaacagaattcagggtactaccatgtgttctgtgacagcagcatggtgacaaaagctgttcccagaataagaatactttggatagcaatgaagtcttaaaatgacattttaatccatatattaatgcttcaaagggatccacttcaactagaatgccttaactcttctttttgcccaataatgctcctggcaaagaagggccacagaaaccatgaacaggagtggatgctgcttgatccattttctgcaaaatgagatttggggactggatggcttctaagctgaccctcaatgctaatggcccatggtcccaggtatcagatggtgttgttgtaaagacaagcattaggccaccttgttaaaacatggtgattgtggattttcatgaggaaattaattttagagccattaaaaataaaataccataaatgttttttaactcagcaaatatcttttaaaaagcagtgaaatatttggcttgacatgttcttttcttcatctctctctgtttttaaaactaacttatggtgccttgacaattttatgaagaatttcagttggcatctgtggagatctttataattaagccattacatttttctgaaacgtttcatgttttaagcttgtcttctttccactttgtgctatacagacacacccacctcttatcactgagacatttctctgcattctttctacccatttaccacagcatgtcatggttttgacagccatcttaagaggaggaaggcagacataggttagatttcaggagattttgggggtttttttttttttttttttttgagacagagtctcgctctgtcacccaggctggagtgcagtggtgcgatcttggctcactgcaagctccacctcccgagttcatgccattctcctgcctcagcctcccgagtagctggaactacaggcacccgccaccacacccacctaattttttgtatttttagtagagacgggttttcaccgtgttagccagggtgatttcgatctcctgaccttgcgatctgcccgccttggcctcccaaagtgctgagattacaggtgtgagccactgcgcctggccgagatttcagttttatacagagtagttaagacaatgaaggacaaggcattatgatactaggaaatagagaagtttgtctcctcttcatttgaaatttttagcactaaagagattagatcagaaaaatttaagaagaaatctgaggacttcaagtcaatggctgctctttgcaagccctttttgtccaaagtgtatcaaaataaaccttttcttggattgctgaaacacctgtgatcatgggatcagtacttttggagctatttctggttcaagagacattctcatgagagttcctttccaatcaaatctgtcaggggctgacttaaaaacctgtaagtgggccagacacggtggctcacgcctgtaatcccagcactttgggaggccgaggcgggcggatcacaaggtcaggagatcgagaccatcccggctaaaacggtgaaaccccgtctctactaaaaatacaaaaaattatccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaacctgtaattggctcagtgtaactcagactaagtagagatcaccaattaaaacccaggcatcctaaataatgcagtaggtacagaggagaaatagttcattgcataaaatatatcagaataaaactataaatttctctacttccttcagtatttcttcttaaacttaagctacctgttatttctagtgatctctaaatgcagaacagaatgaagacaagataaaaactacaaagatatcctatcaaatttgagctgatgctccattactaaggacaattggaattgatgcacacacatgttcttctccatcttttttatagcccaatagatctacagttaggctgtgtcatatacaagaagaagcctgaactaactaggccgtataactctggcctgattaacactttatctaatactttttctgaagtcttttaatctaagtcttgttttgacttcattgaaaataagcagtttgttggtaatcgccacacaagaaccctacacatacttaaagactgttatgagctcaattgtttatcccccaaattcatatggtgaagccttaacccctaagacctcagaatgtgatggtttctggaaacagagactttaaggaggtgattaagttaaaatgaggctgttacggtggatcctaatgcaatctgactggtgtccttataagaggaagactggacacacaaagagacacaagggatgcacaggcatagaggaaggactatgtgaaaacccagcaagaaggtggacatctgcaagcaaaggaaacaggcctcagaaggaatcaaacctgctgactacttgattttggacttccagcctccagaactgtgagagaataaatttctctcatttaagctaccactctgtggtattttgctatggcagtcctagcaaactaatacagagataatttaaacgtagtttgaaataatatattgttagtttattcacagatctttcatattaagatgtgatagtattttgctgccagttgctaaaatagtctaaaagcgagtactcatggatttgcacacagaataaagctctgtgttaatgtcaaaatcatgtccattttaattattaattttagttaaaatgtattttgtcctgttctggttttgctgcaaattgtaatattctacattacagtcctggtaattagtacagttaccaaataaactctatccatgtacattttttgcatgactaaaactataaaataatattattttcatcatgaaatatacatgattatatgtagttccattaatgtatatagaacaacttttccaaaaggaactacttaacctctcataccattaaatgaattttcttgaagaaaacaaagtattttctactaccattttcttcactttgtggctccttataacttccctccttgtaacacctgctacgcggatgactgcagcactattaaaaatttactgtcagtgttagctttccaagttatggaaaaagtctcagtgcaaaacaaacaataaaagcaactctgcataagacaaatccttacttatgttaatgattacatgcggtgacattgtcttatttaaatatgcttatattttcttcaatttggaaactactgtgagatcccaaaagatacactgtgtccacttcaaaaactctaaaattctaagtaccaaaggacaagcacatatttattcacactaatttttatccttaggaactgcctaagaaatttaaaaaaaaaaaaagaaaaagtgattttgagagattataattagttttgtgaggcttgctaaatagtcatggcaaaaaaaaaaataaaacagcaactttcactgttaatttggaatgtttatcttctactcaaaactgaacgaatgtcttacattgttgtgctttttctttggtgcttatcactgaagaagaatgccaattccaagcccaacttggacatatacctcagtaaagctgccctgcagcagggctgaccacctccactgaaaatgcctaggcacagtgaaggcccagcaagtggatgacggcatcagctggtcctaaaacaaaaagacttgagtactatatggatgtaatgacctcaagatcccctatatttcctaagaaattagacatagcttcatcattttcacctatgaagacaaacttcaaaatatttttggcctgctttttacttaaaaaaatgcttatgaaaagggagtggacaaactttgtctatgcctttgtcttctgctctcttttgatgttcctggagcctatacccttaggaagaacttgatcttgaattacaatatcagtgtccttcaaattccacttcccgtgttatagtaagcaatgcctggactgtcatgtcacctagcttagctccagacatttgcagacatttattctggcccctttagactattccctgcactttagccagaaaaattatttgaaatcatgtgttatctgcaacagactatgtgttccaagggggtagtgaccattcctgcactccatgctgtatccctagcataagtccagacacatagccggtcttaaataaatatttctgaataaattactgaattcactgggattacctctcctcagtctcttctgtcttccactatcctttgttctaacatggcttatcaatcataattaacctctagaatacttatcaggcctcactcatgcttccagtttcttttccatgatccagacttactgaatttgccttctattcctttcaaatcctgctttttgctggcgaaaataggtagtcacagtagtgctcactttttttaatgcagtagaaaaagagaagcaatttgacattaatatttagatatggagttaacttccttcttgaaacttgacataatgactctctgctaatcatttgtagagatagtcaacaattctagtttaggtaggaaaattgagaataaaaaaaaagcataggcctgttaatctctttttaggaagagtttgagcattctgattagaaacagatgtcatataagctcttacacataaatgagtgcactattagtttgatattttatcgagaaagaagcaacatgaagaaaaataggcatattttatagcaacttggtacttaatagagtttatgccaaaggaggtcagtgcaatgcattttcttttttagtttttgtttgcacattttttaaggcctggaaagtatgagggtatgagtaggatcccagctgtgccaattaatgacacatataaccatagatgctttatttggctagtctttaaaataaacaaaaaaattataggttgccagattttttgaggaagaaattttctttgatgactgagctaagggaccccaacacagtatattatcaagagtacatcatttttaaaacattttatattatcactataatttaggtaaaattatagtatattagcactagatgatgtattcttcatcaaaaatgaaaagtttccttttagtagccatagaaggaagagttcccaatttaaatctcacgaaatcttgctttcttaaatatgtaaaatataacacaagatttatggaaaaaggtagtcaagtctatttgatttttatggaggctagaacattccagattcaaatatcatgaataaactcataaacaagttactatatcttctgtaaaatggggataatttatgaggttacttttaagaataatatgtaatgtctgtaaagttgctgggaacagtttctggcacatatatatgatggctactattgtttttatagattacatagaatcacagatccttagaaataaaaacaacttgagctagaatctggtgtaattcccatccaatgcaggatgatttgataatcttgacaaattggtctcttgagctctatagaattagaacagagtctaaaagttaccatagcccaggaagagttgaagtacattatcttataaaactactcttgttcatgctatttcctttctaaagtaaatgtaaaaagtatggaaagagcatcatcacaaattgtgaatacaatggagcttctcattttggtttgttttggtttggctatacatgaaataccttaattccattcagtcattatgcttagtttatcaagttagtggccttctggcatattcaatacatacaacggtaaagttcacagtgtgaaacttaaatgacaatacaatgaaaacacaaacagatctaatcctagatttcctattgcaagggcaagaaattgagaacactgtagtcaggaaaatgtatatcaggaaaatgagatttacaaacaatttatatgtatagaaacaaaacaattaaaatctgaaacagactccaaaatgtaaaatatctgacctcacagaaggactttgaaccctattatacacctttcttcatccatgcaaattctatttattctattagtctactttgacgagtcactgaagaattgagaggcaggaaaatatatgatgaaagcaattttaaaaagataaacatcttggctgcacaccagatggattaaaataatggagactggggaggaatatttattgtttatagctgataacaggaaaagaggcccaattgtgtaaaaagccttagatcattaaaataatgtcagcccaagaataaatgcctcaacaggaataaactgaacaccttatcataatcactaacttagactgagtctagtttctccaggtaaaattcaggcagtagtctcagctctaccagtaggcactgcatattacaggaggtgacaaatgttccagattgcctcaaatatcttggtttgttcctattatataggagtaactatcaatagtgcttctttttttatcagaattgtgtctgtttgaatgataatttttatgatcttctaattatcgaatgccactgtggaaatttaaaaaagaaaactttcctggattgttatagcttaagcaaaaggcttgggcaatcccaacgtgcttggtgacaaaggaaaaaaaaaacagctctactttcaggaaatctggctatgtacatgcacatgacttggagacccaagcacagactgtatttcagcctcgactcatcccctccgctgggactctggggcagcacccgagctgtctaactctacacagtgccctgtccaccagctagcatggtttctctaatgttcatttaccaaatttcaaatgaattccttagcacccagcccacattttactcttctgtgatatcagccttgattactgaacaccattctgttttctaaaattgtacagaacatatattttgtgccactcatttgaactatgtctttcttagtaatgtcttcatagtgttttgcttggagtgggtttggggacagaagcggtactgcacttaatgtctgccagggtcaggaggaacaatcttaagtttttggaaaggtttgtctccatttatgtgaactgaagtctgacagccaagagaaaataaatttgttcccagaaagaaatacaaactaatacggggaggttagtgactattgcagttgcaggattgcaaaactaaactattttgactaataatatagtggaattaacttttactcagcacttactacttaccaggtttttaccaatttctaactgttttgaaattaataactcatttaaacatcaaacaaccttatgaggtaagtactgtcattgtccccactttttagattaggaaaatgagattaaagaacttggcaaaaaatttcacatctcatcaatgtttgaactaggatttgaacccatgcagtctggcttttgaatgttccctctgaaccttcatgctaacctgcacacttaacttgcattaagtttgtagcatatgtctggtttgatcatttgatgtgtggtatatattcctacagcaattttagtcattaagaggagtattcaagttagacttggcactcacttctccatctagacaaagaataaccagcagacaggaagaacactattatgagaatgcttctaatcacaaaggacccctaaacagcccttacagatctgaatagaagaagtaataaccagtggtatcacaaccttagcacaacaaaggtctgagcatcatctgacctggtgaggaccaacaataacattttatgaattattttttaggggaattaagaattatttattaggcagcattgcataatcctacaaagcactggagtaggctttagaacctatggtgttggcaagtaaatgaatctccctgtgtttgctcatttatcacaaggagatactgtaagctgtcttataaagattctgtgagtgttaatgcaataatgtttgtaaataaggtatgtaaaataattagcatattgccccatatagagtgcccactacagactgcatgtctaacttattgtttcggatactagctcttacaaataggcaggaatttcaaaaggttctatgaatgtttggaattttggatgagttctgttacctcttcaccccaatgctggcgcaacatgaatttcctttattgaatcaatttgacagatttaacattctatttgaactccatttccataaagcacaggcctcatctaattatccccaggtctgccttctactgtgattgtgctcattctgcctttctttttttactaaagcaaatcttttcatttaaaaaagcttccttttgcttgtttcgcctctaaccacaaaatgcactctcgtccaagtcctctgccaacctgagcaataaaaataataaatgagacaactgaagactctacttggacctttaaaatgctccagcgaaggtgaccctgaaaaattattatggcatgttatcaattaggtgacactatcaagaaaaatgaaaccaaaatattcctttattctgcctgattttatatctcataaatcctgctaaaatacttcattggaaatgcatatggtaatatctagacaggcttatgttagatatattctttttggattctcagtggacattttacatattagggccaccaatatagataatatgcccaagatgacaaattacttcaataatacttaacatgaggaaagtctgtctcaactttgcggggaggggtaaacacagctgctttttaacacagttaaattcataaagctaaaaacaaaacagactttaaaatgtttaaaagtctgtctttgagaaatattctacccatgaggctaaatttgacacaaaatattcatcatcataatttaaattttaatatatggcctatttaaaggcttcatacttcaaaaggtttttacatttattttgtcattctgtcttaattaagaaccaactccagtattagattaagttacacctttggattgttagaaaaattaggttgctattcttctggaataaatctacttttccaataaacacatgaacatgtcaaaattttttttaacaacaaatgcatttgacttacaattacacaaaggcattatgtttaattatttttttctgaaatgttatatagaattgagtaaaaggtatttttaggtggaaaccatttctaaactcttatttcaaaaaaaaaaatcttatagaatgagagttccaaatacctttcattcagctttcctcctgttaataattaaataaccattaggcagttatcaaaaccaagaaagtaacactgataataaactgttgactaaagtatacactttattttgttttaccagttttcaactaatgtcctttttctattgcaggatctaacccagctcccacattgcattaaactgccatgtttcctttgtcccttcagatgtgtctttttttgtaattcgtgtagttaacacttttgaagaatactggccattttgtaaaatgtccctcaattttggtttgtcgtagttagatggaacttatggatttttgttgagaatatgaataccaaagaagtgaagagcctttcttagcatgaaggttcatgaagtcaatattttttattactggtgacatttaacttgatcacttaaggtgatctgctgagtttttctgaagaaagttactacttttacttggaggaaatatttttagactacataaattactaatttctactgaaaactttttcgcacttattttggtatctattagggaatcccgacttcaacaatttttacattgggattctaacgatgaattcctatttccatcatccttctacattattaattgtaatttttctgtatgggtgagctgtctctgcttccctatttatctatctgtatatctttctttctatctgttcagttacttgtttatatctctatgggttcatagatgtttattttactcttttggttataatcaaatgacatatctattagttttgttgctcaatttgatctagttctggcccttggaagttttttcggattagctcttacgctcctttgtcatgcttctctctcaggggtcaataaagtatgccctacaggtaaaatgtgtccactactatctatctaatattgtaaataaagatttattggatcacagccacacccattcattttcctattagctattgttgcttttgagctataatggcagaattgagtaattgtgaccatgtggttctcaaagccaaagatatttaatatttggccttctatgatgaaaatttcttgatctttgctctaggcgaattttctttttttaaattatgaactttgaatagtgcccaaaatgtatttaattgttatatctgaggtactttagaattcagactcttgaatgtatatttttcctatattctcctaacttcattagttgtaataattttgatgctagacatttattattttgtttgaagaaaacaaaatggattatcagtattctattgagtttaaaatactaaatcatacagaataagaaaataatggtgagacaaagttgaaaaattatctagtaagaggagcgaaagagaaaaattgtcctcttgcatgatatgttttaaagtttcctaaatacatgcaaaggcctttattaacttcttcccataataatgaacggtaatatggtagtctcctcttattctacagtttcagttacccacagtcgaatgcagtctgaaaatattaaatggaaaattttagaaataagcaattcatgccatttcagtaaatggcatgcaatttaaataataaagttttaaattgcatgccattctgagtagcaagataaaatctctggccatcccactctgtccctcatgacacatgaatcatcccgttttctagtgtatccacgttatatagtcggttagtcacttataagtagccacctgggttatcaaatcaacagatcacaagaagaagggtgagtatagtacaataagaaattttgggacaaggagagagagaggaagaggccacattcgcagaacttttattatggcatattgttacgattgttctattttattactagttattgtcactaatctcttatcatgtctaatttatacattaaattttatcatagggatatatgtatagggaaacacatagtatatataggttttggtactatctgtgatttctggcatccaatgagagtcttggaatgtattcctcaatggatacagggggattattgtactttccagagatgttatattgatagcaatttttatctttatgatattggacacagttatttcaccatcccacttcacaatcatgagatgattcactgagagacctttccaaatgaaactctgaaaccatgcattttggttttaaggatattcattatgtaatgccccaatgttataattatatcaagcatagtatcagtgcttaaaataaatttattagaaggataatggcattcttatgatcctattttggagaacaattgttttaaactggaagtacaaaagttggtcctattctgtgaaaaaaaaattatctgagctagtaaaggctacacccagagggctatgtcagtggttagaaggttattagcaggttagtaaagggcagccacatttcattggaagcatgtttaattaggggaggaggaggtttctcctcatatgttcattacacagactttattttttcctctaatatctcaatatcctcaaagatcacctagagcagaggttctgaattctaggtaaatgggcctaaggatgcaacccttaaacataacatacataattttgtatacaaatgtagatagatgtgtatttttctaaagatagaatgttctactttattggattcctatggaggcagagattcaaaggaagttaagaaaaactgatctagattaatgtctaaaactaaatacagttacctaagctttatactctacataggaccttgacaccagtgtatgatattttatcctttttgatactctgcctcctcttgacggcactttcatttgtttattagaagttaagtgacattaaaaccaacttattcctggccaggcgcagtggctcatgcctgtaatcccagcactttggggggctgaggcgggtggatcacgaggtcaagagatcgcgaccatcctggtcaacgtggtgaaaccccatccctactaaaatacaaaaattagctgggcatggtgttgtgaggctgaggcatgagaattgtttgaacccaggaagtggaggttgcagtgagccaaattcgggccactgcactccagcccggtgatagagcaagactctgcctcaaaaaacaaaacaaaacaacttattcttgagcttacaagatacgaaaagtgggtagacagtggacaaatataaatagcatgaaaatcatgagacttgttcatagttgacattcaaataatgacattaaagctgagaaggaacaaatcacatagtacagttttaaaaattgttcatcatacaccaaaatactagctattatgtattatcattataaaaatatataaataaatatgtctgtgctatttaataaaagctcctgaagatataagaactcagagtgtttgagaaagtattacgagaaaggcttgtcattgagttgggaatgtgacttcttcttccattaaagtcagctatttataaactataaactatatgataaaacaaagatacttttaggtaatagtcaaattataaaagcgactgttataaaatataaatattaaaatcaaccaaatacttgtaaataccatctgaagtttcctaaaaacctaatactctttaatatgtcattttttccggccttcagtgcttagctattcctataacttgtttccacctcatttcctaaaagctagatttctgcattgtagtgacaattaattttttatatctgacatgattaattcattttttgtaaccagtagttagattcattaacctgattacccgtatctttggtgaaaagtccttcaagacaatctcagccaatatctttagccacacttatttaaaatcatgataatgctattctctgtttaacgtgactacttttcaggagtgagaccagtataacccttcattatgataagaacttaaattgctaaacaaattgtatgttggaaacaataatggcagacaagaagttaaagggggaaattttatgaaattttatgaagggctgctatttgtatattacaacataagatatacttggcaaaagttcttaaacacagtaatgattaataaacatttctcaatttgatttgatgggttggtttctaagtaatttgttttcagaatctgagaacttttaaaagtaaaaagttcattaaaaactcgcaaaacagaataaatttttattgattaaatgtttcaaaatatatttaactcatttttaaataagcttaagtttagcttcaaatacgtaggaaactcatgagttgctatcctactttattgagctcttgttttctgatagtgataataaaggcacctatcctccccacacagttgcaaaaaggattaacttaagtgagagacaaaaaagtactaggagaaatcgggaaagaagaggtttgacttacatgtctctatgtcattcccaatagtatccaaatagcagatacccaacacgtatctgaagaaattaatttctcagattatttcaattttgtcagcaataaacatttaataatgcatttgttttgggggcaaaaaatcagcatattctgaaagcagaaaaaaagggcctgtttgggtttcactgagctttcagaattgcctggacaattatcaaattggccctgtgatactctgtatgttagcttctactacaagagaactttatgaaagtcactgataggtctcattgacaagtttcctgggatggaacaaagaacatttccataactacatagcaataatggaacaaaaatggcaacttacagacaaactacaagatttcaatttaaggaatgaagcagttaagcctagttgatataatatcctttacttctgttttaccacaactcttagaaaacatctgcattatctgtttgccaacctgtgtagtttaaatgatgccaaaacccatcaaaccatcagagaatcttgctctctcttttaacagaaaataaaaaaatgctaacatggttgtgtgtccagaattggtgggttcttggtctcactgacttcaagaatgaagcctcggaccctagcgctgagtgttatagttcttaaaggcagtgtggacccaaagagtgagcagcagcaagatttattgcaaacagcaaaagaacaaggcttccacaacacgcaagaggaccccagcaggtggccagggctggctcgggcagcctgcttttattctcttatctggccccacccacatcctgctgatcggtccattttacagagagccgattggtctgtttttcagagagctgactggtccgttttgagagggtgctgattggtacgtttacaatccctgagctagacacaaacgttctccacctccccactagataagctagatacagagtgctgattggtgtatttacaaaccctgagctagatacagagtgctgattggtgtattcacaatcccttaggtagacataaaggttctccaagtccgcaccagatcagctagacacagagcgcagattggtgcatttacaaaccttgagctagatagagtgccgattggtgtattcacaatcccttagctagacataaagattctccaagtccccaccagattagttagatacagagtgcagattggtgcatccacaaaccctgagctagacacaaggtgctgattgctgtgtttacaatcccttggctagacataaaggttctccaagtccccaccaaactcaggagcccagctggcttcacccagcgtatcccacacggggcggcagatggagctgcctgccagtccggcgccatgcccttgcgcggtggatgagactgggtgccgcggagcagggggccgcacaggagcccgtggcggggggacactggggaggggaggctcaggcatggcggactgcaggttccgagccctgccccgcagggaggcagctaaagcccagtgagaaatcgagcgcagtgccggtgggccggcactgatgggggaccctgcgcactctctgcatctgctggccctggtgctaagcccatcactgccggggcccacagggccggccggccgctgcaagtgcagggcccaccaagcccacgctcaccaggaactctaggtggcctgcaagcgccgcacgcagccccggttcccgcccgtgcctctccctccacaccccccgcaggctgagggaaccggctctggccttggccatcccaggaaggggctcccacagtgcagtggcaggctgaagggctcctcaagcgtggctgaatgggcgccgaggccgaggaggcaccgagagcgagggagggctgctagcacgctgtcaccttttagttgccttacagtaactgtaaaaattctgatatttaaaaaatccaagtcattgataaagtaagaacaagtgagaagtctgataatatatcatttctttccatctccttggacacaatttctcagaagctaagcttagaattttaggaagacacattcaatatactacttaataaaaaagttcattatgtttcatcatttggaataacctcaaattcccagcaaaattgaacactgtgaaaaaagataattaaacaggaaaagtcagagttttagacacttgtttaatttactcagctactgtatttgtggcttcagatttctcagagtaagatttattacagaaagttagtattagtaaacatttaatgatttccaatggaaaccaaacatttatatattgaaataaatattcatctatgcatgtaagtatattttggctaaaaaccaccagaaaaaaaatgctttgacctagaagtttaaggagggatgttgatttattcaacaactatttattaagcaccttctgtgtgtcacaccctgattattacgtcttttgttagactctactcaaaattggttatttaaacaataattcagatattccatatggtttatcagtttccacaagacttatattttcactattttacttttagaggaaggaaaaaaattagtcaaacatttcccatatctatacatttaatgagaacatgggcaagtcttcttttaacaaactttttctcccaaatgattcttaagtattctaatgttctaatggtccataataatttacttaatttgctaataaagtttctctagtaaagttagaaaataattagtgcttactaacgagtattattgattcaaaactttagtgaaaacaaaatatggttattataagataaattataatttatcatataaattataaattctatggttattataagaaaattttttttatgtgttactatgtttaaatacccataagatagtcttgtgtgtatatgtgtttgtgtgggtcagcagaaatagcagactgtgacatcgactgatacagttaggatcaatcatgtaagtaataacatttagttatgaagaataggctatgctatgtttaaagatgcatctaatgatctttgtatattttactttatgtttcccagactttataaaggaaggtgcatagcttgtagacagcagtccccaagtgtagtttttactctgccactaacgagcattgtgatcttgagcaaaccagttggtctcttcaaggttccattttgttgtttgataaatgaaggacgtggaatagaagaacgttgaagttccttccctccttcaaatgtaatgatcatgtaaggtagattgctttaattacatgatactttgaaaaattaaattaaacaaatattaaaaaatcattaaattaaccaacacttcagtaccaaccctgcaatctctaaataatagagtgacttaaataaataataaattactgatgacttgaattaaaaataaactaatcttagattaagctacactaaaggtttggaatttagggtaataatatgacttcctgagccctgaaatattttaccagatttcatggatgaaaacagagttaaggtttagatctaatactcataagctcttccagacaaattgcatgatcacgagaaaagatttacaccatctctatggagtcttagagcatttctctctttctctcagatcctcttatccctaaaggatctctttatcttaccactccagaccaccattttctattttccttaaacttaacagtaatcaaactcggcattttgaaagttaatacattttatctgacatgttcaggttttctggatcctccttatctcccaatcagactaatctgttggcaaacatgaataataatgtctttgacttctttgttccttcctacaactggtttccatttcattggtacctaatgctgtctggtgacacacagcagcattagaacattgaataattgctggttaaaagagagagagggggagaggcagagaagaatgagagagagagagagagagagagagagagcgagccgaaaatgcgggcatgtctctccttctattaagttgttcattagcttttacagtgtattttgcattcatcttgtttattttctcacattctactttagtactttatcttttgatacctggattggttagtagtttcctaaatagtttgtctgtctctatcatttcctgctaatccttcctaaatgaatgcatgcttgaaaagacctaaatctaatttgctactgatttcacaatcttactgcaccactcacttcaaaatggtctcttcttccttggaacgagttttccttttatatcttattcagaaattagccaaatatgatatgataactctagcactttctcacattttatatttctaatcttgaacttttttttgcctatctctgtaaccagactgtaaatttagtatgttacttttatgtagtatatatcctttaaatatttgttgatttaatatgttaacttgagtataaaacgaacatttgaccttgtgtagagtgtaaaagaaatcttttgacacactgtgataggaaaacaaattcaaaagtttattatcaaagataactgtgatttatctgaagcaatctttagtcagggtaagcaagatgatgttaggctttgtgaattaatgttatgagaaagaaagtctatttttgtggagagagaaaattttcccgcataactgtaattagggacaaatcagagattaatgatgcattatattctagagctttaactgataagcaccaagaaatggctttctcaactttaaatggtttgtaaaatattatctctgtactttgctctctatatagaaaataatggatactaggtcttctattcagaaaattcaatatttattctaaaatgtaaactgttgagttacaggaagatttcatatactcaaaaagagcataaaatctacctctactaattagtttctctatgaaagccttccaggcaattacagagcagtaccattggtcaatgctttggttgcttttcattaaaggtatagtgttgctaccagatgaattgcttcatataaaagcacttaccacaaagacctataatggaggttaagtgctatactaattactaatttcaatccttattacctatattttgcagtacaggcactttaaaggaaccatatatagtctgctggttcccgcttctctgagtataagacttggtggtaaaagctctaatttagctgttcttctaataaaaataaccccaaaaattaataaaaagagccataccacaaactgacataaaatacatatactagactttgctactgaactcgtatttacaatcaccgtgtcacaaaaactttaatcaaggtgacacactcttcaaaatttgtattcagccattatggcaccgttgcagatgaagttccaagagaaaaaggtatttgaaattttcatggcttatttcctacctcagcatcacactgaaatgaacacagagcagatgattaataaaacatctgatgacaatggtgactcccctgagttctttatatattgatcattaactttttatatgtatatattgaaattcttcatatgtgctttattttcttgagggccgactctgtgttttaccttgcgtatatccttcagaataattgcaactttgcccactcttggtttatttatattttctaaaatacatcttggtaaaagggcatttaaaatctctgattaaatgttgaaagttgtatctgaaataactatatgtaaagatttgcttcttattacgatactgctcatttctatttttaaacatcttttacattgtgtttcttattctgaacaattatttaattggcaaataaggtactatatgtgttaaacaaatattaatctagaaaaatatgtacaaatatttttttcaaataattaataagtactgcctcaatctcagctaccagattcaaattggacattagtctgctacaagaacacaggaaccatatcttttttgaactatattcagtacatggcatctggtatgtgcacagtcaaataaaatatagtaaaattggggcatatagacatttttgaaaacataaaatatttactaaaatgcaatgatgtttggctaatatatcctatatttattttctatcatctatgcttgggtaaagcatcctgtatttctcttttacagatacattatgcatattaataaagtccaagtatagatattttaacttagcttaacccagaatttcccaaactaatgggactttccctttctcaccataagtagtaataagctctaggtaaagataccagtttggaaattgctgattaagtgttaaaagttactaaataaagacattttcaagaattaactatgaacacaaaaccatgcctcaagaggcaaatgccacactgcaatagtaacaggatttatcattttgcacgttcaggtccactgttcacagctgacaacatcccatgagcaaagcctagaccttaccctactatatattttcatggcatccagtgtgatgactttctctcagcaaataggcagtgattaatccatattttaggaaaattaccaatacacctttctgttattttattaaggttttagctattacttttaaaagcacattttttaggctgggcatggtggctcatgcctgtaatcccagcactttgggaggccgaggcaggaagatcacttaaggtcaggtgttcaagaccagcctgagcaacatagcgagacccccatctctacaaaaaaattttaaaaattagccaggcatggtggtgtgcacctgtagtcctagctactagagaggccaaggaaggaggatcctgtgagcccaggagtttgaggttacagtgagctatgactgccactacatccagtctgggcaaaagagtgagaccttgcttcaaaaaaaaaaaaaaagttaaattgataaagaataaaaattgaaattgcacatttatactaggatttcagataatgcaataatctgggattagcaggggctatgtaacattgcatgcatattaagttacttggctttcaaatcttccattacttcaccttattgtatatggttcacataattgtagtgtaaaattgtggtaattcccaagacatcgattcagcaaatatttactgaatgcctactatttgccagtattataacaggcactggacatattaatttccttgcttcctaactttgtcatagagcagtttttttattacatttaattcagcaaatattggcagagtactaggcttgtggaataggtttgaactagggcttgaagatttagaattctataaaccagaaaaggtccagaagggtattatagacatttcattccacaattgtgagtcagtacttgggatatttgatatcaattgaatacattggttatgtcattaaattacttctttcaagaaccaaataagtgtgatagaagaatttaaatataaattttgattattatttttattgggtaaaatagaaatgtatttttatactttttctttatactgtgttataaattgtgtgctttgcaaaaaacatagttatatctaaaaggggaagagagaaatgagactgatgcttttagtaatagagacgataatgattgcagtaaaatatctttatacttttaatttatatattacttaaaaagcatatttgttttaaaattgaggatatatacaaccacaagtaacattgtttaaaatttctaatctaccacctttgtttcaataacataatattgataaaactcattcacaataaacaagataatttttattttatcaataacggcttgacatttattttatagacttaaaatgagtagtgctagtgtcaaagaatcctcatgaaactctatggttatatgaaagtgaaaacaaacttcttttatgtacatgttcttataactgctgatttatgctactattgttttctcactagttctctacttatctcacgggatccctacactttaatgtgtttcagctgtgcactaccatctgaggaagcgttaggtcttattttctctcagaaaaaaaaagtgttataatattctttcccttagttttaaattttaacttttttacttttgacaaagcctttcctttgtttaaatgcaaggatccagtaaaaagagctttgatatgttgtgctttttatgtgtgcatttttctgatttcattgatgtcctgaattttgaaaacgataatgtacaccttcacgttctcctataaaatggcatttgtacactgtagcaagaacagtttaggacagcattacattcacatgactctaaagtccaataaatagttgatggtttctcagaaaaccacaatttggtgaaacggatgcaaaacagtgctttttcttccagtttgtttttcataaaatcttcccccgatacatattcacttgcttacctgcagggtagcgctcgatcactggccagctgtccacctgcaacgtggcattgccaccactcctcgtgaaacgaactacatggtatttcccatcattaatgattgcattggattcttcaatggcgatgtcatctgtcccaacattaaacttaactccaatttttccctggtgctgtaagagaggaggggaaaaaagagttgaattaagttgactagtcaccatttaataaagattacatacaaggtattgttttaaaatgtgctttggacaacagctgctttcctccaattttacttctgaaaaactacatgtagtagaagcaagattcttgacatctgggtaaatttaagacatctctttcatggataattgatattccaaaaggcacactttcaagggaattgagccgccttcttcccagaggttgtcacagagaaggcgcacagctgcctgcacaaaggacatccttttgtgtactttaacacaacccctttaatccactctccccatttcacaagaaaaacggggctccaaattcttacttttaataactggtgaaatcagagcaatgatgtctgtttagagcccattgacaaatactcacaataggggaaatcattctaaagggtatggggcatttaatgagtgcagtcccttagtcagtattcacaaaaccatcaaatactaacagcttgaaagttattcaatgtttttattttattgatgatgaaacatcaacattttattgatgataacacaggaaggtacaagacttgttcaaggacacataatagagacgtacgaaaactaaaattcatttcccttattcttagattatatctaagctaagttgaagcaaagataccgttatccaaaatgaacgccctcttcacttcttcatatgcaaagcctcattatgaatcattctaactataaagttgttgctgttaactttagaatttcataatataaggtggcaaagagaaacatgtgctatgtcctctgcctctgagaagcattctttaacaggactgtcaactctaccatgaaatcagttgatttctaaagcatgtggatttgtccttaatcagttgcacagaatacctgtgctgtaggcccttgtcagaacacataacctcaaactgtctgtggttcacccttcttcaaacctcagttgagagaaatcacacggaggaagaagggtttaaagtacacacagtccatcctttcctgtagaagttttaaatcagaatgttagaaacctgaagatttgggccacattctcttgactctttgtggggttctcatcattatttgaactaggcagcaggagtatggaatcagcttacactaagaatccttacggaaaatctttttcaaaattgtattaatcaaaggaaaatatttgaggatgttattttgcagtattgctcattatctccttcatgtagagatcctaaaggtttctgttggttttcttccccctgggttcttattgtacataaagatctctttcttataagttagcatgcttacaattttttttggtttgattagctttaggcttgacggatggtttaacttttttaaaaaatcacattttaacactatatacatgtttgttaaataaagataacttattatgtctcttaaatgagattctttaaaatttttctgtagagttatatcacatgtgttaaaaatgtatgtactaaattaattactgaaaatgagcaaaaagtaattctgttaaaataagaaaataatgcatgcttacaaaaaggtctgagctaaaaaaaaatctttaaaaaaatctccataagtctttgaataacgtttgaattttcattggacttttgctgtttgtttattagctgagtcagtctacacaatactaaaatgccttacaatgacatgtatttaaaagtaagggtcatgagaaatatggtggaaaataataagtccaggggaaaatatatactaaagtctctgcagctattaaaattacccagccagaagtgatggcacacatgtataatcccagcagtttgggaggccaaggtgaagaggattgttcaagcccaggagttggagaccagcctgggaaacatagcaagatctcgtctttactattaaaaaaaaagaaaaagaaaaaaaaaagaaaatctgggcatggtggcacacacctgtattcccaactactcaggaggctgaggtgggaagatcacttgagccccggaggctgaggctgcagtgagccatgactgtgcactgaactcctgcctggttgacagcgtaagaccctgtctcaaaataaataaatattttaaaaattaccctatctacatggaccctgagtttcctaacaaccaaacacatacgtagggctctatacattttataaatactaactctggtattcttcataacagttccatgagggagatgctattttatcttcattttacagatgagaaaattaaggcacagggtgattaagcaatttggctaaggtcgcacagctggaaagagaaaagctatggttcagatccacacagttaggctccagagtctggtccttaatcattacaccaggctgagtttaggactgttgtgccatcctatagctgtagctagcagatttggtaaatctagctgtttttactacctgttttatctctcctgctagaatagcatcactaaggggccttgtattgttctttgaagttagtagacatgtatcaatcaatgtatgtttaaaataattttggaataaattgtaagcaactgatatgtggatataatagaatattaaaatgattctttttgtttcagtttcagctgagatgttaacatgataacataataagtcaaaaacacattactgtttccatcttacaaaatgaagcataaagttacttaagccagtcttgcaaaggagaacactgagaactgcttttagggtcctgaattaattacctacttctagtccatcaaaatgcagaaaaaggcaagaggagactgacaattagaagaggatttttggagacagttgagatgtgatgtgatttccacatactgcagggtggaagtctgcttttccctatctcaagtgcaggagaaagggacattagtggaacatctaagaaaatttgatatgtgtcttctgggacttggtgggtggcagcggtcaaggtagtgagcaaactagtatttgactataactgagaaatcttcaagggaagagactgtggcttgctgatgcccagtggccaagcaaagagatattgatgtaccaggagccacttgtgcattagggtttgttaggacaaaggacacttgtggaccctaggttagagtctgtgtagaattgtattgtatcctgtttagcagggttactaaagggattgggctgagtggtgaagaaaactgagaaaagaaaagaaaaaaaaaaaaagaacttggaattgcagtgatagatgaccagatggtgaggtgggaatcctaaatgaccatctgaaggaagtgcatttactacctcaatggaattgcaggtaaattctaataatggggttaaggtctgtaaagaaccaaatgcttccgaaaagtgcctccttaagaactttaagtataggctaagctcaactagatggctacaataatactagccaagtaaggtcatttctgccctttatgtcttctttcttctgcttcatccctggaggaataagagagggagaggaatagtgaaagccatggaaacaatcgtgctcctcccagtgcaagtgggggctccactgtggctgaagcagggataatgaagaggctttaactgacttctgctattacagaggagtaagctgattttactttttatgtctaaaagtgaacggatgacctttttactatccaagagggagcaaagcactgttgagactccctgtggacttccctggtggttagaaagaaatatttttacagaacaagtttaattcctgttacaccttgggaagtactttcaacacaacaagtacaggaagatatctgttactctagggttgcccattgttttagggtctcgtctattatagacctggttcttatccaggatacactggaaaaaattcttgcagtttcctacttattatgaaacttattatggaagtaggccataagagcctattttcatcagagtattaattattaagaaggtctagattcagtgaatagaagcattgcaatgttaaaggtgaaaaatgcactaaactctgaaataagtccctttaacttaaccttaaaactttctgcaatatgaaatgcaaaatgctcattttctaggtgcagaaatctccagatttcataggatttggtttttttgcaacacaataaaataaacaatttagaaacaatgagcatccgtgatgcttggagaacatccgactttttttttttttaattttatatatatatttttttattatactttaatttctagggtacatgtgcacaacgtgcaggtttgttacatatgtatacatgtgccatgttggtgtgctgcacccattaactcgtcattgacattaggtgtatctcctaacgctatccctcccccctccccccaccccacaacaggccccggtgtgtgatgttccccttcctgtgtccaagtgttctcatatcatttgacttttaaatgacgcccatctcttcttggagatgttcagttgttgcctcaacttcaaatgtctttgacatctcatggatttaaactctagagttagctagaatggaactgaaggctatcaaaataagggttcaaacaacaggcccgaccctaattcagacattatctacttcaccccaagttgcatcaggctttgaaaaacagtttaattataaatgatcgccaaagagttttccctgaaaacaataaatttaaaatacacataaagcacaaaatactaataacaagcatatttataagaccggtatttactatttaattcagaaactatagatattcttacaacacaaccatctcatgtttataggatagcaagtcatttaaattatataagcaataaaacgtgctaaactttcttgccaatgcgtaattacaatttaaaagaattcatttcaaactcttattctctgggattaaatatgattgtcttggcaaattctcatgaatattgcattagcaaaaccagaagtcatttcactggacatgtctttatctccctgtacatgtcttgatctccctgtactgtatattccttgaaatagataactggctcaaatcataatttcaaaaatctcttataagaatatcagtaacgaggcatttataatttaatgaagactttccatggattcattaaataaacagtgacaatggtaattattgatttttttacaaaagctcatttctgaataaagattatattattaaaccaagttaaagggaaacatcatgaaatatgacactgggaaggtccctgaaatttctagcaagtggcaccatagtttaatgcactgtctaattccatatgaaataacatatgcacttgtaagttttatgttttaactaagattaagatttaatggtgtaatcaatatcttgggtatacttcaagcaagatgtctgcatgttacagatgcatatataatatgtgcctatgaaatggataaagcagaatacacgtaagtaaagatttcggtctacatgtggcatacagacatgttacataagattttagtgcactgtttcccctcaccccattcttggattgttatatagaaatgtttggctcaactatgctcaggaacagagaccagtaacaaataaaaatgtctctctctgtgtctgtttactatactcctagagagaaggaccaaacattgtgagcaagtgtgcaactcaggagggcatgtagattagcagggagccctgtttacgttctgtaaacttctgtcatgcaccatagtacagtccagtactccagggccccactttggacagaactcaacaatgtctttaaatgctctctctatgcttgtactcatttcagaatacagaaagactcccatagtccaaatctacattgttgattgaaaccagagttgggtgaatggaatgttttgcttctccagagactaatcctcaccagggagcaaaggttttaaggcatgaaggggagtctggagcctatagtcacagttgttggactatgcaacactgcagacagtatcagagagccatctgttatctcacctaaaaacaaacacactcagataattgctaatttagcccaaacacttttttttttttttgagatggagtttcactcttattgcccaggctggagtgcaatggcacgatctcagctctctgcaacctttgcttcctttgttcaagtgattctcctgcctcagcctccgaagtagctgggattacaggtgcatgccaccacgcccagctaataatgtatttttggtagaggcagggtttttccatgttggtcaggctggtctcgaaatcctgacctcaggtgatctgcccaccttggcctctcagactgctgggattacacgtgtgagccactgcccccagccacccaaatacatttctaagtgaattacttagaggccctcttggctggtagagactctgtttaccaatttagatggcctataatggtaagaagtggttttaatctagttgttttaacctggcactgagatatacatgccatcctctaacccccaaaaagcaacaccaccacatcaaaaacaagaagttcctgctgccctgtctcctattttctccattaaatagcgtctgtttaaaattcattcaggtaactaataaaaagtatgtaatatgcacccagcattttcctactactgggaggagaataaaaacaggtaaagtctgttttctgctcctgggaaaactttcaatcaaattgggaaggtaaatcgtgcatgcaaatactcatacccacaaaagagttgagggagtggtggggaaaagcacaggtgcattgggggaagcatctgaaggatctctggaagcctcaaactgccatgggagcaaaccagcatttggacagctctaacactaccagcaggttctaatgcaactcccagggacatagaagttatgttctgtctaccttctatctctcctttcaggccccacataccagactactcactatgtgccaggtattgagctctatacaatgtatctcatctaaaactcccagcagacctgaaaggtaagtgccattgtctctatctccttggaaactttaatcttgctgaaatcacacagccaataattatgggtactgaaatatgaccaatttggtggggcattctaaaactgaataatgtcagttgtgtcagtgttccaggaaaatgtcttgaaactaaggcacccttagaggatgagtcaagaggagggttactacagggtgcatggttttgtttttggttttagttttttttttttttttttttttttttttttttttttttttttttttttttttggctagttacattttgtagcactacacaataaggaatcagaagtgggcaagatatgtgggcaataccacctcagaaacatctcatttaggagtaatacatttttaaaaaacagccttttcatttccccatcaaatcttcattaaggatagtgtatcttttctaatatgtctccatcctacaggatgctgtagctccttcaatgagactatattctggcagcgatattaacttcctggaggcttaaattcatctcttggtcctaagaatgtctaataaaattttctaagcctgtgccagtcctcctccacacactgccttaggtgttagtttttatatgcccatttcaacccctcaaacctattaaaaacaactttagggtaggaaaaaagcctggtgtattcctcattgtatccttcaccacacttcccagaatacctttctttacttttgcaaatttccaatattctttcacatcaattttcttttttttaattgagatataattcacatatcataacatttgcccttttaaagtatatggttcagtggttttagtatattcacaaggttgtgcaaccatcaccattatttaatttcagaacatttgcatcatgctccaattttcttttgatgagataatgcatacaaaattcttagcacatttaatggctacatagttcctgttagctattagcattattattattattgctacaattattgttgttattcatcactttgaaaaacaatgtttagcttcaccgtagtttgatggaagttaattaaaatattgcttcaattatatagacatttcggttttgctagaggatacatttttaatgattacaacttgtgaagcagggtatctattttgtaaatgggaaagctaaagctcagaaaggctgagacttggccaaagtcagagcatctatctatgacttggatcaagagaggatattctaaaatctacctgtgctcaactgtaagataagtggttctcccgttgattatgctgaggcagagcatgcttgattagacaacatccatgtcccctcccatctcaatattatggttctagggaaatcctaaatgtaaggcaaagcagttctcacggaaaaaatttagatattactagttgagttttttgaaacacattgaaggtgcctaagtttgaatttgagtctctcttagatttccttcaaaatttaaaaaaatagaaaaactctaagattttattgtgtttttaaatcagagattctccaatttaggaggagaaagaggactttgcattaggttgaagtatcagtaatctgtgaagccttttgtgaaccatgtatgtttcttcccaagaaagtataatctctgatggaagcgcttgccattattgggaagagcccctgccttgtcaggtatgtaggatttagtggtcgtaaagtgagaaaaaggatggacagatcttgagctccagtgataacatcaaaacacttcagtgcttctatttcctcattgtctctccttagatgaaattaaataaaaaatcaaaacaatgtcaagatgaatttagtccactaagtgactggctgctggatctttgaatggggtaataatcttgatatcggtattttaagatattctcaattttgtttcactaataaagccaatactggattattctttacacagtatttgagaagacattctcaaaccattatgaagttctccagtgtggccatgggtacagacatatcatcaagccttttcgtgatacttcccccttccaaatagcatacgtttgcagatatcacgatagctgtagaataaaataaagctaccttagcctcttgtgaatcagagtcatctcattgagataattaattctgtatctccatccactgagacaacaactactatgaagttgaaatagttgcctttaaatgtgtccttatgtgtaaagaatgtcttttattatttttctccctgaataatcaatgagcagaaatcaaatagaacaagaaagaggcattgacttggtggcctatggaaccttcttaatttttcacaggtaatactttccatttggatagttagcctagtggtctggcatcataacaaatactttaggttgctgtatgaaaatctcagcgtcacactgaattaagttaagccttttccaaagtgtaatgagctgatcagatgtgtattacttgtttttgttcatttttttatatttaaaaattattgttgctttaaagacccttgttggaatgttaaattactttttcttgtacagtcacattgtacagtaattcaggaaactatgggcaatacattgtgtttcaggtgctgattaaaaccacaatctttgtttattctgcatctgcctgaatccttgtctttggaccattgcactctttgatattacctccaccaggaactgaacaggaaaggggcattctatcaattctgctaattgttgacattttttatgtaaaaaggttttcctataaaagagctttgggattatttgtggatttcatttacttgttatatcccaggatcatcattttccaggagacctgactatataattacaatctaactctaatgttccaaatttccatagcacaaagcccaacatttttcagacaaatagacagaacatccttggattgtaattttagtcctctgcatggcaaatgtaaccttagtaactcggttataggtaaaacaaaatgaaccttcgtattttagaaaatccttaaaagacgtgaaaacatatcaagagattaatgtaattattttcagtgcttccattgatataagccataagctacatacagtaaactgggaatggaaagatcagtttggaaggagcactatttttttaaattctatttgtgaatcatgacttgcaacctaaaaacaagagtgaggaaatgttttcaagtgtgtttgatggactgacttcctaatgatgctatgttagttttcacaagcctcaagaagagccctaccttgaaatgcatcccaagagaaaagctgacagtgctaacttttttcttttcgttttctctttcttattgacttctagtccaggactagctgtccgacatccttaggaaaaaaatgtgtgtatatgggcatagaaatgcatttaccaatgaatattttctaaagaatcagcaaaactctgttatccctgaagtggtaagtaataattcctacagccatcaaaaataaatctatgttcatgtgtgtgattgtggcacaacagaggagaatatggaatctctaaggcagaaattcctaatgattataacttttttcatcttcacaaaacagtaatacctccacaaaaatgaagtaatgcagaaaaatatttatcaagtgccttttagctgcagtgaattttgtaaaacaccataccactcatcccatgactcaaaactgataaaatgtgtgttgctggttatatttatatacatttattttcctcaattgcatggttttctggcataaatgacactaaaattttggaactaccataacacatgaagttcagtattcaccaatatttatgtacttattcaaaaaccacagactttttactatactcctggcactctgttaagttctggataaatatggttaacaaaccagatggtgctgctgtcattatgaagcttaagtctcacattattcgttacacattaaaacttactgtagcatatacagcatgctaagtttcaagaaggcaaagagtaaggatagcatgagaggaactgaataatttaagcaaagtctccttgagaagctgaagatgagaagaaatcaataatgaacatttagcattttccaggcagagaaaacagcatgtgcacatagcccagggagggattgtacaaagacagatccttttatgaacaaatgcagacacagatataaatatgtggactctttatagctattaagatgtgcaaattatatgtgaacatgtacaggtattcaaaatatttgtataagatataaaactaggttatggaataatgcgtaacaaaagtaaaatatattatttgcacaaatagagcaattgaaaaatagatggtgaagcacatttaaaaaattttccaatcagagaacagaaaattgttgaatatatgtagaacctaacagtatgcaacctgacattcatctaattgtttattcctaagtgtcattcatcaatgtgcattatgaaatgcaatttataaaagacttcctgaatcaacagggactcacatctttttcaaaagtcacttacttctacaatgtcaaaaaagattcatcattctacgctcatatttctaaactaatgtaacatgtttagtttctttgtgtggtggaatgtcttgttaacttatttatccagagagcccttttatctcaagatgtagtaaagagttatccataaaatttctgccttaagatttatgtctgaaatcacttgactggtttttcaagtaccctccttaaattggtagaagaatgcaaagttttcacccttgaccctttcaccttcctgttcactcagaagagcagatgaacagggtttaatgcctgtgtcccaaaatgcagtcttccaggcagtcaaccaatcacttcaaatgagacgaaggattctctatccaattctacttccagaaaaattttaaataaatgaagttaaatgagcatttgccctgaaatttggccaggaatcgtgaagccaaaaacacgcgaagtgctcaaattcaagtaactcatggacgttttgaacttgagataaaagttcacttgtaacttctccagagcagtaaccactggaggctctttgaggtcatcccttcccattgtttgcctggaaaagcaagagaatattttgaagacagttgtggacgtttagctcagtaaagacagccgaaggaataaatacctggagcaatgtcaacttagcagccattgaccaaacaaacaaacaaacaaacacactttctctcttactgctccatcacactagcttttcatttccataaatgtctcatgttctgacccatctcaggcccattgctcttccttctgcctggttagctgtttccttgccttccccatcccaaaataattgataccctatattgtttggagataattttgagaacttaaggatagatttgggcattgaatctgctgaataagggatagtgtttgtgaaatatcatttcgtgaagcaaaaactcattagtggtcatctactggagtacaaaagacatctacttaaaagtctgggctgacaatagttgaaaagcaagagacatactgggaggccatttctcttctgattagcagaattatttggtggactctgactatttctgataaatctttaagtactaaatatcatagcaagaaatatactgttgtgatcttgcattccatttatacacttcccctgccaaacatgtccactgttttaaaataaacatgaacaaaacctaatagagaaggtaaaaatgcactgagagattaatcagaaacatcattctaaggccaagtggaaaccatatgtaacttattcagtgtttggtaataccagtgtcagagctctgaaatgagtgtggatattccagaagggcaggatttggcagcagatgcgtgatgatgataatgatgatgatagccatccttcttgccatgtgtcagacactccttctaagcactttacaggcaataatacgtatgaatatatatgattattttcatttaaatgatgaggaagctgagcctcaaaagcttgtcctaaatcacatggctaataagtatcagagctgtgatttttcaagcagtccaattccagattttgtgtgctaaactataccattgctcctctgaggaagtccaacatgcttacaagaggttgcagcttgtttagctgtggtattaataaggctctttgaaaaagagagacactaacatcctcattattgtatatatcaagtaaaacatcaagtacttttcagacctccactcctttaattctcacaataactcattttgccagcctaccaatctccatgttgaggatgtttaaaactcaaagcaaggaggtacttttctgaagtcacgcagctaaaacatcaatctagttacattcaatccaggtctatctggttccaaactaagagctttcaaccacatcatgctactccttctgcagagtcttcatgatcccctagaagtagtaggggccagatgagagtatcctagagctctagacgcttaccattttaggaggtttgtatactgataagttttccaagatgggggtggacagacgcagcaattcctctttcatgagcattaaattagtccagttgtttagaactgctagtaagtgaaatattaatctccattagggccagagcagactttgtcatacttcaagagccagaaatggaagtactatcttttaggtttaattgagattctggagtgtcagcctattttcagagtctgtaagagaggaacactcagagaaatagccagtgtctttcctctacccaaccccttcccacctagtttacatccagtttttctctagtatgttttttgtttatagccaacagatttatttaaatcatatttatcattgcttgctattttgaaagatgtgcctcaagcttccaatcaaatccaaaagaatacataatcatcaaaacaaggttagtcatggagttttctactaaataacatttgtgactgaaataggcaaggaaatgagagatttagttgtagtttcccaaaggtaataaacctaatatttaaaaagaaatagtaataacttaccagcagctcaggtgttccatgtgtcatgatcaataaccaagtaaatatagatctgaattttgtagccactttggttgtatcaaaaaagccactgcatggtactattacatacatagtttatatggtttagaagaaccatataaaccaccattaactattccttttatcataataataaaaataataggtggagttgctgatatataaaatatgaattgatccattagaagtaattttctattataatttttcaactttcttagtcaatttcagattatgattagaaatgttaatgttaatcttgtttctctaccatttaacccctctcttaaaaacataatgaccacttcttagacccttttctactctccttccatgtatatttcaagttttctacttataatttgtaattatttaaattgttttatttttatcttagttgtttgaaatcaacctctacattattaccatcttttctttctccccaagcttataagcattggtctagcatttaatgataacttttaatttgggatgattatatccaagatgctgccccagaatgagagttttatgaatgcttaatgcaaggaatcataaagcttataccagtgctgccctgaaaaattaaccaaagaaaaccccaaaactctttctccttaatcaaagaatatgctttgatgtgaacaaaagagagaagaatatttaatatcagctttggttgcactgcaattagcaattaacaagtaataacctatgattagttcacaaactccaacaaatacacttaatgacaggtgactaagagatgtgggaaacatttaagttagggccaagatgaacaaatgtgaacctagcacaatttggtttggtaacattaagcttttgataaactttcctagtcaaaattaaattattccatattactttgaagtaattataatacaattttctactttaatcagctgtctcaaactttgtgatcacaagttattttatgcaaaaaaaaccctaaaagaaattatgaaagatttttcaagaaagatttataaacttaatctttcaaagtatctcataaatgtaaatgcatgcttagcatttttaatggattatttactcatcatttagcttaaacatcataatgtttccaatctatgttacaagagctaagccatttcaatgctttttgaacaagttactctgttgacattggcacagaccaccaaaatgcactgattatggaagatatacggttaatgcatacagtatctgagcattgatagagcatcaaggcaaaagcaggcaatacttaagttctccaaataaatacacaaaaaagagagcttgatgaccacctaaaataacttttcaacatggaaaggtgagccttgcggcattccacatacagattagctgagcctttcaaaggtattgttgaatttatctatttctgagcatatcttacttttaacccaacttaattctttggaaggacatgcattacttctgatacattaaaaaaaaaaaaaaaaagacccttttcatgctcttgcttgctaaaactctactagaactttcaatgacaccatattgcctctcagactattcaactggaaattgtatcaggtaaactctcattcattattgcactacccatcttttaaatttttaaagagattattaggggctgtttaaaattattactattcttccacttcttactttttttaggtttactctcccatcacaattattgtcacatgctacattccagactacatatatatatatatatatattttttttttttacccaagtactacaatagaaatgtgatacatcaatggattgtaagaaaaaaaaactacccagctatgtacctggttatattcacacattgttacagagctgaaacggattaattaggcagttaataaaactattacaacaataattgcagaaattactaacgtaaaagtatcttggcctagatagtttatgtctcagttaataataatgttgatagtaatactaataagttctaattatcaatgaccatttgctatgttcccaatttagtcttttaaatatacctctgaacagtatttggctcataatggtcacaaaacaagtgtttgctaaatattgactaaattcttatattaactctgtgtgagacagatgccattattaccttcacttaataggtaaggaaactgagtcataaaaatgtcacttgctcacagtcactccactaacatttgaaggatcaggatttgaatccagatctgtctatctccaaagtaggtgttcttaaccactactgttttatgttgcctttggaaaaatatccaagaactagataattaccagtgatgaaatctgtttcagaatatagaaaagtataactcccctctaactccataaaattaaaacaaaattacaatccctcctaaatgtataaaattagaacttccttatacaaaagccaattaaatgtagcacacacacacaaatccattgaccaatgtatattttaatcataactcactataataaagatggctgctgcatatattgccatttaccatgagtcagtccttttgtggtgcttatataataaccgattttagctttacaactctgaggtaaccattattaagatcattttacagagaaaaagaagtggcacaaatttgcacagtcactgtgttaacctaaggactcaaacttggtccttttttacttcaaatgctacataaagccagataaagtgtatgtcaaaaactctgagatatttcaaaattgagaaatctattaacatgcatcattaggacaaatgagaaaaaagcaaaatactaagataaattctataaaggtatttgttaagttcactatgcatttttgagatatttttaaaaatcacttggtaaactagaacaatccgttgcatgataaaactatttctacctcaaaccaactgccaacatcatgcttaacactaaaagcgttcccaatgaagtaaaacagttttacattgtcaccaataggtcttagcgttggtttaaacatgtcaatcaatgcaatatgacaggaaataaaaataacagtttaaattattgatagagaagaaaacaaaaacacactacttgctgtaaaccgaaaccacactgttggatgcaaatatagccatttaaaataaaatgagagagctagccttcagaaaaccattctaaaaataagataaacataaatgcatacattctcataaggagtggcaaagatattgagcaaaatgttttggaataaagaattaaaatgtgagtttaatgaaactatataattttttggcaagtgtttctaaatatagactctgtgtgatggatacattaaaaattattatgttattttctttgtgttagaaaatgtccataatggaaagaatgaacaatggcagtctgcgaaacaagagtactgcaatttttgtctctaactatatttgtaatcttgaacaaattacataactcctctctcttgctttactttcctcatttagttcatctttttctagatcatcctttctggttctgtaattctattttattttcagttgccttctcaattttctatattgcaatatattttaattcataatggttcaatttgtgataatcactgctcagccacaaattgaaaatttagccaaaaaaaccccacagaaatggcattgctttgactttaaaatagcatactcttcctgtcttttttgagatctaaaattgtttatcagtttgcggggttctcttgggtttattgtactattagacactgacacgttttaaaggatccttaaaaaaaaaaagaaacaaatgaaaagaaaaagaaaacaaccaaatctggcttgttctgggatgctgagatgtcttgacagcaattactgcagtagagactggtgaataccctattttcacagctgatgttttccttcaaaattgcagctaccttcactttggttgaggccagggtactatatttagatagtataaatgtatccagagagcaatctttcacgtttatttgtagagtgggtttatttttatttattgatgtcacacaaaatgatgtttcctcggtttctgctgtatataacataccaaaaaataaagacggtctagaacacaaagtaagaatatattctgtgtgattatattgacaatggtttcgatttttatgcaattatactcccataatgttgaaattgttaacacaagtctatgtttactatgtaagaggaaactttattatgcataatgaagatggcatgggaataagggagtctcttatccttcctgtcaacctaaggccaatgtgtaatgcaagaaacaagtaggacacagggaaaagcaatagccataaccaagagaacatcagctatccctccctcctcacttagaaataaagaatgttggccgggcgcggtggctcaggcctgtaatcccagcactttgggaggctgaggtgggcagatcacgaggtcaggaaatcgagaccatcctgtctaacacggtgaaaccgcgtctctactaaaaatacaaaaaaaaatagccgggtgtcgtggcaggtgcctgtagtcccagctgctcgggaggctgaggcaagagaatggcgtgaagccgggaggcggagcttgcagtgagctgagatcgcgccaccgcactccagcctgggcgacagagtgagactctgtctcaaaaaaaaaaaaaaaaaaaaagaaagaaagaatgttgagaaagcaaagcattagtttatacaaccttcaaaataaaaaataatttcaagtcaaattctttttccaactttatatgtggggtgtgtgtgcgtatgtgcgtgcaaattaataagtcctagacaataaaaaattgatagcacataaatggaggggccaattctagcacttctttttgtcttttttctccattattggataatagtggttaccaaatagaattcaacaacagaactgattaaatattttccccctaggttttaatttagactacacaacatgtatttcagtacttcacattattagttataaaatttttctattgttcccctattgaaagtttaagagaatgcccataaactgagtttccttttagaaaaaaatcaaataatgtcaacatcctttgcatctcatttcttctctttcagacttatgacttaatcctcattagttataatactttattttcatcttttttatttgattatttaaaactttaaggtgcaaatgggttcattttggagacgataaacaggaaattttaagatttctcttggcccgttattttagattgtcccgtgatacactgggggcaactagcgaaagaaatgataatttgccaatgactcttaaaatactgaatagtaaaataacaaaattcttagaattgggaagtgatcttaggcccaaactctcatgtgataacagaagcccttctaaaaatatctctgacaaagggtcacttaagttcaacttgaaacatgccagtgatgttattagttctcaaagcagcctattcattattaaaatccttttgaattgaaagttactctcatgcggcatggtggtcactcccgtaatcccagcacttttggaggttgaggcgggcagatcacttgaggtcaggagtgagaccgcctggccaacacggtgaaaccccttctctactaaaaatacaaaaattagcagggcctggtggtatgcacctgtaattccagctactctggggactgaagcaggagaatagctatagcctgtgaggcagaggttgcagtgagccaagatcgccccactgaattccagcctgggtgacagagtgacactctgtctcaaaaaaaagaaaaaaaaaagttactctcatgggtctgcactatggatcattttagtgtaatctgcaccctcttgccaaatcacagccctttgaatatttaaaaacagttattaggccacattttccccacagtcagcccaggttttctgctggaaaaatcaccttccattctttaactatcaatccttaaagtttttataaccattcacctttcagctatctagtttgttaataagcttagatgctaatggaccttagcacaatacactaacttcaatgcaacgtgtaagatgggtaccaaaccgtaagatataaaatgggtactcaacagtgtaatatgtttcttaattagggcaccacttttccatcaaaattgtctgagtttttttttttcctttaatagctgcactcactagttgatgatctcagcttttagcaaactaaaattctcagacctttgcacattatgtattagctagatatctccctgtacttattcttgtggatttgaaaatgcaattataggactttaaccaccccctccagatctcccatctgtgttgcctttgcttaaacctttttcttcatccaaaatactcctacctctgctgtgcaaaacactttatcttgggcttaaactcccttgggtccttattacccctgctactgtatcactatgcttaatggagaagatgaaatttacataggaggcaaacaatccaggtttctctcttcatctgtcattacaccatcttactgaagctggtcccttcgttgttcagccttctccggtagacagagacaaatccgtgttacacaagtctgcttattccgactttagtcttgatgagtccacatttactggctcagtgcattctcgctctctctcactcaaattatttttggttttgcaggcatcctttgaaatacacttttaaaatattttgagttgtgaacttttagatggagataggattccatgagggtgcaagggctgtttcatggctttggtatgcagtgtaagactcagagtcaaatgtgtctgggggtgtgtcccaggcccatgtggggcaagccactgtttcctttactaaaatgcagcataaaattcatacctgcctcagaggtcaaggaagaattacataagattaaaaaaataaaatgtttaaaataatatctttatcaaattaagtactcaataaatataatctattaatatattaattatactattctagatataaaatgatcatcaaaagaaatcagaaaatgacaaactctttgctttttggaacacaagacatctggtgcctatgccatttctgttgccaacatttggaatgtgcctcccctctcattgctcattatctccaaatatccaaaccctaccttccctttgatgccaagtcaaaatgtgacctcttcttctgaagccctcattacccctagatttgattcctgctcagtgacgatcttgaaggtatggcatttttgcaacacatccttcaatccctatcatctggcataaacctggatcacagtaggtacttaataaatgtctgttatatgaatcaatgactacctttcccgcagccatcattaatttcttcctctcctgattttgtatatccttattgcacataaatatttaccatgcatcataattatttgtgcatgtgtctcttctgccttgcaggactataaagctttttgagcactccatgtcaaattgacctctggctaccttgcaattccttaatacatactagacactgaaaaatacttttgaatgaattaatatctgcttttctctattgctacagtattttttgtccatggaagttctgtaatctgtaccaggaaaataattaaccataactcacctttgtaggaaaaggattaaccataaactgcctttttctgagacatctgttccataatctaatgaccaacgctatttatacagttgatctatctacaaccccttcaactgtaaaaagcatatggaaaatgtatgttcaattctagaggaggaatattttggctatccttttgtgactccctttatctttgatgctcacgtataatccaccttaaaaggctgtgagtgaggcagaaggaggatcacatcacttagatgagatcttgcctgacaccactagatttgggccttcctatgaaactcccaagtttcagttattattatatcgaaatgacttctattgaacactaatcattcaatggtcagttaatttttattgagtatctctatgtacacaggagactatgtgggatgctatagaagatacaaaacaaactaagggtctgttccctgtttggaaggtaagatctatatatacaagtatatacacaccagtgaaaagtaatatacaaactgaaccctaaaattacagatgtaaaaaaatatataccacagactgggagaaactatttgcaaaagatatatctgataaagggctgtgatccagaatagttgtgagatccacacaaagaactcttgaaactcaacaaaaagaaaacaagatagatttaaaaatgggcaaaatatctgaaattaccaaaatgagatatacaaatggcaaatacatacatgaaagatacatagcatcatatatcattaaggaattgcaagttaaaactacagtgatacaccactataaacctagtagaatggccaaaacctgggacactgacaacaccaaaggctggtgagaatgtagagcaacaggaactcattcattgtcagtggaaatgcaaagcaatacagttactttggaagacattgtagtagtttcttactaaatcaaacatactcttactacatgattcagcaactgaactccttggtatttaaccagaagagctgagaatttatgtccacacaataatctgtacatggatgtttatagcagctttattcaaaattgccaaaacttataggcaaccaagatgtccttcagtaggtgaatgaataaataaactgtggtacatccaagcaatggaatatcattcagtgctaaaagaaatgggctatcaagccatgaaaaaacatggggaagtcttaaatgcatattattatactaagctaaagaaactaatctgagaagcctacacactgtatgatttcaactgtgtgacattctggaaaaggataaactatagagacataaaagaacacattggttgccaggatctagtggggagagagggatgaataggtagagtacagaggatttttagggcaatgaatgtactccgtgtgatattataatggttagtactagtcattatacatttgccaaaacccacagaatgaacaccaggagtaaaccctaacgtaaactatggactttgtgtgataatgatgcaccaatgtaggttcatcgattataacaaattaccactctagtgagggatgttgatggtggggagactgtgcatgtgtaggagcagagagtatttggaaaatctttgtaatttcgctcaattttttttttttgtgaacctaaaactactctaaagaataaaacttacaaaaaaacatatatatgttatgtgtatatatatatatatatatatatacacacacacacatatatataataatacatattttatataccaaagaaagctgattaaaactttgtttagaagtacagtaggaccacagaagaaacaaatttctgggggtactcaggagtttacccgagattacgtaataccaacaggaatcaatgtttcttcagcacaaactgattttggaatgatcgaaacaatgtatatgtactttctcatttaatatccacaacaaactaataaaggaaatactattattatctctattttgtaaatggcttgaaacttattatggtgaataacttcctcaaggtcacagaaccagtgaggggtataagtgagatacgaacccagtcctgtccaactgcacagctgaggttcaccaatatcctatacttccagtcttgggaaaagaaaaaaaataaaaattcagttggacaaaagcaacagaaagagaagtccaggtgggagaagtctgattaacttctggaaactttgcaatctatgacagttttatgattcacttatttttatttaatatttcttcaacactactagtctatctccaatgtgaacagaggcaacagtctttctgttacataagaatcatgtacatatgtatgtttatattcaatttataagcagtctgtctttttaagaagacttattaaggagaagtaatttttcataggatcagtcttggggctaagcaattatatttgctatctttttaatactagtagtcatatttcttccctaattgattattgaacctttctaaatatgtctgaagacatagattgaaattatcctaaggctcgacctctttttttaattgtgactaacaaattttaatacaaggcaaacagcaaaacatggcaggctgaaggagtaatttcttgcacctatagccggagtttttttaaagagctacgcaatttttgttgatcttccactggcttatctacagcaattgaagtttatcagaaagatttatgacatggtattgcaggccctaataaatgactttgggaagctgggaaaactcactaaagttaaagttattatctgaacctcatagggctaattagagatacaacctgaagtgttgagtcagcagtaagaaacacaacacgttatcaattaaagcctccatctaggcttggagaagaggtggggaaaagaaaagatttgcaatgaaaatgaatcatatgtttaaacaccagagccaaaaattagtcctcaaaagcatttcctgaactctctggaaatgtcgatggggtcagctctctgcttaaaaagggacccttccaaggcattctcaaagtaagttaccaaagttgctttgcatatgtataacaggaagatctgaacatatacagatgtgggggttccagaaagcaagaaaaaactctacctcttccccacatctcttcttctgaggaataggcaaaatcttccttccccaacacagctctgtgacactgtcaatttaaaacattttcatgcaaatcaagttaacatttaaaaaacaaacaaacaaaacttgcactatgaatgacgtaaccccttctcaaatactggactttaactactgccattgaaaacagggtggtttttcttaagcatttctgacttgatgctgctgttttcctgagatgcgaccaactaaaaatgacttaaaaatccctgcaccttcctggtattaatggaaagaggtagtggggtgttacagggagctaacttttttcatggttttcttaactgagttacaaaaataacagaaaattgcctctgtgcacatgtgtttaatgtgtctatgcatgaaaagccttggggataaagggagaagtagatattttcagaatgtttgattatgattgtttgtatcagaatctgtttagacaagaaaatcagaactgaaagtagacatatgttaaaacattttcagcccatatccttctgctttcatgttgaaaattgagggccataaaataataaacatgtattagatttattgagttcctttaagtcggcaagatccccagagtgttgtgcaaaataacagcaacttttgaattacaaaattattacatgttcccatgaagattatttaacccagagatgaataaggagaatgggtaataaagagacctgagagggattttccacacccttctcctcaatccataatttaaatacagtcataaactgtgagtaagcaatataagcatttgtgtgcagcatatatttgagcctgaaaggtagaaggcagtgtttaaaaatatgtttttaataaagcctataatacagaatagacaaacaccaaggtaaagatggattagaagaacaagtattaaatgaatacaccttctagcaaaaatcatttcttgttatgtgcctcaaaaaagaacaatcttctttagatagtattttaagcaactgactagtgtgtatgtctttacacagccatagaagagtttcaatgagtacttctcaccgattcagtgagccaaatcataaagcctcaggctgtcagaaaaaaaaaaaaacaaccaactgtaaattttgacaagaatgtgacaaaaatatataagatagattcactagcatttctagagtgaaaaattactagaattggcccacggcctctattgctgaaaaatttaatgtaattactttttttatgatattgtctagactctccagcattggcagaatttttgttctatgtctatgctggaaataaattaaataaagacctaggttttcttccttctattgtaagaactatgtcctcttcaagatgaatgtgattatggtttagcaaatgaatgtgaaggtaaaggtgtttaggagaaaatacaaaagtaagatcttaacgttgtacttaacagaatgtgtccgttagtaagaatactaaaaagcaggattgtaaggaagaaattctccaatgtaaaacagcttgcatgtcttctgggaatcttgtaaaaatatagaatctgattcagtagatctggagtgggcctaagagtctgcattcctcacaagctcccaggtgatgctgatgccgccagtctgcaggttaacaccttaagtagcaaggttataatgtatggggaagattcgtggatagggtcagtcttttaaaaatctttaaataatttgaatgtaaattatatgaaatttctctgtctcctggtttcataagtgttttcttttttttttctttagacaaaattggaatagcagtttgactatgacattctaattggtgtgtgtttcagctagaggaagattataacaaaagagtatttctccaaaataaagttttcctttattttgcttttgtaagtagctcaacaaaaaagagagtgtggctctgtgtttgattttacttcctttaaattcaaaagcaggcactaaaaatacctttgaaaactatagtaatgaactactgtggtactaggctcaagaaatctggggcgttcctatggacttagtggcaattgaagcagtcagattttcagatttagctgccatcagctgtggattggacagtgacatagtctaggacagatgtcaattttagccttcttctaacataagtctggaatacattttaattcaccagcaggaaggattttgttgcatgtaagttagagtttaaagccaggtttatttttgtttgggaaaaattctgtgcatctcaaaaggcacaatacctgtgtgttaacctgtctttttttttttttcggttggtattacagaattgctgataaagctttacatttacattggccagtagactagaacagattcctcacgtctctgtaagagctttgtgctgctcacttgatccaagttaaaatctctccacatcttaagttgaaaattaacatacgggaatttaatcctgacatagccactgcatcaacttttgtctagtttacgctttgccagaatgtcttaccattatgtgtctttatcttttggaaggctaggtatattgaaaatcttttaaaaataattttaagaaaagaatgtaaacaatagaaatttattcactttcttatgggacacatttcctgccaaatgctccccacaaagtaaacaccttagggtcttttttatttggaaaatgtaaggagatacgtaagtgtggatatagattcttctaaaatgtcctaaaagaaataaaattgcaagttttcctttgtctttcatcagagctttctttgtcatgtctaaagccccgcggcagggattagggagatgcaaaaccttactgtaaacagggaagggttgaaagaaaaggttcattaaaaaagaaaaaaaaaaaaactatcatttgaatgtaatatgtgaaaaatgtttcttccaggttgagtgaaaaatatactaaaaaagtgtaatcctagcttaagagattttgttttaaaatcctaattctgctaacaaggcaaaaggaacttaagatacggatgtatataaagcctcccggttcacccatcagtctttgaaactgccacacctaaactatctgttttagtgccattctcctatatttactccagtcatttttatatttcagttttgctcttaattttttttcccaacagtattcaagaagaaggataccaaaaaaagcattcccataagtattgtaaaaagtctctctcatgggtttgtttttagaaaaatgttaagccatgtttttggttcagtggaagaaggagcctgtgatagttttaacacgtgtacccaattagttgttctggacttcagcaaatgttctgcttggagcagctgttaacagattcttgctctattgttaatcaaaaagccaataataaaaaggcaaattaaaaggcaatttaatattatacttgtaattattcactttgtttctcatataagtgcaatctcatttcaatgcaatgctttcaaagaaaacatatataaggtagaggaaaatatcaatataaaattaaaattttaaaaaatggtactatatacacctttataaaatatgactagggaactccaaaaaaatgttcaaggactaagttccaaatacatacgtatgcacacacaccaacatgcacacatgcacacacacataaatgaatgcatatattctcaggcaaaaagtagaccttaggcccagaaacaagatatttgcaaagtattgatcagaatactatttatagtttatttttagggataaacacattaatgtaacttcatcttcaaaactttttaaaaataattacttttcaaaataggcaatgtgctatgcaatggagacgcatctatctacaacaggaaatgaaagtacaaacatccattcccacagtcttagattgttgtttaaatatagatatatatttcattaaagtataaaaattaagtcattgacctttactgatttgataatagtacttagtctctatttattaaatattgtcatctttctggaatttactataatacataccggttaagttattaaaatttaatcttttcacatattattaaacaaaacctctcacttattctgtccttactgtggcaacaactgatgccacaaaagttatatttccactaaagcattttaagggaattttgagtaagttacttactgatcatttgatgagatctgttgactaaatgtggctttaattgctgatacttgaacttagagtgcgatactaacaggatttattattcactaagcacttacaatatgccagacaatgttttaagcactttagttatctcgtctgtttttttgtttattttttgagaccgactcctactctgtcactgaggctggagtgcagtggcacgatgtcagctgactgcaacctctgcctccgggttcaagcgattctcctgcctcagcctcccaagtagctgggattagaggtgtgccaccaaacctagctaattttttgtatttttagtggagaccgggtttcgccatgttggccaggctggtctcgaactcctgaccttaagatccgcctgcctcagcctcccaaagtgctgggattataggcatgagccactgcccactgcgcccagccttatttcacctcatttaatccttacaattactttaaaaagtaggtagaataataaactccattttacatatgatgaaactaaggcacaaagaacaatgatcacacagctagtcagtggtagaactctgtaatctgtgggttccacatctgccagaggatgtatgtaagtgatgtgcaaacactactccattttatataagggacttaaatatcaacactatggattttgttgtgtgtctgtgtgcaggggaatgtttctggaaccaatccttggaggaacaactgtaccttatacactacattgaaggctcacaataaaagtctttcaaccaggagaacatagagtaagatacaaaactgtgggatatagactatgactcttttgattagtatggaagaaaacatcctagtattttgttattggaagaaaacatcctagtactttgttattaaggattagcgagattgaatcattgatgtacttacagcaaatctaaagtaaaccatacaaaatagaactttcctcaagatgactagaggtcaataaagctatgggttatttacagtgtaatatgaaacagcatacaaccgcaagggagaaggacatactaaataaacaaaacctgcaaaggcaattttcttcagagaatctcctcatgtacaaaaatatatttcaagagaaagtagtatagttactgcgttttcataaaaagtctgtttggtgataacatatgctgaatacaactaaaggcagttcttcaagtctaggcagacaagctgcagtacagcagatacacttgctgtttaaatatcccttcaaaaaaaaaattccatttgtttaccaaaatctattcacacttgttgaaaagcatctttcttcacttatctgaatgtgacaatgaatcaaaagtaccttctcttctgttaccagaggtgataagggagaaactgagatcctcaccagaggctgaaagatgtcttttcagtgctcttgaaagcaaaggctaatttttccaaacaaaaatttctccctaaggagctgtattaatgaggtccaaagtaatgcttaacccttgactactctaattaactcaagctgactggccagaagccctctttcctgtggcctatatgggagagatcacaaaagtgcatggtaaccctatccccacttgctgttttcacaaaacatggggctttgttctttgtttggcggttgtgaagacatttcagtctcatctgacatcacctcctcacatggaagaagtgtgcatagaaacacctagcagcaggctgcttgtctcagtgtgttccataacccttgctagcacaaagactcatttccagctcccagaggtagcatccattaacacatgttccttgagaaatctgacttttcttttcaaaaatgggaacgagtgtattcttgctatacttttttccaaatgctccaaatacacaataaattatcaagtaatcaggcctagttatgcgattcccagctttcaatacaggtatattagaggaattcatttattcactcatttgtctagcacatctattgaaaaccttctacatggtagatacaaggctaatttggtttcattgaatctttcctaagcaattaagcccagaaaaatttgtcttctctctgtttgctagagcgatagatactaaagtatctataatactcaatttattagtagtaaatttaaaatgtaattacatttatttcaacttacatttaccaatgagtacctttgatatgccaggcacttttctaaatgccagggatacagtagtgaaacaaacagacaaaaacctctgccctcctgtagctttaattctacaatggaggaacagaaaataacttcaataagtgaatgaaatatataatgtgagagagaggtaaaagaagtgagcaggtggcactgaaagagtggacagagaaagcctcactagaaaggtgaacttgtaaagatgaaaggaggtaacgaaccatgttaatgtctgggaaaaaagcattcagggcaaggaaagactacatagaaaggcttggaggtgaaagcaaacatggtatttggttggagcaaatgggtcatgtggttggaggaaagtaaataagggttaaagtgtgtgaggggtgcagtcaatggtaaacttttggattttactctggggaagataggtactcattagaaggttttgaacagataattgacacagtctgatttagggttttaaaaagctcattctcagagtctttgggaataggttgaaaagcatctaaaacacaagttcagagaacaattagcagactattgaaatactatgaagtgattaaactttattgaattttaattataatcaagcacattatggtagaggcaatgagatttactgatagattggatgtgagatgcaggatgaaggaactgcaccttgaactcaagatgatttcaaggtttttggaaaaggcaacaggcagtatgaattgctatcccttcagatggatattgtggaaggagtaaattttgaaaggaatatcagattaattgttgacaaccaaaatttgtataaaatcaggtaataaaaaggggatgtgagtttagaatataaaagtaaaatgtggacgtatcacatacagatggtattaaaagccgtgagagagaatgggatatccaggggagtggctataaatagaaaaaggaagaggcccagacctgagctctcagggtattgaggaagaaccagagaaggagaccaaggagaaagaacaggaaaaacagaagaaaacccaggaaagtgtatagctctagaagtcaagtgaacaagtgttttgctgaggagggaatgatcaacgatataaaatgctgcttgtagtccatgaatatgaagactgagaattgacattgatggttactgttcaccttaataagaatattgaatacattatttacctaattaaattctagactcctggtagtcaggacttgtcttaagcagggaattgagactgagtcaaatttgaaagttattttatacttaagttgtctagaactctgaacatcatttttcatatcacatacgatatttcattatagattctagtgacttctcaagaaagcctactttttcccattgttaatacgtagaaccagaccaaaataatagaaccataaaatgttaaagtatccagtttggtgattattacaaatgcatacagttgtattcaccatagcagcaacatataaaatatttccatcacccccaaaacttccattgtgccctgctgtgctcagttcccttcctccaccccaacccctgacaatcattcatcagacttacctccctgcaattttgacttttctagaatgccttagaagtaaaatcatttaagaatttaacttttacactattatttaaaaataatttcatcagtaaatatataccaaccataacttaaatgtttaaaatatatcttttcttctcactaccacatctttagtcttaaaatggtcctcagagatcccagttcctcctgctgtgaccttagcttctagaagttctttagcccctttgagtttataaatacattgatttataattcatcatacatttattaataattatttcaaggaatagtcagaactcatttgcatatatatacaaacatagatatgtatgtaagtaatatgtatacaaacatatacatgtacgtacatgagtaacaacagaaaatgagttctgactactccttgaaatagtaaattattaatttattgttttggaactgtctctaatcctttatattctgaacactgagcacaataacagtaactgtaatggtcctataatcaattattgatatgtagaaaatgttgcagctacattacctatgaaatcacaatgttacttctcagtagtcctaaatttcagaagtagcatttgaatgtaaaaattggcacatttgaatacaatctatataatctttgtcgttgttgctgttgttgttgttttaattcagtctcttagtaacacagaaatgtatttccagagttttccctcttatgtgcctttaagcatataagattacacatctggctttgtaccaaaaacagggcccaacaggatatgaaatcctggggataacagcaacctagctatttctttttcaagaatttttttcaaactgagccagaaactgaaaagacagatgaaaatggcacaacccggtgacaagagagcaaagataaatcacgtttccttccataaaaacattaagatcttggctttaatattaatatttttggttacagttaagctttaaagttaatgaaattctcatttgtatgctgatcttgggacatgaataccaagttgtagatgggatagagattagcaataaagaaaattaaggaaaagaaaatgaaaaattcccatagagtttaacatgcatacacatatgcccacactcatatgtgggtaatatgagagaacctgcatattttttggaggttgcctttttgcaggagttgaaactattcatcattttgctgcactttcctgtggtataacctaactaagatttttgagcaaaagatagtttttgtttttggaaaattatgagtaacttatacgtgacctgtttactccattaggaaatatgctgttttattcaatggatcataggaacagaacgaagcagaacaatagcaggaaagaaaaaattacagtcttagaaataaaaacgtatttcatccattttggcaccaggactgaattaaaatgctgccactaggcaggattttaaacatacacccttttcggcatacaattttaatacagaaattgagatattaggcatgcagcgcatattagaacattgctctttctgctgcaggtgtgtttgactgaccctgaataaatgtcaagaaaaacacctttcctatcttttttttctggctataattcaccttctcttaatatttaactattgctccatcattataacaggcactctgtttaagtcgtgggtacaggtaaaattcagcagataaaaaataatcatattggaacatactaaatgtaatggagatttttggttgagaaaaataattggtactgctaatataactgatatagtcatcatatttcctatggatttacaaaaaaaaatttaaaaaagcaagtaagatataatagaagcaaaaataggaggtgaataattttctgtctttggaatcagtgtactttattattacacattcattctaagcctacgtcagaaaatacttgaagcaaataaatagagaacagttttcttttcttttttcgtcccttttcttcaagagaacatctcattaacattaacagaaactgtgcccagaaaaagccattaacattaatggaaactatgcatagaaaaacccctagattagtttttggtcttttaaggagcttatgcattgctgcctgtcccaaaaagacaggatgggaagatagtaatcacatttttgccccatctttttaaattatatatttcattaaattatatttaataaatcctgagttggaaacagcacaaggaaactcaagctgcaataatatttactctcccaataaacctggagctttcacaaaccatgtgtcttactgagagtcactgaacaagttatacgaccatgattctcatgaacatcctctttgtgcttgcaattaggctgcctgccaggagttgaaatgattagcagtaaatataaatttaatagctttgctttgcagttccccagtcactcttggtgcctccattcactagggagataatgtgaatcagaccctatcaactaaacatacgacaatagttgaatctgaattaaatatgagggaatcttaaaagggcaaggtaaaataaaaagaaaaattaaaatatgttctctatttaatagccactttacatttacaccaaaacactgcgctattttttataaatatcagccaaactcaaagtattagtacataaatcatatataatctaaaatttttaaaaacctgataaaaagaatgcttgaaaaagtataggttttcttttttttgtcacttgaaatagaattgtgaaaaatatttacatttcaaatatcattttgcttagctgttagagttccttagagttcggttttctgaaatttaccaatactttctcatcctctttcacatcatcatcagggctccacaggaaactgtcaataggtatcaatttaatgtgccttctttactaggtgccttactatatgtcttatcacttatctctcaatttaggagacacaaaactagaagacagcaatgaccaggaagtcttgtggctatgctgtagaatgatgatgacgtatataaaatatggaaagtctttatgctttgcttttgttctcatcagaaatagtccctaagtcttaaattgtgataaaatactccttcacattttctttcaggtacaataaaggtcagataaataagaagcaaaagaaaaagagtcagggaagagaagaacagttttcggcttagcctgatggcaaagggcttttaaacactcctcaaggaacattaagcaaaaatgagcctactgaaaacaactttccttgattttactccccagttactttcgttcttctctataacttcccttatcctttcatcatagatgtcttccttcatcactattcaatatttaaaacagctgaaagattggttactgggtaagaaaaaaagatacgatagctaccaggttgagcagagatatctttgagctctaccatgatagctgagatgtttgtcctgctcagcactgcctggcacatggtaggagctataggtgaaaagatatctctgagaagatatgagtttgttggtactagggcaaagcatggaggaaaaaagaaaaaagagatagagaaagaccatgagtcataatgacatctttcgtcccttcgaaccaacttttcttgagtccatagtattatatgctccgatgctttagccaattaagttaaatccatccttatgcattttaaagtattcgaactaaaataatatcatcaggaaacatgtgagtaaaagaagggccacctcattaccttttggcaataaaaggcagagtttaaattataaatatttacagaaatatatacaccaatggatttccaagaaaatgtgaatgatatgccacttaggaaaataaaacgatctcccagtataaaattaatctcactggaattgctgaatacacatctgatgctcaaaaagaatactccaagaaaatataaattgtttaaatataagtcttaataagcaggatgttaaaaactaaataaagtgacaggggatgcggtggctcaagcctgcaattccagctctttgggggagctgaggggggtggatcgcctgagatcaggagtttgagaccagcctggccaacatggcgaaaccacatctctattaaaactacaaaaattaaccgggcatggtggcgggcgcctgtaatcccagctactcagagggccaaggcaggagaatcacttgaacctgggaggtgcaggttgcagtgagccgagatcacaccactgcactccatcatgagcgacaagagtgagactccatctcaataaataaataaataaataaataaataaataaataaagttatgatgaataacaaatcaaacggaagcaaactgatcctcaaggtggtaaaactcaagaaaaaccctatgattttgctgatctcttagctgatgccacagaaagccaaacacaaacaaacaagagaaattatcctatctgaatacatcagttttatgatatttatgtaactactaaagcatttttttttaagtataactgatgcaaaactggaggaacgcaaagtcagctttctttgatcaaagctcctataacttctgattaaaataataattggatatagttcggactactccacatacattctttcactgaaattggacataatttagtgaagcaagatgctgagaagtctactgccttggcagatttccactgaaatatgtttaaaagcatagtttttctccacatggaaaataaattgtagaaaattaaatgtgagtttatataggattactttttttaataaaataattatcagatatccaaaaagggaagagaattagcaagttaaagaaattttattttgcttgaacaacaactaagtttcataaaccatgctccatgtgtcctaatataaaaacaaaactattaattttaatgtacagggctatgaaatggaatttggaaattatgttgctagaccaatttggttcctttaaaaaaggcaatctttatagatgcccagcaaaaagaaaggagggcctatttagagccatgttagaatcatgtactgtccaggtattaagaaagccactttggccactccaaaaaacaacaataaaattatttactttaaggcaaggcagaaagtctccacattaaatttttgaatttttacttgaattgactccaaaacaaatcaaactgaattacagttgaaagttaagtgaagctaaatataatttatattttctatatcctattccaaaacaaatattttctatgtaatactccaaactataaacgccagacactatgatcagcacatgttatctcattttttcttccataactaatatataagcaggttattattcccgttttacagataagaaaacctagagactgtaattaagttttcaaaggcctctcacagttttgtcgcttctttccactgatgtcctccctagtcttgttctgatgtgtgcaggagtaaagatttctatttttccatctggaggaatttcttagtggcacactccctttaatctgtgtagagagctcaaaatttccctcaattctcttgatccactccaaaataaggatgttctgaagatggtcacagacaaacaagcagggggcagcttttggtagaaggagcaataatgtccttcttaggcatcctcttctcagaaggaatcaacatgtagcccataaaaaacagaacccccatctccatggctgcttcccagagctcagagaaccaatccacctcctcaagtacaagagcagcaaaagaattggggttaaaatcttaactagaaattaaggaggtatcttctacttaagcagatttcaaaccgtgctccaaggaatgctgttacataatatattctatattctgcctctattggaaagaaaaacatgcaaacaaacaaacaacatcccaagtatccaaaaccaaaacaaagtactctgcatgtgagcaagtttggaaactctagattaaataaagttcagcttttatactgttttcattattaaccatttatatgttaatcagcattatgacctccgaaaaggctttaagttcatttatcatctgctgaagtagttcggaaatcctgcttcatatatcctccaggtgaagacttgaaaagagcagctgcagcccaaggcatttggttgaggattcagggacttggaaggccaattcttttccggatgtaacgactaataatatttaatatacaattttgaccaaaaatatttttgcatgaacatggcctaatgtattttacttaagtatatctttattggtaccatattaagaaaagcttattccttcttgaaaccatgtttaggcatcagttgagcacctctgaaactcattttaattttgcaggactctcagattattaggaagcaaatattcaatggggtcaacttagacaagatttccaaaaatgtgttcctcagcttgggttgaaagctgtaaacatgttcattattaatcttcaagagaataatatttatgcggcccttttccacttaattaatcattaacacctttgtcccagagcatcttaaaaggctagtgtttcaaggactatccatctgtttgaataccattgataaaaccttactgtttaagtttattcaattatcatgaataatgaattagagttttctttggtcagtttatctcttcaagatatcactaagctcagtcttgtaaaccctaacaaggtccagttttgaactagttacaatttaggaggtttaactgtcattaagatgcgaatgactcttccagaggacatggaccttgtcttgtacatctctgtgatctccaaagagctgtgcacagaattgacactaagttcaataaatgtttcttcaatatacgaagaaatgctctgttgccacttaaagtgcagagcagttttcatcttcaaagcactttattcacattaattcagctatttacattttgctgatgggtaaacggctggagaggctaaatgggctgttttaaaggctagagagagaaaatcctgcctgtcaggaataaaaatttgcaattactgattaccagtcatatgtccctggacttttgtaggaaaaaaacagagggacaaacaaaggccacctaggtagtggttatcctactgtcaggacaagtcaatagcaggtaaagaaacaagtacactagacggtccaacagctctattgaacaagtatgggggaaaaaaagttatttttgttgtggttttcagtgagtgtgtgcgtgtgtatgtgtgtgtgagcagtgttgatacacactgtgatgcagaattacctttttccatttgcaattctaaaacaacttccaggtgccatgtgctgtttacaaaggaattgaaatacatttgacctcaagcgtattttgctctggcaaagtgtgctaattgtatagatctaaaggcagcagcaacatcatcatttcaaaatagacattaagacaattaaaaaccccatgtaactctactgcaaagtaaagttctcatggagactgtgaggtgtgtacagatatgctgtgtcatacgtttctttatgcgatagtttatgtcccaaaactctttttttttttttttttaagatggagtcttgctctgtcgcccaggctggagtgcagtggcacaatcttggctcactgcaacctccgcctcctgtgttcacgccattctcctgcctcagccttccgagtatctgggactacaagggcccgccaccacacctggctaattttttatatttttagtagagacagggtttcatcgtgttagccaggatggtcttgatctcttgactttgtgatcttcccgcctcggcctcccaaagcgctgagattacaggcatgagccaccgcgaccggcccagctcttatctttttaaaatgacttttttgatgtgaattgggggaggacagagacaagacttcttggccatgtattgcttcagttctcagttgtgtttctctctattccttggaaaccttgactttcttccagtagcttcctggaaggaaaatttgaggaaacgtctaatgtacatagatactgtgtgtatagagaatagtccagttaggaaagtactctatgtaagttctgaaagtctggatttagggtcttttttttttttttttaccttgccatctacttctttccaccctgctaaaatcttagtaattaagtcataagagacatcttccttttatacccaaaaaaacacttgatgagatagaaaggagctgcgtaacattatacttcgtttgggtgtatcttaggaagagatcctgttcccttaggaagtgcaagggaggtggtgaggacataggcaatcaggaccaaaagtgtaggtgctattctaaaagcagtaatttagtagtcaggtgtcagatgaagacagcaaaaaatgcagttttgagtaactggagatggcaaatccccatgtagctggcttaggcttgaactggcaggtacctgacattcaatgcttgaagatgtagggaaagtggctgaggcagagtgctgggtaagggcaggactgagttggttggaaatgggcgtaagtacagcctccagtgtggaggttgctgacaactcagcaatctggtttcagaggaggtctgaagaaaacttaatgcaagatagtttgttagatcagaacaaccactgaaaattctccagaggaaataattgtgcttataacataggtggagtagatatgccacacccatttgacacccaaatcttcatcagcttggatagtaccagacagactcttctttaggtccacagggatttttttaatttctgacaatttctagattctaatccaaggtgacaactcaagaaaaaaattagtaaactagttgtgttctggaaaagaaaaataaattaaagccacagacaagggagaagaaaaacttctatgcttggccaggtaaaggcaagctttctctaggaagtacttatagtcacataaatactcaagaaatcatagacttctggagcaagaagggtcttggttatcatctggactaacagttgctattaacagattaaaaaactaaagccatgaggaattattttatgaaatcatacatctaactgacaaaatgaagactaggatacatttatttgcttgtgtctaatactcctcttcaatttggaaacctccagtgaagcagaacacctaataaaagttaattaggaacaggtactgctgagaccttctctaaaccccaggagcagatgcatctctttcactcgcctggttacctgaatgtaactaaacatgccatctgattgaacaaacaaacctattcttgtatttcctgggaagatgagcccctggatatgaaaatctcacacttttaaggcaaaggacttcaaagtagtccaagggtaagtcaatcagtaaaggaatataactatagacatgcactgtgtgatctggtgttaatctagaactatgacattttttgaaaagcaacaaaaagggtgttgaggtatagctgccaaaaccaattaaaagtaaccagaaaaaaaaaaaaaaaaaaagagaacactaagcaaacaggttttccctcaccatatttctaacagaaatgcatggccatcattaaggatattctgcagaacctattcaagaaagactgcacgtggtggataaccaaataaaatttccttgtacagtcaatgtcttggcatgcaatgggtcccgaggcataaatgcaaaccattaacaaagctttattaagaaagccttcaccatgctttgggaagatgtttgatacaattcaggttaagtgctgatcaataacctggaaatcaaaagaaccgatcacagaagcaaaaaaagcagatttaggcagattcccagccccatcccaaatgtgagatactgacaccaagcataagaaatcatcgctttttctctcccctccttcccccatcacacataccaatgccttttcctcttaagtcccctagctgcaaatatttcttagtgaagtctattttaccccttttacactcacaaactgagtcgcaggttgtacattttgtgataccatcattgatgaaattgatgaaagcctctaatggcattagaaaatcctgaaatagcacggctgatatatacctggcaggtaattgcttaaaactccagcagagatggatgtctaatctattcttaaaaatatgagcagacagatagcagttcacccctccactgcctctttcttgttctcccccaacaattctgctagttcatttgagtgtttcagacaagaaagcaagaatattatgcaccagaatataatgtggcctttcttgcacagcttctctttgcaatcccaaagctgccatttgcagcttcaagcaacagaaaagcatgcttactgttacttaagattaaattcttgataataagcagatttattgactcatgttttgaatacatatttattgaggcactctactagatgctgggcaaagtgataaccagaaatagccagccagaaacactttccacaagtcattaccagagatttaagccacagtaaaaaggtggaggagaatagacgaaaggttttagggggaaccccatactcaaactctccctcagaaaaacaattattaagtcttttcttacaaactgtagagtaaaagaagctgcccaatcgcggtggctcacgcctgtaatcccagcactttgggaggctgaggtaggtggatcacgaggtcaggagatccagaccatcctggctaacacagtgaaacccatctctactaaaaatacaaaaaattagccaggcatggtggcgggcgcctgtagacccagctactcaggaggctgaggcgggagactggcgtgaacctgggagtcagagcttgcagtgagctgagattgcaccattgcactccagcctgggcgacagagcaagactccatctcaaaaaacaaaaaacgaaaaacaaaacaaaacaaaacaaaaaaagaagctgcccaataatgtctgagcaaaatggaggccatgattattttggctgtagtgttttagactttcatgtaggagagaaggattcgctaattggttttcagtcaaataattctactgaggaaaaagaagtattcctgaaagaaaattgagacataacatggataatgtaaagcctatatttaatcttggtcaattccattgtctcattttcatgtagatgtcaaacataccagcaaggagaaaatggttcaaaaatgcaacccagggaattgccctacttttcctacttgcccagtcttcaatacaatagatctttattctgttctcattttctctaacaaaatctccttgttcggaagagtcaaaggaataaatggttggaaggttaatctcctaattactttctcccttcataaaataatttatttaattgtggaaattattatgcagctgtagagggagagcatattcattttttttcaggaagtagttgagcaagcctgacttacgccaagagaaaaaataaaaattcctgagaaaaataacaaattgttcaaaatgagctgggttaagtatccaaaccaaggaacaagttcatttaaatggttactcaggaaatcttgacggtgatctaaattcaaagttgcttttgtttttctaggaggcctggcttacagaaagaacatgataggttcctaggatatatcttaattttgtacttcatttaatattgttaaaataattttgtctctaatatcacagcttgtaatatctcaaacaacactgattactgattggtaatgcaccatactctaacagatatttaatctctatcctctccttccctagaaaaggtgtcatggaccccgggatgtattatacattgcttatagcattttgctgcaactttaaggcaaaaagaaaaaaaggtctctgtcctaatcaggcataacagccatgaaatcctatgtgcaaattgaatatcaaactaatactgtttttactaaccaaaatccattatctaaaagtttgaacaagtgaaaaataatttatttatttgttatggtcccaattaataagatgagaaacttaacagaataaacatatgactatccatttgtacacatctaggaatggaaaaatgacccactttaagtacaaaaaaatgagaataatctataaaaactaatgaatcagtccctttaactttgtttattggaattacaatatcaaagcatttctaatttgggttaagtaaaacatacaccaaagaatctatagacagtacttacaacactgtcagttgagtatttggctttgatatagctttgaaaggtaaaagacaaaccaagtagatttttttttacttggggaagaatgtgagaatgtgttaagtagctcagagtaatcattccataatgtgaacagataccaaaacatcacaatctaccccataaacatataatatataaaaatattatttgtcaattataaaaagcctatgttaattaaactcagctgaaccctgatatatacaaaccagtgatgcaaatggtgttcaccaagcgcatactcttagttggtgagcatctgtaaacatgctcgttctcagcctacagctactaccgtttggagatcacggtcagtaatgatgaccagtctagggaaagttcatggatagattaagtcactgggctagtatggatttgcactgaaattccaagcaaagcctctttcatttagtccaaatcttgttctacttgactgcaactagatttcccaatagggtctgtcaatcaaaattaaaaagaagaaatgtaataactttaatttctttctaaatctagagtcaggacaaaacttctaagtcattattaactggtactctaccaagaatatagctctcaattattcatttcagttcttaattattccctgtttcaaaaaatagcctgcctgccgctcataaaatcattagctggagagaaaagtgggttcaattttgattggaagtaaaagatatggtaggatgtttgtgaaataatgcttgaaaagtaatgttttaaaaagaaaaaaataaaaactttgttttgttgtacttcttgtttatagctttcatgtaaaacaaactatggttgtttcaagatggagcctcacgttcttagatttggtatgtacaaacaatttctcctttgacggaaaatgagacattttactttgccagttactttggtttacttgactggacttgtataattttaatgcaagctaagccaattgttttctaacaaaagctgtcataaaaaaatttatgcagccttggaaatgtaaacgtaaaaaagaaatgtaaaaaagtaaaacgtattcatcattttcctgcaaattgaagctaattacacttagaattacttgcccttccacatatttcatttacaacccatatgatcttctcagagtctcatacttaagttaataaattcagttggaatttttaaacacatttataagtatgtatatattggaaatagcaccacatgtaaggcatctctgaattttgatgagttgggggttaggtggggacattacacaattattctggtttctaagattaaaaaaacaatcttcctacaagaaaataatgcaaactgaagagagagagattctctaccactcttgaagaaaactttgggccttggggctgagaaggaaaagtaactcaatgagccatttgtaacacattaacactaattcttaaatgctatttgtggttaaaaagagatgaaatagacaaataacctggaaaaatctgtgacaatagaattcaaatgtaaattatcatgtctcactgccccgttagctatccaaaggcaaaactccattatttcattccccttctcacatctattacttattttcctttctcaattagttttaattaattgtttcttaaagtgtacttacacatttaacagtggttactgtgggctgtgccgccctctgattattagtcttgaagccatcttatgttattgttccattcctcacactcaaaaggtccccaaagaacaacctcctgaagttaggaccaatggtccctttagtttgtcataaaaccaaagtgatacatgtgtttaataacacagaatgtgtgccataaaaccctgatttgaatagttcttggaaatgtaggccaaagacgtcagatgaaacgtgccaagttgagaggtgcagataaaaggtaaaggtttattttgtaaatgtgtaatattttgatagtcaccagggaagaaataatgttactgcatgtggacgggcaaggtggctcatacctgtaatcccagcactttgggaggccaaggtgggcagatcacctgaggtcaggcatttgagactagcctaaccaacatggtgaaacgccatctctactaaaaatacaaaaattagccgggcgtggtggcgtgtgccagtaatcccagctacttgggaggccgagacaggagagttgcttgatcctgggaggcagaggttgcagtgatctgagattgtgccactgcactccagccaggcaacagagcgagacttggtatcaaaaaaaaaaaaaaaaaaaaaaggtactgcatgggccatcatgtgaacctgaactaatgttattccatcacgtaggatgatggcagtcacatcattaatctaaaatattcactagtttcttgcaaggacattaagtagacagattcaacaattacttttgctagataaagttagggcaaaagtatgacggacagctgaaaagttccattcttttcaatgtcccagcagataaattagtagcttaccagtaacatcaagcattttaaaaagagaggaaaaaacaaaacaaaacaaaacaaaacaccaccagtaatgatccagtttaataacctcatatatttggcttggggtaaatatcaagtggtgctgatcagtggaattacagatgtaattggaaatgttaaattttcttcttactcgactagtcacatagactattctatctatactaaggaaacatttataagattttttgcaaatcgacagaaaagagtcatcaaggaaaaaatatgataatttataattctgtttgttttaatgaggaataatatatgtgggagctgaaaatgttaaaatatatcaaatatttcaaatataacaaaatatttaatcaaagcaaaaattagttttttttaaagactgatacattctttcacctccatttcaatatatattaactctcctaaagcaaattagttaatacacagagcatttttaaatgaattataaggatagccattcaagaattgtttatcctggaaaaatatcagtcacaaattaaatgtaaaatagtgagcaaatggattaaaatatatacagcatgaaagattgctttgtctcttaggacttcacactttaaaatgattattattaacattgaaatgatttatatcagtgaaggcagacatacacctgacttcagggaccaatacaatagagagtatttttgaaaaatgtatattctctagacttgctgatttaaacctcagcttgtgaccaagaattttcatttttcagaacctgaccatgttactcttcttatcaccgaaatctgataaccactgcagtaccaacttcaggatgttcctagatacctttggatatgttaaaggaatcctaagatggttgagggcactccacatttatctaagcctttagaacaacaatcacaaagtccagtgactacagaggccagactttaaaaaggaatagggagaaataaagtattgccgacaggagagagccttccctgtttcaaggcagtagcaactattcacttccattcgatactctcctacagaaatgtagaccactttgttcgatattctgagcttttttctctctcttttttttttttaatagtagagatgttgatgtttatgtgaaacattctgattttcaaatgttggcaaccagtttcgaatattttcagtgtgcaaccaagcactatgcttgcaaataaaacacaggtatgggaaggctctgactgaaggacaattaatttacaatatctgattgtggtaaactatctgaaagatatagaatattatgttctgcatatatatgtgttcgtgtgtgtgtgtatatatatatataaaacaactacaaaaaattatattcatatgtatatacgtataattttcttctttctgtgtttacatatataaagcacagattgacaagctggcttattaatactaggtgtagatattttgaaagagataaacaaatagtattgaacgtatctaaacagacagccaaatcaacaagttgaatggcaacaagtaagacgtacactctatgacagtgactaaattaaccaagagttacagataagagagtgattagcatgcgataagaacattatagaggactacctagagaaggcaaggtttaaattgggccatgtgctgggaaacctggatatctatatgcagaagaattacattagatccctatctctcatcatatacaaaattcaactctaaaaacaataaagatttaaaggcaagacctgaaaatatgaaactactagaaaaaaacatagggaaaacactctaagacattggtctaggcaaagattttacggctaagtcctcagaaacacagggaacaaaaacaaaaagagataactgggactgtattaaactaaaagcttctgtataccaaaggaaaaaatcaatagaatgaagagacaacctgctgaatggaagaaaatatttgcaaactattcatccaagggactaatatccagaataaacaaggagctgaaacaattcaatagcaaaaagccaaataaacacgttaaagagtggacaaagaatctgaaaagacatttacttaaagaagacatacaaacagccaacaggtatatgaaaaagtgttcaatataactaatcatcagggaaatatgaaaatccaaacctccatcagatatccttacccccgttagaatgtctaccatctaaaagacaaaacagatgctggtgaggatgtggagaaaaggcaattcttacacattgttggtggggatgtaaattagtacagccattatggaaaacaatacgtagatttctcaaacactaaaaagagagctattacatgattcagcaatcccactactgggtatttatccaaaggaaaggaaatcagttcaaaggaatacctgtccccctatcaccatgtttgttgcagtaatattcacaatagcaaagacatggaatcaatcaaagtatccgtcaacaggtaaatggataaagaagtggtggtatatgtacacagtggaatactcttgggtcataaaaaagaatcaaaacctgtcttttgcagcaacatgaatgaaactgaagggcattatgttaggtgaaataagctaggcacagatagacaaatatcacatgttctcacacatatgtgggagctaaaaaagttgatcttatggaggtggagagtataatgatagataccagaggctgagaagggtgttcatgtgtagaaagggggtgaagagaggtaggacagggggtataaacatacagttagatggaagaaatatgttctaatgtttgatagcacagtagggtgactatagttaataaaattgcattttatatttcaaaatagctagaagagaggatttgaaacattcccaacacataaaaatgataaaagctcaaggtgatgaatatcataaatccccctgacttgatcgttacacattctatacatataacaaaatatcacatgtacccagtaaatatgtataaaaatgtatatcaattaaaaaaatcaaaccatgaaagctaattaagtttaaaaaatgatttcatataactttagtaagaaatactttaaaattccttaatgctaaaaaatttatcagaccagttaatatataaattttagttatataagcatttaaaaatttagaaatattaaaaactggaaataattaaaaatcaagataggttggacttaagaggtgtggcattaagggagatcagatacaacagactgagcaaaagcaagaaggtgagaataaagcgaaacccaggcatagaacctacaaagaatacagtaagaagtcaccagaaatgtcaagcagactgtttgccagtctgaactatcaccctatccccgtaacagaattccatgaaaaactaagaaaaaataatatgacaaaatatatgttttatttccttctttatgagcctgtttggttaacattttataccatgcaatgttaggttgagaactaaaccaagaaatatgaacacaggaatggaaaatagaaagaaggaaagaaggaaaggagaggaagagaaaggtagtaaggagggaaggaaggaatgaagaaagaaaaataaaagagaatgaggaaataaagaagaaaaatgtaatgcaccatgaaaaggagatacatatacaaatatgcaaagggacatgcagaaaagaaacattgaccaattaatctcattaatgggtacagctcgaaaactaatgtgcttaagtacagagggaacaatttaggataaataatatgaaagaactttatagttatgtaagaacactcaggcaatggatcatgctatcgagggaatttagagacactcttggctggaagacactaatttattatgcgctgatttaagtataattaaaatcaacctagatattaaacaagggaaacgatatgtaacttttagatatccatttattacctaaggacagagagagcagcaaatgtgcaaatgttctacagccagattaatcttcctttaaaaagctcccattcataatatcactcccttttgaaaatactttaattgactctacatgatccatccaaattcataagtggagtattcaatatccatagtctggctttaccctactgtttcaatcatgcctcccacttcttctagatgctggccatctacactcattaggttgatctactccccatactttagggtgcacaatgtttgcccagcgtaattgctcagtgattttttaatggatttactgattaagcttcaaaggcatttccaactccacagaatgtatgctaattctaacgttacccgtatagaatactaaaaaaaaattttaacattctccaaaactatggctatatttttctcctcttccattttcatccttaggatggttttccaaagtaaaacactggcctgtgaaagctactgaaataatcttggtttcttcagtaagaaataaattattcactatcatccccactccaatgcaatcatagcagaattatctttcaaattatagccacatggtttctgaagactaatgaagaggctcagcccaggagacagttttgggatccaaaaaatacctttcagtttctgctctttctaattcggacagtagcaatgaggccacactgattcaactggtaagcttccttcatatttttcattgttgttttttcccttagtttcaagccctacctgagccttgcccacgctaccaccactctgtctgaatttttgcacctttatttcatccaggttgatactcacagcccctgagttttcctgactgtctaagacaacagtctaaaagtgaaaccagaaagctaggggggagaaacagtgtcacacaaaaattctggcagatactgccacctacagggattataaggtcatccccaactcaatctcctaaaaaatcactcatttataatagagggggaaactgggcatatttgaactacacggataaagaagaagccaatttcatcaaatgataacctttgatttagtgtatggaataattatatatgtatatatgtatgtatgtatatgcatatgtaaatcaatcattaaacagggccaataaaaacagggctgtaagaaagaaaattaaaggagaaatatcaggttgtgccagtcgataatttctgttactagaaattattaaaaatcatattggacgagttgattacctatttttggttctatatgctcttgaaaagtttatgtaacactgtatacaacatgatagaatatttacctataaccaaggtgtctaggggttgacatttttatcctataatatttgaaacttaaaattatattttagttattcacaaataattcattaaaattcataaactaaatgataaactatatcattcctgaaataactaatataaatgtagctatttaaaatatgagatgctggctatttctgtgatgatttaatgccatgttaacaaatatagagaagaaaatagtataaaagcatatttttagtatttactgtttaaaaaacctttagatctatgatttttaaaaactgcatttgaaaataattacaaacatatagaaaaggtgcaaaaaaagcacaaaacatccctttacccaagttcacctattactaaaatttaacactaggatttttctcaatttatttaatttttttctctctctgtccacacaaatacacacacacacacagaaattgttttttttcctgaaccatttgatggtgaattacatacatcatggcgctttacctcttaaatattgtgtatttcctaataataatatcgtcttacataatcataatgttaccaaccaaataatctaatctaaaaagtagattatttgatctcatctacaatctatttccccatttcctgtcaattgatccagaaatatcttcacgctatctccccctccagaacaagacccagtctaggaaagctataatctttgaatctgcttttttaggggagaagaaggaagagattccttattttttagctgcgtaggctcttagctgtgtcaccattgcaaccaaatggcttgagtgtgacaactcccattcatctttttggtctaccttttcctttaatacatcttggagtcagaagatggataataaattattttggaattatagatgggtaatatttaatgcccaatataagaaggactgaagacttctaaggtttgagggcagatgattttttttgcatgcatttgacagctcaattgatttttacttcttcataagttacctaagtgctatggataggtgatatggtactactttaggtgttgataactgaattatgtcagtagtctagggatgacaaatagccagaaaaaaaaaattcattagtttccccaaattggtaaacagtttttgggaaattggaagaataatatgagtgtcatggagacactatcggctaaattgacaatcagtaagaattaggtaactgaaaacctagctctttaagtgtgtatgagaggagagaaggcgggttaaactggcagttataattaccatgattcattcaaaagtatgaactgcagtagttactatgcatttccaagtagattttcaaaactcctaaattggtgggagtctaaattcgttcaaccattgtggaagagagtgtggtgattcctcaaggatctagaactagaaataccatttgacccagcaatcccattactgggtatatacccaaaggattacaaatcatccttctataaagacacatgcacatggatgtttactgcagcactattcacaatagcaaagacttggaaccaatccaattgcccatcaatgatagactggataaagaaaatatggcacacatttgttagattatatagagtaatgctaaatatttaaatcagcaaatcatctgttccattatagttttttaaatgattattttgccactacccaaggatgctgtgaaaataaatgataagatattctatcaacaaacaatgaggctttcaattaaagctgattataacttacttttaatgtatattgctattatacttaggctaaaaaaccagtttacgttaacatagtttttatgttaggctaaacatcaatatacacaggccaagttttctttgaataatcttcttttgttaatgaatggtccaaatctttaccccacctaaaattcctttctttgtgttttttacccattgaaattctgtatcgtcatacttaggtcagtcttctgggaagtcttttctgaaggtttcaatttattcctcttaagaatttattttgcatttatgcattctaacactcattttcacattaccacttcatgttgtaaaattttcaagtaattttagaccctacataaataattccctaagaataattttgttaattttatcctattttgtttcccctgtaacactcagtacaaatgctctctgattggtgggtcctctataatagttggctatttcagatgaatggtaaaagacccctctcacatctgggatcatcaggaggtcagagtttcagcaagcattgcagttatgcaaatttctatttgttactattacaataattgctagcagctagaagaagctagagtaatgatgtattttttcaaataagtgccttagaagattcctaggaaaagctaattgcaaacacctaggagagaaggcatatgcattatctttatctgtatagccagagtcctactagttacagagtggcaaagaagcagcatccaaataacttgtcttaggtatttgtgaataactaaaaatttagataattgcatttgaaaataccatattttagtgcattctatatgtggggtccacctctgaacacttgcatccctagagttaaagagagctagaaaggacaaatggacaacagacagcgtctctgcagacgaggtgattctttgagatgttattaaaatgagtgctgttcaactacgtgattgactgtaatatgaagtcacgtgtggaaaaaacaaaactacaccctgcattataaacaccattctagtgataagacatcctctaacccacttgtaaaattaagaagataaaaaccacttagttagatttggcttaaccatagttaaaacaagtttctaacatgaagtaaaccttaaccacaggcttcttctttcagaaaagcaaatacaaaacagttatagctagaaatcccatggtgtcttttaaagtactgaaagttttcagactatattgctgaagcctgttgcatgtagcctatgcatgtagctgcttgtctcctgtaggaatcctagcttacaaagtctagatgtgaaataggtcctgggttgagtggggcatctataagttaaaaatattttcaactgtgtagagttctacaggttctccagtcttatgattgggagaatggtgcttgctgactgtcagatgcttctattctcacatccatcttaataatatattcacacaagcatatgctgttaaataaacaaaagcagtactgatgatgatctggtatctgtgagtgtgaaactaatttttttttaagttgtaagtcatttgcaacctagacacttacagagattattggggtaaaattgtggactctagaggcaacagctccaccatttattgattacatgactagcaagttacttaacctctgtttatgtcagtttcctcatttataaatccaaagctaatattagcttctacttcatgaagtctctataaggagtatgctttttactcaagcagagcacttgctacattgctcaaacaatattagcttgtcttaataccattacacaaatacatgaagggcaaaaaaaaacaaagtctaatttctccaataaacaaattgctcatgtcatcaatctaatcaccatttgattgagtttagttgtttttcttttcctgaacacaggtccattgctagacatgcacttgcttatccagagggccaatcagatttctgaaaaagttccaagttttggcatattcctctctttctctttgactgactgacccatgattcagaattgcaatcacaaagtgcccctgatgctactgttcacactgtcagaggatagaaacacacaaagtttaatcagattctcagtagcaatgtgatgtcaatcgggatgattaaataccagccattctaagcctgccttgcaattgttgtctgagaattcacctgagtcctaaggaatgtgataatcctaggtctgcagagtacactgacccagagaaagaccactgacaacatctacatctacctttcttttggtatgggggtgccagagagggttaaatttacagtgtgtataatcatctctgggttgaaagtctatttgccaggttcatattaacaatatgttttctctaagagcatagcataaagtagtgaaaatagaggtctttcagcaatgcatggcttttgcctacagcagcagagagggaaggtggaaagtcattgctatgaaagaggctatttgttgtttataaagcataatttttaaagataaattgctggaaacatcgatgccatgaacataagtagacattgttcactttatggaatccattttatatccatttgcgctgcctgcttatgaaaggaataaagggagaatttcagaaatggctaagcaaaaaagacaaagggtggccattttgttaaagttttaccatccaagaaagtgctggcaaagaagtggagatatatccacaccaaattgtcaccactactgataaataactcagagaactgatctatataggtgacaaatcaaaatggatatttgcatacaaagagaagcaaatgatatggaataccatatcatatcctcatgacctagtgtcaatgtgactatgatggaagccataagtgacaccctcagcaaaataattcgaattcattctagtgctcctgggctcccatagcaccttgtatatacctctttgataaaacttactatgttttactcttcctccttacccagctagcttttacactaaactgtgagctatttgggaatagagattttactttccttatctttatatatacatagatttatctcagtgccaagcacataataaacaccaaaaatgttgaatattgattggattctgtgctttcatctttggtgactagtttaattgaaaaaaaaagcagtagttctgactcaagagaagacttgagcccccagaaataggcttgttttcattattatctgtaagtattccagtatgttaaccatgccatttaactcactgcctgtatgtagccatatgcatatcagctgaactattgatgccaaatgaaagtgggattatataattcaaaccaccccttgggtttaaatttggtccaagacttgcactctttatatttcttattttttttccttctattagtgaatttctccattactcctggggaaatagataattctcctttaagtagattcaattactgtaaagaaatcacacttgatcactttgaggagatctaagctttgctcaaactacaattcaatgagctgacctagagttaatcaccttttactcattcatttatcaaagagacaagcacaacaatggatggattttggcatgcagtcttcatgcatgcaccacattaattaattcctattaaggaggttttaccagcacttgcaatgaacactaacacttataaagacagcacagtccacattcttgctgttctgtctacacttagacatcagaactagcaaaggatgtattgtctatttttttctacataaaataaagcttactactttgtgcaaaccacttacctactgataagtccacactctgctagtttcagtgttctcctaaagaagcaaaagtatattactgctaaatgttcctgtaaggactaatttccagtgaggtgtatctgtcattttgtacatctttacaatttctgaactgcagaaagataacaggttttgtagaataaagaagaatcatttaggaattaggtgttagatacctatctatatttttttgtttctactcagtatcacatttatcttctgcgatttataaaactatacctccttttacaggaacatgatgcttcccatatcacatccaaatggagcccatagggattgctatgttcttacatgaccatacacccctggccagagttggtagattgaggagtaggctcaaactgggccaaacacagtaccttacctccctgaacacatttgattggtccaggagtgggtacctcacttagcccactgcatctagagccaagtgtctattcccatctttatcctgggatatttggattttagatggtatcttcaaaaaactcagatttgtttcccacaggggctaaagatttatgcaataaaacttaagagttctcagaaactaagtttttcacctcaaggaaaagcctagtctgcagtgaaaccaaatgaagctgacaagctgagagaggcaaagaggaaaaccagattgatttctgacagtgcctgaatcccgagggctggacttcaccactcttctttcctcagctttgttatttaaggtttctttccattctgggagccaataaatctccccctttgcttaaatacttcaggctgcctttctgacagttacaaaccaaacaattctaatcatattcattaatagtgcacactaaaacacactgtcaaagacagttacatttcagactcttcaaaaaaaaatcaatgaaagtgacagaagtttaaaataggatatcagtatgcaccagtatagcattcttatttccccatgtttcttctctaatcaccctactagattttcatagagtgtttaatatgagggaaacaggggaggttaggcctcaggcttctagtttctaatgtatttatagggaaagaaacaattgtaaactagtaccaaaagctccaaagctttaaaacaagcaaataaaaaaaaatcaataaataatatgggatagaaacagaaagtagattagtggctgcctgggactgggtgtgggaactgagaatgactaaaaatgggtatgaggtttctttttgcctgatggatacattctaaagttggattgtggcaatggttgcaattacttagtaagtttactaaaaattagataactgtatactttaaaaattagtgagttttatggtatgaaaactatacttcaatgcagctgtaaaataggcaaataaagcaaacaaaaatagaaataaagagtatgagcaattctacagattttaagcagctagagaaaatgattaccaataataatctttaggaattaaaattaacaccaatagaagcagcatgctgtaaatgtaaatatagttcaatatttcatttttaattttttcttattgtggtataatatacataacataaaatatactgtcttaaccattttaagtatacagttcagtggtactaagtgcactcatattgttgtacaacggtcaccaccatgcatctcaataactctttctatctggcaaaactctattcccactaaacaataactacccatttcctctctctccagcctctggcaatcatcattctaccttctgtttctataattttcactactctaggtacattatataagtagaatcatacagtatttgtcttttcatgactagattattttacttatgacaatgttctcaaggttcatccatgaaccctgcatatgtcagaatttctttccttttaaaggctgaataatgttccattgtatgtatacagtagtccctccttaaccacagggaatatgttccaaggcccccagtgcacacctgaaataaggcatagtaacaaaccctacttacactatgtttcccgcagcttttatttatctgggaatatcttaatttctccttcactttcaaagaacagttttgccagatataggattcttggttcacagttttgttttgctttatttttttattttggcactttgaatatatcagcccattgccttctggccttcaaagtttctgaagagaaatcttagctaatcttattaaggatgacatgtatgaatgacttgcttctctctcactacttttaagatcctctctttgtcttttgacggtttgattctaatatgactcagtggtttccctttgaattcatcctactttacatgttttgaatttcttggagttttatatttatgttttcattgaacttgggaaattttcaggtattatttttttcaaataatctctgtccctttctccttctcttctccctctgagacttccaaaatgtgtgtgttcatttgtttgatggtgttctataggttccttaggcactatttacttttctccaatcattttttactttctgttcctcagactcagtaatttcaataggtaaaaatcttgacctatcttcaagctcagtagttcttcctcctgtctgctcagttctgtattttattccctctagtaaatttttcatgttagttattttatttttcagctctagaacttgtttgcaatttttaagattttctacgtctttgttgctatttccattttgttcattcatagtttttttcttaatttcttcctttattcttagagcatttttaagacaattgttttaaagtctttgtctagtaagtttgccatctggtttttctctggcacagtttctatttttttttcctttaaatgagtcatactttttcccaattctttatatgtaattttttttttgttgaaaaatggacatttgaatttaatgatatggcaactctggaaatcagattacctcccttcctaaggattgctgttttttggtttgacttttcatttttgttcttttgggttcttctgattgttgcaggctgtctttgagccagggatcagcctgagctataaatttgaggtcttctcaagtttattctgggctcatgcctttccctgagtatgcacaccgactttctaatttcctctgcatatgcagttgcttttgaatgtctaaatctttattttctggctccaaaaaaagaaagaagaaaagaaaagaagaaaaataaagtgtgtgtgggaaagttaccaggcctttaaatcctcctcttagctggagggaagaagggtttgcaacaatgaggagagggtgaaatgatgagtccccacctctgtatctgcacctacatggtcagagacagtagtcagaaatcaaaacacaggtctctggtatttgacactttgagtcttatttgtccatcatggcttctacaagctgcatgcaagcctaacacagtatggggagtagagaagatagatagttgctgctaaactaaaactgactaaaattaaccataatttatcatccaagtcttcccttagaagttatacacctttaatagactccagagattaaaaatagttacttcagacagattgtatcagtgcaattattgtctatataaaaagacagattcctggtgcttcctttttttagatcttcccagactcctctttgaagattattttttatcctaatctacatatagtttcttcagataaagatctgaataaaaaaaagactacgcattgagtacaatgtatactgctcgggtgatgagtgcaccaaaatctcagaaatcatcactaaatcattattaagaacttattcatgtaaccaaataccacctgctccctaaaaacctattaaaattaaacaaaaaaaacagtgtggaaaaaattaagaagcatgggaattgtaaataatcaaggatgtataatatctatgaattttataagatacaatgagataaatagaaaaccttagacagctttctatccggtaaaaacaaatggaattgaccatctattgttaaaaaaaggacagttctaaagatcagaggtcaactgtgagtgatgtgagaatataattagccacagaatattatagtacttcaataaagaaaggctcctatagttaaaaacatacaagtcagacaaaggaagaacaatacatctatgatccataaagaattaataaagcagaacaaaaaggtattctgcagatataatttgcctggatgttttgcaaaaacttttatgaagaatttttcaaaagaaagtcatggaaaataaagaccaaggaggattttgaatacaaattaaaatttcattgtttgagatcaaagagtatacctctaataagcattaagaaaaaaaagcatttaaatgtaagcattttaatgtattaaaattattaagatcactgttgcccaatagattatattaaacaaccttaacttaaaatgaaaaaattgaataaaagtataaaatcattcaaaattgtatctatagtggaatttcatcaaagctgtaaaataactctaattaccaaaattatatctattttttaaacctgttttcctatttaagttgattactccgtgaggtaatttttactgccccagtaatgcgattcaagttttttacatctttccacagattcttttattatggaaagaagacactaaaatactatccagttgaaaatgtaattcctttcttaatatatcccaggttatttttgttagtaagtgaagtattcagggaaaatatctctagcatccccaagtctatagagtagtgtgggtaatgaccaataaggaactattttggggtacattcatttattattttgcttggggccctcaggcatacatatacacttccctatccctaaaatacaaaatctgctacccaagaacaattaagaaaaaaaaaaagaagaaaggagggacgaattatgataatttaattacaatgctgacaaatgtatacatgaagttcaaaggttattctcatatgctccttctaagagtacaaattgttatataatttggtaagatccttctctagaataaaaaacaatacaagtttaaagctttaagattggatagtatttttgatcctgtttttttccaccctgacatttattttaataaatacatgatgcatatgtagaatattttatctaaaaagatgttagccacctttttccttataacagtgaaaaacggaaacctctgcctataagtaagagatgcataaaataagtatggtgtattcatataaactatatgcaactaataaaaatgatggccaaagttttcacagtagactgagcaaaaaactatgagacagtacacacatttctactgtttaaaaaaaagtagacatttgtaaatttgtacaaaaagtagaatgttcttaaaaaagtagaaatttatttgcatatttaagttgacaaatttgttaacttaaaaatctaagttaattcacatgcaaataaatacatctagaattatatatatatcaatatgtttttagcatttatctctggatggtgagattataaattattttactttgttctttgcttctctttgtattctataaagttcctacaataaatacatattacttttggaataaaaaaggaataaaggttatttctaaagttaaagtaaaaaaattaacagtcatataatgtaaaatgaatgtgaagataccctgaaaatacagagtaaagggatctctctctaggtagtaaaaccaagggctaagtctttttagaggccccattaaataagtaggatagcaagtaatacagtgtatgagaaagggcaaaggtctcagcactagcgtgcctgtgttttaggttaggttttaccatttagtggttaaagactttgggtaatcattgtttgacttttcttactttattttttgtccacctataaaaaattacgtaaatggttccttgccttttatcttacgggttacctcaatgttcaaacatgtgcatgaatgtggacacattttataactataaagcaataatgtaagtttattaaaaagttgttaaaataacattaaggagaaaagcagacaaccaaataatagcacaattcagtgaaaaaagaaaaaaataaaccaatacaatgtaaagtttcacacgccatgttttaatccttatctagttccttcattgaaaggaaattatatgagtatgtaagataactatcaaatcctacccttttcctaaaacatcccctttcaagtcagttgcaagtaaactcttaacaacaaccacagtactgctattggtttgaattacctgcaacatgtaaagcatatatgcgattcacaaaccactaaagtgctataagaaaatgtccttttggttgtctcttatgtaccacacaaatgctaaaagaacaataacaactaatattttcattgaaagtctattatgtccctggggctgtactaagtgctttgtatgtattatcttagttaaaccatttaaccatcttcttaagtaggtgttattaagtagccaattcaaagacacatagaggtacacaggtggggcaggcattaaagcctatgtgcttaatcactacataaaatgccttctgttttgcaatatgaatggatattgtggtgaataagatatgggctctgtctctaaggctactgacatttaacagtggaggtaagatatgcatgcattcccaaacaaaattcaagttgagatcatttggacttctctctaagagtagttggcattgtatctgcgtcttaactttaagcgttttcaccagtcattcaggcacagaaagttatatatgtaaagacagaatataaaaaagataagcataggcgtttataatatttacatatgaaattatgtatgcaatatacacattacatattattccaggaatacgtattttattcatgagccaacattatgctacttgagggcagaatgtgaccaattcttattacaagactttcacataatataggacttacacactcagaggcagatgctgaataaatgccctgagctgtgtttttaagaatatttgtttcaaggtacgaacatgacagatttggccatagggaaggtgaagcaggggaaaggctagtaagatagacgaaatgttgtccagcagcagaaatggaggcagtaagaatggagaggaagaaacaatgcaaataaagtccaccagcgttgggcagtctgtagtgagaaaagtttaaagatctcttttaaagtggcactctggatttccaaggaaaacactctattgtcaagtaaagtgaatgtgttgcttggtaggatgatcttctgaacacattgaatttgaggtattgaggggccatttcatgactgggattagagctggggatatggatttaggagtaatcccccgagagtggatagatgaaaccttgggagtagctagtaggggagagaaacaaggagggcaattataaaaaaaaagaaatgaagctgctggagaaagatccttcaggaatatttataagaagttgagtgtgtgtgtgtgtgtgtgtgtgtgtgtgtgtgtgtgtgtgtgtagggggagtcaaattagaggaaggaattaaagggtcacaagaatctatccattttccaccacatctgatccataatttctaaaagcttaaatagaatccacatcattgatagatttgtctttctataagtctgtggagcgttcatcagagcccacaggatgcaaaagtagtacaaaatgcccatcaaaatattctccagcttcaatccatttaacataatttaactaaggtaacataccttagttaagacaatcatcactatttgctgacattcatagacagtacattttcttacaagcatttacttcataaaacaccaagagaaattaaactatgttggaacagagtgatgtctaacacaactggaaaaggaaaaaaagggttctggacattgttatcccaatgttaatgtcctaatcttgatttttcttacaaagcaactggttttctttgaaatgtctaattgatgaatacaattaaaaactaaagttctttgtgaaggaaaaaaaacattatcttcagaaaccaggaagctgagtgttaagccattgctttgtttcaaatgcagctgtatcttgttgcatgatagcatttatggcatcaccagtggaatattgtttttaataagtgcaaaactggtgaagacattggtctcctttagaaagaaaaagttaataatttcttctccaccacatattggctaccctgtttattaaaagatagacatttttgacatttggaaagcaataattgattctacaatattattaggagtccatatagatagtgaacctttcctgtcaggatacgacaaaaaacgcgtaagatagggacatccaaggatcacctaccattcatcacacgcaaggtaactgctttcccctaagttcactcaagcagaaaatgaacagttgccaatgatgatcagagagatagaaaatgctgcttccaggaatgaaagtctctttgttgttgttgttgttgttgttgttttaaagttaaaccaatattctatatacttttgctgaaatagcaagagggccagatttgataagatcacagtcctggaactgatcagttgctccttgatgtgtttacagaattttacaatcatataaccaacagatgctcaaaagtagcctcaaaaccaacaaagacaaacattctgttttcaatctttggtgaattattttgaagtttcaaagcatattgctcagaatggaattttacaaagataatctttagatcttagttatttggaggattataaactataccaatttactgttctatcattggaagaactgcaagtattttttgctccccacaaaactaaatctcctctgaaaatagaaacctatttcaataattcaatttgtattgcaatcaatacaaattgattgggtgcaataaaaagtacagctaattcttagaaataagcatgcttatgtcattaaggctaaaactgctagcatgagaagctcaagtgaaataaataaagtgtattcttataataagcattgccaagccattggtagttgaagacactattcaaagatgcaaccttgtctttcattggtgttctctgtctgcatagaaagggctgtgaaaggagagatgcaaaagaggcaaagaaataggaaaaatgtcttgggagaaggaaggatgttccaatgatatggaataacaacaaaaaagttaacttgggacaagttattatttaataatactggagacaattccaaaaatattttgaatcacataattatgctgtggaagaaaaaaaaattattcaacgtccaagactttgtgtttgtgaaaaaactgtcctctttattttatagcccatatattctaaatgtttacaaagataaacaacattgtttttgtgaccattaaaatatgatatgtgaggaagtatgcagggcttgggacttgaagattctgcatcaaattcagaataaataacctgtgatttagctacaattcgggccaaaccttcatggctttttgacatcaagaactagtacatagtgagggatcaaaggatgcaaaattgagtgtaatcaaggatatatgattttttcttctatcaggtaaggtacaactgctagtattgatgaaatgacaacttaaaaaaaggctttctgggccagacgcagttgctaacgtctgtaatcccagcactttgggaggtcgaggtgggcagatcaccttaggtcaggagttcgaaaccagcctgaccaacatggtgaaaacccgtctctactaaaaatacaaaaattagctgggcatggtgatgcatgcctgtaatcccagctactcaggaggctgaggcaggaaaattgcttgaacccaggaggtggaagttgcagtgagctgagattgcgccattgcactccagtctgggcaacaagagcgaaatttcgtctccaaaaaaaaaaatggctttctgttacaaaaatgacaggtcagtaatctgttacagaaaaatttataataagaaaatgtgagtaggtaaacacacctaaatataccttaaagattgctcaaaaaaagactcaagtggattaaggacttcccaaagtattcttagtggtgcttgtcaaacactatccagaaagccctcggtcaggtttgtaatcttttcggtagtgttcatttgttgcaataaaataagtcagcagttttaacaaagaaaaaaattctataatgtttactgtttaatactaaacacaacagtgtgagattatttcctgggcttttaaaaattatacatatcttttttttagaaacctttacaaggaatagtagcatcctatgaaaagttggcttaatatttgattatatatggtgtgtatgattatctccataatttgagacattaggctattggtcagaaatgtgatctccactgtaacagcattttaggggaacaattatatttgatatttctgttttcaatttatagtgtctattctagaaatataatctgccataatctgtcaaaactgccaagactgtttgtagtacttcaatggtactttacagctaatatcaccaccacccaacacccatctgcataatgcatttaaccttacaaagaatacttttatctattatattacttcattttcaaaatggtcttataaaacaggtagagcagggattttaactgaatttccattatgaggaaaataaggtaacaacccattcctggcaaaatctggactagaattcaaatcatttggctccaaactaacacatgcttctccaaaaagcagcccagtatttccagcgacttaatttaatgaacagattcaagacatgggttaaaaatgttgaggatgtcaggctgactgtcactgagtatacttcttgggtaaggggcatccttactcctgttaagatgatcttactaacagctaaagcagactgggagaattttgacaggagaactactattcttttcagacacagatagttcccttttggtgaaacttgttgcaatgttccacaaagtgttaccgcatctggaaagtccataataattttgatttatctgcactgacagtcagcagtatgttatattcactgttgcataatattattatctgttgatcttcccagtagataatatattcctcaaaggaagaatcttgcttattttttaactctgtttagtgccagccatgttgaagttgctcagtaaaatttgtgggaggaatgaaggcaggaaggcaggcaggcaggaaggaaaggaaagaagggaggggatgacgaagttttggaattttcttttgcaaaacactctgctaattgaatttatgacacaaaagagttcagggacaacaacaagaaaaatgtttgaagtcattgtagcgaaagagtatctcaaaaacaagtaagagaatgacttaatccaaccacttgatatgaaaattaccagtaattagcctgtgttaaagagatcaacttttttacacaactcagcagcaaattggttaacttaaccaaagttatgcccaaattgctccttatccaaactgatttctatgttttggtttcatgaaactgatctatcattcaggacaataaactaaataagaactaggcgttttatatagtgttaaggaaaaaacatcattactggcactagtatcaaataatattgctttctttggcaagcaactcaaactaggaaaatgaatttattaaaactcttcatggaccttatatcaagtctgcaatctcctaaatgtaaaactctgcctataaacattgtcagggtaaaattttgccttaaaacagagtaattgcttctatttcctgtgatgtttacacagcaactccttcagaattactcttaaaaagaaatagaaaagaaaatcaatagcaacagtgcactatgaaataaactttgtggcagaaatggaaccagaagattaagataaaaccataaaagtatgaaataataaaaagggcaccaaattcactccataaaaaagactaaacatgatttcaaatgtatattacacacacacacaatggaatatagacattttgtatttcacaagaacatttttataaaaaataatttgcaaaaattaatccagtagcaattaatactattctgcctaacctcatggtattgacaaaccttaatcagatattatttgtaaaaatatactttacagcattattacaaatgtttcattttccaaataaattatctttgaaatatttttactttgtataaaatttttaaaattcaagaatcatatactctctcttgttaaaaatgtcaactactaattacacaacttactataactgcttttactatttgtatgcaacattcttcttcattatttgtgttctactttgcttgttttccaaagtctctggagatattcttgtaagacaaatttaaaacatttatcaatttttatcttaaatattaatttgagttgaaaattagacatgtttaccttaaatactgagcaaaaataatttcaactatatataacagttatagatctatcaatccaaaatgtatatatatatatatatatataaaacaatactaaatgtagtatcttaagtaattttgaaactaacatgaatttccaaatgcttctttagcctagcagacgtccaatgatacacggttgaaggtaactgcttcaatggcaatcaatcattaaccatcaaatccactcaagactagaatcaaactttcttctattaaattacccgcgcaaaacaactgagttttcccatccaaaccattggcctctgcaacttgtaagagtagagggaaaacagacagatctacttgataatcaatttaaaggttatcaaggctttctttacttttgctaacacagtttctattttgagccttcttggccaatgtgcttctgcctaagtgtcacaatctgttttaggtcttagctaagaaaatgtcttatatggtttttacagttaaggattgacaactgccttttgcttttgttggtaagcactcctctaaagttctcttgcctgatcaaacctcacaaaaatagaaattggtccttattctgaatgtttaaaagtccagtaagcatttactttttcttgacgtgtgttaacatatacacgttttgatctactcttgaagtaattaatttaggaaagtgaattaccaatactgtacaaacacatgatgccatatggattttcagggctgaaccaagttcataagcaagatggcaatgaggagacatctatactttatcttattgcaactaccactttgagctaagtacacagagcttgaaggagaaatcattacttgcttctttggaaaccaaatccatcctctcaaaccctatggttttcccttccctttgttaggccatactgatttacattgtatttcagtattgaaatttacatcagaccaatttcacattgtttagtaacttgtgatttatgtagtattaagattaattccattatgaccaatatcctgtcatatcatttaattacattgacatttattgtaattacatctaataaattagatacatttaaatacattccagctaagaatttaaacaaatgagagccacctggcacaatgagagaaactgtttcagtacagagacggcaaagacactctctgctccccaagttaaaatgatttagtttgacacaacctggaggaatttattctgtgatcacgatattttctcttttgcataagatacacaaagtttgagatggaatttggtggtaattagaaggcagagaagaccataagaaatatgggaggtcatgcttttctcttttcattaaaaagttatctaaaatgatagcataatccttgatagtcatttttaattggcaattattgagtacacacagtgcagccagaattgaactgaagtgtcacattgtcaaatgtgacttttcctgttgcatttgctttggcagcttgaacataactattaggaccaagaagaaataaatacttcacattctaaagaatatggggccagatcctctttccagagctatgatcaatagcaacccccaccgcctaatcctccttccctaacacactttctaatctacataaggtgatctgaggatcagaaaagagaaagagacaacgcattcttaatggagaatacagaggttgtgttctccgttctccgtcaaaacacccaatttaagtgcgattgaactccaaaataaataaagacagggacactggcatgtcacttccagggctctgtacttactgtcagtggagtgaagcaaagaacttttaactcaatttaatacatgatccctgtggcttgaggctatacatgaggagagagaggtgtctactcctcacctggaggtttctgaaagcaagagactctccaaacaatctatcctagggtgaaagaacctaaaaagccaaggagaaaagccctctctgatcctcacaaccccctgaggttgctgaagaagacctcaatgggtaactgacctcagtgggtaactgagcttcatgtggagaagtatgaagtagaaggtggaagaagaacgacaaggtggtctagataacagtcatattaacggatcctcatggaggagtgagggacattagctgcttatagaaagtacggtagcaggagcaacagcatgttgtgtttacacactttgacatcatatatttctggatgaagcctcagcactatttttttttctttttctttagacacagtctcactctgtcacccaggctggagtgcagtggcgcaatctcagctcaccgcaacctccgcctgccgagttcaagcgattctcttgcctcagcctcccgactaggtgggattataggtatgcaccaccacgtctggctaacttttgtatttttagtagaaacgaggtttcagcatgttggccaggctggtctccaactcctgacctcaggtgatacacccacctcagcctcccgaagtgctgggattacaggcgtgagccacccaccgcgcccagccagcactgtcaactcatttaaggtctctgagccttactttcctcctctgcaaaatgagaacaatgtgctctacctcacagggcttttatgatgaacaaatcggacaatacttttagaaatgatgtcaaatgattacactatgcaaacaatgatattattacttaacctatatattacattcaacttcactgcttgctcatattatcttactatattatatatattcttaggacagctggagtcttgtactactttatgtcttgtgtattctccaggtgtgctatatttagcataatctaagaatgatttgcaatgacccttatctttgtataattctcttccctttgagtgtgtgtgtaacctgtaaatatgacaatatatctcaccaatgatacaggctgagcaagccaaatctaaaaatttgaaatccaaaatgctccataatctgaaactttgcagccaatatgacactcaaaagaaatgctcattgaaacattttggattttggattttcagatttgggatgctcaacttggtaagtgcaatgcaaatatttcaaaatctgaagaaaatccaaaatctgaaacatttctggtcctaggcattttggataggagtactcaacgtatgtgtgtgtgtgtgtgtgtgtgtgtgtgtgtgtgtgtgtgtgtgtttgtgtgtgtgtgtgtgttcaagaatggaaaagccactaagaatgccctccagctgacaaccagcaagaaactgggacctcagtcctacagcctcacagaactgaatactggtaacattctgaagaagcttggaagcagtttcatcttcaaatcctcaagataaagagcccagtcaactggctccttaatattagccttcttgagaccctaagcagagaagcaagttgagctcccacagacatgtgatctacagaaatgtaagctaaaaaaatatatgtgttttttggctactaactttgtagtaatctattatttagtgattgaaaactgatacagatgctaaaacctatttattaaatgcatactatttattaaatgaaagccattgattgaatgttcatgaagcaattaatatataatatctgagaacatttcatgtgaggtcttgtctgaaaattcttctgaagaattttgaatccttattagaatctgaaaaaaaatctcagaggctaatcacaactaggattaattggaagacatgaataagcacccctggtgatgtttaaaacatttgttgagggtagagtggtagagtttagcaaaacctgtagtcaagtaggatggaggctcggcaccaatataatttggccaaaaacttccatggtttactcataggctgatggcatgtagattacatacaatgaaatgataatttttatgttaaggagagaattctcaaaatatttgtaaaaatgggcagtttgggatggctttatggaaaagtggggttcatgttaagtctcaacaccgagtactaatgactaaagtaaaagaacactgatgaggaactaaaagaaaactacagagataatcaaatctgctcccctgcctcaccccttatgcattataatatgtcatcattccctgccaaaaatagaattccttttattttagtatatctctagggaataagatcgaagaacactctcctaggaatttaattatccttcgttggaggaaatcctctcgctcaacatgaaggcaaaaagtaaaggccatttcatcttgtcctgcctcccccccgcctgttaattttaaaacacatgtttagatactagaatattttaagaaaacagctaccatactggcatctggtgctattggcaaccagtgcaaggataagctccagtgagaatttaaaaatgccttttcctaaggagaaactgttaaaaaaaaaaaacaacctgattatcaattgttccccaattcatgaggaaaaagaacaagtattatcaaagagctaatttataaatacctggatttacaactcttttccactaagtatttccaaaataattgttctcaaagttaactgtacactagagttaactagggacctttaacaaattttgatgcctagtttctatgcctttaaaaattctgaactaattggtctggagttcagtttgtttattgtgataatttcaagagctcccaggtaattctaatttatggcctctgagctatggtccaggattacatgcatagtagacttctgaagaaagacaaccatgagttcagtttatttctccactagaaggactggattttagagatctctgaagtaaaatatccatgcatatttgctctgaaataaaaatgttacagaacaatgcttttatttcaaggtttgcatttttccaaaggttttttttttcaattcctctgtttgcaatgcagcaatatcttgtttgaatgcaaattaaatcttcctcttaataagaaggatgtgtctctgcctcaggaccatgtacaaacagtctggtgatggcaggcagtgacccagggatgttcatgatggactgagagagacatggcaaacattacaagcatgcattgcaaatactggactgtggaaaattaatagttttaacccttaagccaacttcacctggcacagtagcatattttagcaataatttacctacattttacactaacttgggggaattacagacacaaagttggaaataaaccatactgaagatagcattatactttaccttggctgaaacttgggaagcaacacaatttggcctttatatttaaaaatcacggttcatttgacgtcacataaatgtagagagaagagtggaaatttgagtgagaaaagctattaggaagtatatttactagagaaggaatagaattaacagaacttagtttttttcatcttacattttcttttgttgataacgaatcaattggaacatttttgaggttgccagaatcttctgattctggagcctaaataaggttttttactggcaggttgaccgaataatagaaatttcatggccagaggccaaccaacactttataaaagccctctggaccaggtggttgacaagcccaggacttacatgaatgcaaccccagaagaaaaacttgcaagtgcctcttcaatagccatccaagactcttgcttgaaattcaaggcagctgatggtgatttcgtcttccatttacaacttctttattcttataaaaagaatgctgtatccttttctttcctccccaacaccaacagttcactcgttcaaaaactctaaggcattcagttaaaagtagatgaaaatattgtttgccagaaacatcttcaaacagaatatgagttttcacacacggaatgctcattagaagcagaagcaaacgtatcactgtaacataataatagctcatattgagcaagtactctgggctgtgtgcctaacatacaatagctcatttaattaaccataatgttgggtggaagctattattttcatttcacaaattaggaatctcagacacatagaacttaaatcacttgctgaaagccgtacagaaagcagtaaaagatccagtattcaaaagtaggtaatttggccaaaagtgtccactcttaattataccactctattgtagctattgtgtaaagtggcccatgagaacaagcaatgggtaccttgccccagtggaaaaagataaattcagggaagtttcttgggtaagtttatttctgcactaagtgaaaatgttaaataaaaaaatatatggatgaggtaggcagggcccagtggctcatgctagtaatcccagcactttgggaggccaaggagggcggattacgaggtcaggagttcgagaccagtctggccaacacagtgaaaccccatctctactaaaaatacgaaaattagctggtcatggtagtgggcacctgtaatcccagctactcgggaggctgaggaaggagaattgcttgaacccaggagcggaggttgcagtgagcggagaatgcgccactgcactccaggctgggcaacagagcaagcttccatctcaaaaaaaaaaaaaaaaagaaagaaagaaattatatggatgaggtagatggaggacgggggatggaattcctggcataggggatagcataactgaaatcaaaaaggttgaaacaaagcaaaacaaaaaaacaaacttacattgtgtgttgggcagtttggtacagtaaagagataatataaaaatcaaggagatggcactggagaggtgaactaggagaagatcatggcagtcttagtatcacaccaagaactttgactttgttctacaggtcagaaaatctcaaatatttctgatcatgacccacagaaaaaaatatattttacttggtgacaaatacttttttaagcatgtattttacttctatataataaaagtttatatatctttattatacatgttatttataatacgtcatattatagataatatcacacacacacacacacacacacatatgtacactcaaactggttgagcaccctaaatccaaaaatttgaagtttgaaatgctccaaaatccaaaattttttgaacaccagaatgatgctcaaggaaatactcattagaacattttgttttgttttgttttgttttgttttttttgagacagtctcactctattgcccagtctggagtgcagtggcacgatctcagctcactgcaacctccgcctcctggattcaagcaattctcctacctcagcatcctgagtagctgggactacaggtgtgcaccaccacatccagataattttttgcagttttactagagacagggtttcacgatgttgaccatgctggtctcatactcctgtcctcaagtgattcgcccaccttggcctcccaaaattctgggattacaggagtaagacacgatgcacagccatcattagagctgggctctaatcatcattcatattttatattttcatatttgggatgctcaaatagtgcaaatattccacaaacaaaaaaaccctgaaatctgaaacacttccggttcaagcattttggataagggacattgagtctctctctgtctgtcgtgtgtgtgtgtgtgtgtgtgtgtgtgtgtgtgtgtgtatgcatctgtatagttggcccttgaacaatgtgggggttggggtacccatacactctcagttgaaaatctgtgcataacttttggcacccccaaattttaacaaccagtagcctactgttgaccagaagccttactaataacaataagcagttgataacacatattttgtgtgttatatgtagtatatactgcattcttacaataaagtaagctagacaaaagaaaatgttatttagaaaatcataaagaaaatacattgacttcattaggtggaaattaatcatcataacagtttcatccttgtcaacttcacattcagtaggctgaggaagagaaggaagaggaggggctgatcttgctgtctcatgggtggcagaggcagaagaaactctatgtataagtggacctgtacagttcaatcctgtattgttcaagactcaagtgtgtgtgtgtgtgtgtttgtgtgtgtaagagagagcattttatatatatatatatttgcaattgaatgaaaattttcaagaaaattaatgaatcttactattcaaatattcatattttctattctatttcatatcagttctagactatttaggaaatgagtaggcctctcaattcatttttaggccccattaatgagctataatactgtttaaataacactgttatgggtgttggaaatatatgcgctatcatcaaaggattttgattacaggagacatagtttagagtgttacttcaactgggtcactctgatagcagtcattagctgtctgaagatgattttgagtcatttgccaagctcaggcaaaagagaaaaggggagacaaaatcaagtctacttagatgccacaaaaaataaattgaataacttagagtctccactaaaattataattctttattagaagaatgttaaagaaatgatccgaggaccactattcttgaatatccttaaaagtgcaatacaaagccagttagattagcagggttactgacatacccgcctgaaggaaaggaaacaaacaggcgaccactggtgccctccagctctagatttatttccctggtcactgactatctgaaaactaattttggttgcctgagaataaaaagtcaaaagtacatgagattgctctgaagaggagtctacagaaatgtattagaaacagatgaatagtcatgaccctctttactcaatccactcttacacaaatgtctatgcaactacagaagagaattcagtacctatttatcaataaaagaatatgagaatgtttctgcaggctcctaaaaaaaacctttcctatgaacagaagataatggggttattatagacaaggcaacagcgccttctgaaatattgcaaactaattaagaataattattaataacatttttggtggtattgtcttatgcttgactaatttgtaaatattctggtatatttgaactttcactattttagcctgtaccctattttttagcacagattttaattagaaaaatagaagtaataacaagggaaatcacatgttaactaatgaactgagcctaacaacaaaaaagacacagggaggcccttgaaggactctctagcttgatgttcttcttggaatctagggcagggcaaaagtcctaacatcactctatggacaacagagatgaaccacatgagccaggtgctagaactgtgatatttatctctgtttccctgtgtgtaccaccaccccacaactccaaaaaagaaaaaaattataaacacatccactaaaattggcaattctagagaaactggatggcctgttaacatctggctttcccaaaactcaatttttctgtaactcattcattttttagcctttgattctgaagaaattacttgcctcctggccagccacagaggctgacgcctgcaatcccagcactttatggggcaaggcaggtggataacctgaggtcaggagttcgagaccagcctaataaatatagtgaaaccccgtctctactaaaaatacaaaaattagccaggcgtggtagtgggcgcctgtagtcccagccacttgggaggctgagacaggagaattgcttgaacttgggaggtggaggttacagtgagctgagattgtgccactgcactccagcctgggcaacagagggagactccgtctcaaaaaaataaataaataaaaataaatgaaattacttgcctccttccaggcttgctatagataaataaacatatacgcgcaatctatatttctccattacactgcaatcatttccttgtcactagaattgtatcttgtagtccaagaggtaagtaatcggaactgtcaggacaaactcttgggactgtaaatgtgctatctggagcataactatcctaagaataaaatccaaaagcaaaaactcatcagaaaagatttgaaactcatttcagacaagatgcagactataaacaaataaatacacaatatgaaagcaacttaagtctcatgatggaaagattttgatccaactgattattattgttcctagttcaaaatattttaggccttatcaatggcaatgcataacaggaatgactaaggttagcttttcagtgaatcatcagagtagtgattaaactgatgacatacaagactcctaactggattttgaagattgagtacagtatccaaaactagcactggaacaagacaacaacgttcattcagcccacaagaaaaccagtttaaaactctgaaacaatgacaccatgagtatatttgtgataattatttgccatgccaattatattaaatcatgaggaggtagtacacatctacatgcataacgagcccatttttatgttagcatatctccaaggactttcctgctgtgtattttatactgctactgccttatattttatgttagcattaatgttttaattttcatatacatatccttaggccattttacgaagggcgtggctttaaaaattcagttgatatattaaattaatgttaaaaaaaggtcatgtaacaagtagtcctaaatcagttctttgtgttccctctgtacattcaaaccttctaatatggtttatttattatgggtaatacagaagtaagatctgggctctaaactctgaccatctgtcaggttaacatgcatatgcactaagtgtctttcttcagatgatggatcctaccacaagtcctccctaaaacaatatatcaatccccttccccacaaaaataaaaaaaattgatttatatcaaaataaatacataaaatagagcttctctctaaattggccttctgattagaatactacttcatcacctcagaaaacctgtcttaatattatacaggtagaataatttaccaaggtgtaaagaattttttaaaaaatacaaaaaagagacaaaatagtgtagtgattaggaataaaagttctagaacaagacgatctctatcagacccagttcggccattgactgtcttgtgagtctggtccagttatttcaccttttagagctttagttttctcaattcaaataagagtattcaccacaaggtttatttaaaaaaataaaagatccatgtaaagcatttgtatcaaattcaacatatttattaatattactattgttactaatacacagatgacttcaaaagctgctattaaaaaccaagtaaggatgtgggtggcatgctgtattttagattcagattcaacagccactatactagttacattcatatgacattcatatcacattaacgtcatagcacagcacagcaattaagaataagggtctgtctggttttaaaccttagttctatcacttattagctgtatttaattcagtaatcttcttaacagttctataaaacagataatagtattacataccttataatgttgttggaaggattaaataaattactatatgtcaagctcttagaaaaaaaaatttgctgttgtaattatggattttatttcagaacggaaaatgtccaaatatttaaaaagccagaagaacaacagaaccagtcttgtagtcactgaagtaatgataatttaaaaaatcataataataaccattaaaacagtaacatgctatacttagctcaagcgtagcatgctatcatttgcctacaatttcactatattacccacatgacctctcaacaagcctgtaatgtgggtaggctatagattattgccttcaaattatatttcatgaacttgaggttcagaaatcagtgacttgctaagccacataatagtaggtgttcgagccagtgctagcatctaagcatgggcctcatgatccaatgccctttccacttcactccttcacaatggccgaagaaccaaattcaaggcaaggccatccaacaggccatcctgataagaacccctcctgaaataagacaacacggtcacacaaatcaagtgcacatgctttctaactcaatggttataaagaagttataggtaacaactgatacatctgcacaaaccataaggccattaacacaaagatgcattttaaagctaaccagttccagcagattatattcatgtaaagagaatttggttttcctttccttctgacacttcattttccctttgtctcccaaatctgttaataactatttttaggcagatggagcatttcatgaatgggtcactcttaaaaatctcatttggtttccaatttttcttcaagcattaagacttactacttttagattttttggttattatacacaaaagaatatatgtggatagaatatacacacatttatgcaaatatatatatatatatagcatgcatatatatgcacatgcatgtctatctatacatatacatttacaacaaagaaaaactgcttaattttatgtataagagattcagagaactagaccaggtaacactcagaatatacacattattaaggagaaagcaaaaaataaaagagaaatcagtaaacacacaaatcttcccattgacaaggttccctttctgagcttcctttcactttacttctgattttcttctcatattatgtgcttcaggtaattctgcacattttcttctcctgaagagaagccatcaccagaagaaaaagccatgaggtctttttagagagaagaaattcacaaatactgttaggcagggaggcagtcaacaagcacttactgaatccctagccccctaagcactgtactaggtgcttagaactgagtccctcctgctattcagttagaaggatggaaaagctatgacttctagtattagcactgacctagttaagccatgaataaagaattaaaaggttttcatcttccaccatacaagttaagaaaacaaaaccagaaaccttgatatatgtttttcagcccaatgcattatggtttcacatatgtttcagctcttattgaaattttttagctcaatttcttttggtctagaaagttaaaaaatgtccaagtcaacaactcagtaagaaatttagaaagtttccaaacaactcagttttggaaactttttagttcagcatttcccaaactctttgctattgacattttaggctagaaaattctttcttggaaggagcaggggcctttcctgtgaattttagagtgtttaatggcatgcctggcctcgactcattagatgcctgttatcacctctccaaccgagtggtgacaaccaaaaatgtcttcagacattgtcaaatataccctgggagcaacataattcctgagtgaaaactatctaggccaaaacttcacctaacacataactctattagatggatagcatgaaaggatggcatataaaggtctggaaatagaatgacattaaacttaaaataatcagcctttttcctaaaggtatttttattcaccttgtacataacattgagaaaacatcacttgtccaatatcaaaaattggggaccttaaagcaatacacccctggtcttcccaaatcactgctctggcttgctttagtttgtaacattaaggctctgtttcctagaaagtccagagctaagacatacaggttgctttcagttcttcagaggcaaggaaactaagaaaggtggtaatcataagaacaccacacataaaaagaaagggaagagtaaaccgagtttctgttcttaaaagaaacagtgggaaaaaagagaagacatacattatcatttcaaagcaatttatcttaacaataattgggcaaaagacattgtttttagttgtgttcttgcagaagtaatgtcaaatttacttgaaagttagagttttagaaaattttagatgcagggagtacatgtgcttgttacatggatattacttgtgtaatagcggggattgggtttcttgtgcacccatcacccaaatgttgaacattatacccaataggtaatttttcaactctcattcccctcccaccatcctcccttttggagtttccagtgtctgtcatctccagaaaatcagataacttaaaaggtttcatgcacgttaaatagttaatagttgttttattacaccaaaggaaaaatgaaaaactgtttttcccaaaacagcataaatgtttattttctgtatgtttactttgctgtcccatttctataatatagaaaagtatattatttgaatagctaaatgtatttatcataaatatattacttttatataaatatagtaaatatatcttttactttgggatgtaaacagagctaaaatattatattctcaaaagccccaaaatagtccttaaaaatcattgaattaatgtggttatttaatcttgctcagcaatttgatgcaaacgcctaaatacaaaaagtggtttagtaggtactacaaaggaaggaagaaggaaggaaaagacttaatactctagaatgtttcctgaaaatcagaaaacaagtagcattcaattgtagctaaactaactaactaactctctctctctctctctctctctctctctctctctcctcctctccctccctccctccctctctgtcacacacaaaaacacacaccacaaccctgattaaatacctgttggaagaaaggaaggaagcatatgaggcagcatggaagagagaaagagagtgacaacctcaagagacatcattgacttgagttctagtcctatgatggatttcagaaagtggtcataatctctttaggcctcagtttctcatatgtaaaatttgagggtttactagaagatacatgtattctcttcaatttaaacagtccctgattcatagtgtgtttcagattagggtagtaggaggaagattctgagtttcagaatctaagaaaaattaaatgatctaagttacattctaaaatcgatatgagctgcaattctgagaacaacttggccagctagcccgaatatttttggcaatgccagcaacagattggctggatggcactgcacaagagaatctttttaacacagtctgctcaatctggtctatccaatgttctgcttgggataactttaaatttgggttgacttagaacttgtccttggtatctcactggctgttaagaggacagtccatgataaatgtcttcttcattaaaagtcaattcttgccaactttttcatgctactttttttctacaataccacatataatttgagacatactgcccacaaaacagaacctacagaaggttggaaacaatattctattctctctttcagagacatgtaacattaaacagggttcaaagggaatgcattagaagtttacagaggaatttggattacaaatggttcacaggaacagtaagtacttttttttggcttaccagctagaagtgggacataaggtaaacaagctatgagtagatttctatagaggtaaaacacctcatgttacatatcaccacacccctgctgtataatacataccataaagtattattacaagatttaaatatttacatcaaggtttgccaatgaaaagagctttgagaaccatgttagcttgtagctgccaaagacacaagtaacagcagtagttgaaatcaggcagtagtctggggaaaatggggaatccaagaacaaagccatgtatgaatttctccctgtcttccatttcaaagtgctctttgtaaagagaaatacctaacaatgcttgagaacagtttatatttataattgtaataaaaaagaaaatactgaagactgtatttttaggtgtcttagttcaaaggagcaaaacactttgtcatcctaatcagaaaagacatttaagataacaactggagaaaagtagctttagaaataagtaggaaacatgtcctaagatattttaataatgtcaagcagctatttgcacaaaaatatggagctgctccacatttcactacatcttccagggagacggtagtagatatgagtaggtaaacatccctaacctgtctagtcacatcagcatattagccacagagaaacaagatacataaattctgggaccacctaaagtgatttgttgatcagctctgtgcataattactgcttttgtttaattacttttaattacctgtttttcttttgtccttatgccctgaggtgagtttttcatcagtaatgggcatgattttatgaatatcacatgcaaacaagcaaattagacccactgaacttgggaaaccatttttccccatcccttctctaaaggttagctgctattttctgaaaatgatattgattctatggtaacatgcacaaaggcactaatcaggagaacaggagcttttgtgaattcagtaaagcttataaaatacctcattataacatgctaccaatctatgaccccaataatagcagtcccaaaattataaataaattagatgtttaaattgttacccttttttatactacatagtgtaacacacattataatttccagaagagctcttaaagaaaaaaaatgtggagaatgaaaattgaaaagcagcagctgcttaggagtgcttaacctagagctagacgtccaggcagatcgaaactgcctgctgctcctccttcccttttcctatactgcctacaaataatcggtttgatttttcataccacgattttgattaagcactgtgtcattatttctgggtaataaacagtttttattattttcagtttaaagcaattattgccaaaaggaatttttaattttaatattaatttatttagagacaggctctcactctgttgtccaggctggctggagtgcagtggttcaatcagacctcactgtagccttgaactcctgggctcaagcaatcctcctgcctcagcctcctgagtagctaagaatacagggcggtgcccccacatctggctaatttaaaaaaaaaaatttgtagagacacggtcttgctgtgctgcccaggctggtcttgaactcctgacttcaaggaattctcctgcctcagcctcccaaagttctgggattacaggggtgagccactgtgccaggctcaatttttgtttttaatgataatagctaattctgatgagaatccttgaagcaaaactctcacaccttgctagtgttccagcatgtataatcccctgttatagcctgaatgtgtcccccagaatatgtgtgttggatacttaatccccagtgtaacagtgttgggagatggtgtctaatgggaggtgtttagataatgagagctctaccctcaaaaatggattaacactgcaatataaagagctttggggagaagggttctgcccctctgctcttctgccttatgaggaaaaggattccttccctctgggggatacagcactcgaggccccatcctaaagcagagaccaaacccttaccatcagacaccagatgctggagctttggtcttgaacttcccagcctctagacccatgaggaaaataattctattctttataaactacctggttttaggtattctgttatagcagcaaaaatggactagagacatctccttttaaaagtcttgcatgcactgataattgttgatgtggtaaattgaattaaataaaagaatctaaaatgactgtcttaatttttttaaaaacagttttccattgacaggtgttcaaaacagcattatttttaacttttgggtttgtgtagtaaattaattaggggttttcttttatatttgtgttttccaatttttctttaaggaggatttagtatttataattacaataatttttagaaaaacattctcatttaaccatgaaaagagttttaaggtattcacaataacgtattagagctcagtagctttaacacatttctttctacaggtacatgacataagtgcatgatgatatttactaaaggatagaaagagaagtcttaactatcttgaaaacatgaaacaatttaatggtgagtttaaaaaaaacctatgtattgcaattaattgacaaataaaatattgagacatgggctttaggttcctctgaggcaaaaaaaaaataccctgtttattaattttttgtccccttctccttgctgttgtagaatatatgaacatggtcttataataggttcagaaccatggatagcagatccatgcttttaggtagatgcggcattatcttaagagacaaagtatctgctgatcttcagtctgctttgtagtggcctcgttatgagggcaaatcagttaccttctctgggcctcctttgcctcactggtaaagcaattcattgccttgcctttccaataggggaaaattagactaaataaattttggccatttacagctgaggactaggacttttttttaatcgttctgatacacaaataaatatgctctgacattattccacggatgagttttactttttttgtttacttgaatgagaataatggataagaaaaacattttcaataaggttaatttatcaatatatctacttccctattgtcttcagtccatagttctagtaatgagcgcaccacaaaattgataattccatcagattatcatggaaaacgagcattgttgtatgaacgtttttgtgactactgcaaaggtcaggaacaggtctgctttgaaaacttcagataaagatagtttttaaaaagttccttaacacacagtcctaggagtacgctattaatttttcaacttaaaaaactaaggtttccatatcttttttggtagcttcaagggaaaggaaaaaaaaaatgccttcacattcctaattattttgaaatatttttcattggttactacttcttaaaaattcattatccttttttttttttttacttttagattttatcaaaaccatatagctatttcctctctgattgacaaataaagccactatcggtttggcacaaaatctagaatatggtagactctcaataaatgttagatcctctttttcttctctcctattctttcctatttctataaggtacatttcataagattttacatgtggcattcatcttctagatcaaaaaatgtatcatttaatggaaaagaataaagtttaaaatcctagattagtgtctgcgggtgttggtaaagctgaatggctcccacgttttggataatctcattcaatttttcttccatatttttccttgaatttgccactttctttctttcaaaagccaaggctctcaatatgtttggattctctgttaagttatgctgtttattcaatggaggcatgaattcaaatttgtccacataaatttgacctcctaatgctacacgttgttattggatttctgttgtttctcttttaagtggccctggttgtcttaaaacctgctcattccttcttcgagctgtcgccatcctctacaatgctggaaattcacaatcatgaatattatacagggagatacaataaaaatctatgtctttataatagagtcaacaggtataaaaagaaagttatttcaaataaaaagtttaatattctacatttcataattattgggaagctttgagagtcgatcccaggaatgctcttatcacattattcattgtggagaaaaagttcagtaaagtaaatatagtaattagagctcatgcaagaccatcagatggtaaaatatctaaattatctcactagaaggctgtttatagcaagggaaactaaaatatcattctaacaatgtatacataccatagagagaatgatattgagtctaaacctccaattaagtataggcattaaggatgcacatcattagaaatatgctgtgacttttgtttcagccaattatagaaggaagttagagctaagaatttcttgaaaggtgattttagatgtgagtgaagaggaaaagacaggaaataaagctatcatttattttttgtcttaggacaacactgaatatttgtcagaagcatctgctccttaaataacacaattgaataaaaattggcatctgaggtttgaaagttaatttcaaaggtttattataccacagggttcatatttagcagctgtcaatttgttatcgacaagtgtaataaaattcagcaaaacttgaaatcttcccttgccaaagagacagctgtttctgaatgttggagatttggggagtttttttttaaaccaacctctatttgaaaaagaccttacttttatttatcaaaaaagtcatttgatgataaaatattgatattctttaactgtgtttgtaaaaaaaatatatatttttaaatgtgggattttgttgttcttgctgattcaatatttgtagacagtgtttcaacctgggtaatgtggaccctccatgggatatctggcaatatctaaaagtgtttctgtttgtcacaactagatactattggcatctagtgtgcaaagaccagggatgctgctaaacattcaataaaatgcaggacagctcccacaacaaaggattatttggctcaacatgtaaattgtaacaaccttgagaaaatttgttttaaggaaactgatacaatggatttagattaaagattagtttgcatttacagactttctaaaccatggttttcacctggtggggagctgcaggcaggcaccggttgtgctttaagtaagtgttatttgaacaacagagtaaaactccttagctcgaaattatagcaagtacattcgcactgatgtaattaagtttgtgtcagttacactgaatatatttctatgtacaacattttgtaactgtgctataaaaataaatctgtaaaaagttcgacaggaagtttctttaggtagtaattgttttctacagatgcattagctaatattctacacagactccataattcatattaaacaaaaaacttgaatattgttttagtcctaccttttaccccattattttctcaacttgacaatactaataagcaaatctatattttcaaacaatatctctagatcacacattccttaaataattattttaagtatgctacataaccaaaacagacattttcagggccgaaataaggaccagggatccacattttgttgaatgtctactcagtcattgagaaaagtactttttatttaatatcaatttacttcaataaaaatgtcacctaacatgtaaaaatacttaaagagagagtactatttaacccatgaaaaataaaagaacagaatgagacagctgcaaaatcaaatgtatttaggtgttttagctaaaagtatacattattccaataaaattaccttttgcaaataatattactaagaagaaatttaaagaaaacatactccactatcataatggtgattttcatttaaattagaaacacatttcaaaattcatgaccttggaaactctcatttcatttgagcctccagagtagtgtgctgtctctctctgtctctctgtctctctcaatcttttaatttaacaaatacttatatagcatttacaatatacttgataattgtagaaatattttacaagtattaactcctgatgaccctataatgtaggcacacatattatcgacattttgctaacagtggaaccgagtcatgcagggattaagtaattggccaaggtcccatagctagtaagtgacagaggtaggatttgaattaaggaagtctggttccaaaagccttcctctttagcgccacgtaggtggcctcccctcttcattacatagtattacaccttttatttatctcaaacttgcccaggtagtgtgaccttggaggagacatatgtgaaaggtttcaagtcaagtcaaagcctgtgggaaagtgatggggagaatgagagaaactgaatgatctcaccagctaatccatccatggagatgctttgttcagaaatctcttagaattagaagtacaaacatagttagatctgagttgaatgcatctgatctataacttccatttgtttatggcacacattttatatcactgacaatttcttttttctctacaaggagaggcagtatagaatggtgtttaagagcacaaactcaggagttaaatctcctgggttccgtttccagatttaacttgctattaccatatttgtattgtatctcttgaatggtgaacagagaaaatatgatgtagtcaagaagttctctccttcctgagcacactgtcagattacacttccccacttcttcctaagtggggccatgtcattagttttcaccaataatgtaagagtagaaataaatgcatgatacctgaagcctcagatgcattgagagccagtgtactttgtctttgctcttgttcctgccttgtctagcatctggatgcagaagatctggatgcagtgaaagactcaaaggcctaaatgatggtggagtcacaatatgggaggagtctgcatccttgaatcatcacagggattaaagcctccaccctgatactgaactatatttgactgtacaataaacatttataataactcactgaaattttgcattatttcttacaacaactagcttttattatactactatgactgcacatcattcatgtgagcaaaatggtcactcttttaaacttcaaattaccttggtttaaaatagttttactcagtgtgtgttcctcttcaaaagagctttgataagcctcattacctataaatatttttctgtatagttccaaatgttaaaataacttagtagagatgcagatatttatagcagttaaatactgatttataaaaccacacaatactagtacaattgatggaaaaactcataaactaagtaaaatatattgaaactatctgccagaaaacctgcattttccatgatttgaatgggccacttcaatgaacagaacaaataaaatggctcttgtggccataactctcacaaagaaaattatttctgataacaataccatccttttctgtaaatgtatactacgctcaactaacaagggaatctttactttgctacatcattaccaaattggtaaataaatctaagtcttcatgtcaacatttcaagaagggctccctaaagcttgtaaattgtcaaagatatcagattttaaaggatatgaacctcttaaaaagtacttggatgaaatgttatgttcagaatctcaaatatgaattcattgtgttcttgtcagaagttacatcatcagggtcctgagctggtgctggttcagtcccaaggaaaagaggaaacttgtgtattactcagccctggcagatgagtagattcttctataaccttttcatcaccaaatgtctcaacgaatttaaaaactaaagattatttcttgatttggccaggttccttgtaatcttgacagtaagaagctcagaaaaatttcctttgctgtgcatcatgtatgctttactcaaaggccgaaaagacatagaatgcttcttctgaactttcatttaaccagcggaatttgtgagggtataatattcatatattttattgaggagatataagcaatatctcttaacatgtagtttttaattgactattaagatacacaatcttttaaaaatttcaaaatgactcaacccaaattatttagaatatgatttatttcaaaacatttttaaaattccttccttccacaattgtttattttgtctatccagttttgtaataaatgctatatatataaagatggttcctggcattaaacaacatctgcaaaacagtgagcaagaacaagatatttctagaggtaagtaaggtccactaaaacaacataaaatcatagttaataacatcataaagtcaatggctgattctatgttttaaaatcagacaaacaaaccaataaagatcacacctaaaacatgtgcaactgtatagcataaaggagttcagaatgagactcaaccaaattattgcgatcatgaatattacacatcctgagaaacaggaactgtcatagcagtcttgaccacatgttcacatactcaagttggataaaaggaaaagtccaaaatcttggcacaccaaggtaaaaaggtggatatatatttaattaacatttaaaacaaattttcccatttctccacaaagagctcattttttaaatcttaaggtttagtgaagaagagatttcaagcccactgcaaaatgaataacattcttttattatgctgttgatctccaaatatgcaaatgcctttttctttaaaaaaaatagtggtagtttgaaatcaggtagcatgatgcctccagctttgttctttttgtttagggttgtcttggctataaggagctcttttttggatccatataaaatttaaagcagagtttttttctaattctgtgaagaaagtcaatggtagcttcatggggatggcattgaatctatacattaccttgggcagtatggccattttcgcaatattgattcttcttatccatgagcatggttccatttgtgtcctctcttatttccttgagcagtggtttgtagttttccttgaagaggtccttcacatcccttgtaagttggattcctaggtattttattctctttgtggcaattgtgaatgggagttcactcatgatttggcactttgtttgtctattgctggtgtattagaatgcttgtgatttttgcacattgattttgtatcctgagactttgctgaagttgcttattaaggagattttgagctgagatgatggggttttctaaatatacaaacatgtcatctgcaaacagagaaaatttgacttcctctcttcctatttgaataccctatgtttctttctcttgcctgactgccctggccagaagttccaacactatattgaataagagtacaaggctacagtaacaaaaccagcttgatactgataccaaaacagatatatagaccaatggaacagaatggaggcctcagaaataacaccgcacatctacaaccatttgatctttgacaaacctgacaaaaacaagcaacggggaaaggattccctatttagtaaatggtgttgggaaaactggctagccatatgcagaaaactgaaactggatcccttccttataccttatacaaaaattaactcaagatggattaaagactgaaatgtaagacctaaaaccataaaaaccctacaagaaaacctaggcaacaccattcaggacataagcatgggcaaaaacttcataactaaaacactaaaagcaatggcaacaaatgccaaaattgacaaatgggatctaattaaactaaacagcttctgcatagcaaaataaactatcattagagtgaataggtaacctacagaatgggagaaaatttttgcaagctatccagctgacaaatagctaatatccagaatctacaaggaacttaaacaaatttacaagaaaaaaaaaacatcaaaaagtggatgaagaatatgaacagacacttctcaaaagaaggtatttatgtggccaacaaacatattttaaaaagctcatcatcactggtcattagaaaaatgcaaatcaacaccacaatgagataccatctcatgccagtcagaacagagatcattgaaaagtcagcaaacaacagatgctggagaggatgtggagaaataggatcgctcttaaactgtttttgggagtgtaaattagttcaaccattgtggaagacagtgtggcgattcctcaaggatctagagccagaaatatcatttgacccagcaatcccattactgggtatatacccaaaggattataaatcattctactataaagacacatgcacacgtatgtttattgcagcactgttcacaatagcaaagacttggaaccaacccaaatgatcatcaatgatagagtggataaagaaaatgtggcacatatacacaatggaatactatgaagtcataaaaagaattacttcatgtcctttccagggacatggatggagctggaaaccatcattctcaggaaactaacacagggacagaaaaccaaacactccgtgttctcactcataagtgggagttgaacaatgagaacacatggacacagggaggggaatatcacacacctgagcctgctgggggttggggggtaggggagggatagcattaggaaaaatacctaatgtagatgacaggttaatgggtgcagcaaaccaccatggcacacgtatacttatgtaacaaacctgcatgttctgcacatgtatccaagaacttaaagtataataattaaaaaagtggtaaaataaaatgaaaatcaaagtatttcttagctagtatatttcatattatgtgtaaggccatagcaaaataaatcagtatatcttggtggcaaatgatcaattgacaaagccttctagaatgagtcatctcaaaactggtaagaaggaagtcactcagtataagcagaaagggaatatggatttgacagagtattcaaactacaccgaagcttaaacaccactttactgttcattttatatacaatagatctgaactctaagaggcctgcaatcatttaaagttattgaattagtttatcaatagattttaagcattaatttggttgagtctcattctgaactccttcatgctatacagtttgcacatggatgatactcagatgaagtattctgattgacttttctacatttcacaaatcaaactcaaacaatatacaatcatcttgaatgaagtggtatgagattagtagcaaaaggctgaaagaatcagaaatgagttctaatactatgtcattgataaacaatggacattttaacttcaggatactaattttgaaaatggagacactacattctgttcaactattgggactataaagaaactagagtaagatcatgaaaatggtaaatatcataagttattatctccaattatcacaggaaagtttgcaattaaataccattttccttaaaagagtaagaatatatttcaactatgaaaagtttttttctatatatgtatttttttcttaaagtggaggtacaattacactacataaattagttgagaatgccacaccaaatattgtatatgcttttctcagggatgcataaaagtttattcttgggtgtgttctaacttcaaagagaattttgtctgaaatatatgggacatttttacatctcaagcatataggcaatcatcataaaaaagttatttagtttctagtattaactaaggctttatttgatagcttaatgatctttaaaataaaaacaaaacattgccattttctgttgatttagcctctcttctatgaaagtctccaagccccattatcacaccttctaactttttttttcttttttttttttttttgagacagagtttcactcttgttgcctaggctggagtgcaatggcgtgatcttggctcatggcaacctccacctcccaagttcaagcgattctcctgcctcagccttctgagtagctgggattacaggcatgcgccaccatggccggctaattttgtatttttagtagagacggggttttttccatgttggtcaggctggtctcaaactcccgactgcaggtgatccacctgccttggcctcacaaagtgctgggattacaggcatgagccaccacacccggcctacacctcctaacattttaaagtgttaacacaattcttttatttacaaaccttttattttgaaatacagaatcacagaaagttgtgaaaatgtaccagaaattcttgtgtgtccttcactcagtttctttctttgagacggagtctcactctgtggcccaggctggagtgcactggcgtgatctcagctcactataacctccgcctcccaggttcaagcttttctcctacctcagcctcctaggtagctgggattacaggcacatgccatcatgctcagctaattgttttttgttttttttttttttagtagagacggggtttcactatgttggccaggctgatctctaactcctgacctcaaatgatccacctgcctcagcctcccaaagttttgggaacacaggtgtgagccaccatgaccggcaatttcttacaatgataatatcctgtctagctatagtacaatatctaaattaggaaattgactttggtctagagattattccgacttcactggttttatatgtactcatttgtgtgtttgtatagttataggtagttttatcatatgtgtagatatatgtggccaccaccacagttaaaatacagaactgattccatcatcataaggatccctcttgctacctctctttggcttacacaacccctctccccactccatccttgagacttgtcaaatcaataatctattctccatctctataattttgccatttcaagaatgtcttctaactggaatcatatttatgtaacttcttctgttggactttttcattcagcatagttcccctgagatccatctaagttgttgtgtgtatcaatagtttattcctttttattgttgcatagtattccatggcataccatgtaatatgttatacactgtgcataacacattttaatacatgtattaacttaatacagtgttattaactctggaaacaaatttttgtttgtgtttcttcaaacatacagcttctaaaactgaaaatattggctaggaagacatatctaaattataaagaaccaattgttcatatgctatataaaaatgtttggagtaagagggcatactttcataaagtttttttttaagtcctaaaaagaggattttatctaaaatagaatgcagcttctaagttctaaaaatattatatatcctattgagtagctcagtttgtagctggaagaattgtgcctgtatcccagaaggtcttataaataatttattcaatttcagtatttaatttaattcatttacaaatgagatgaggttagattattcagtgtaataagaaatctgttagagaaaatagtatttttcatagttgattattatagtatcattttctttaaagcatgaaatgcatcttttaaaatattgattagagactataatgtaactttgctgtaattacaatacttgtcttccagatacgtcctgaaaatagttggattaaacaaattagtgaacatccattcaataaaatactatgtagcaatttataatgatgataaagatatacaatttaatgacatggggatatattccttagatgttagtaatttgcatagcaggttacaaaatagtttacataatataattatatttttgtaaaatgatacctatatatccacacaggcatacaaatcggaagaatatatacttttttttggggggggcggtgggggacagagtcctgccctgtcacccaggctagagtgtagtggtgcaatctctgctcactgcaacctcctcctcccaggttcaaatgattcttgtgcctcagcctcctgagtagctgggattacagacatgcaccaccactcccggctaatttttttgtattttttagtagagacaaggtttcgccatgttggccagactggtctcaaaatcttggcctcaagtcatccgctcccatcggcaggctgggattagaggtgctgggattacaggcgtgagccacccgccccacaggaagaatacgtaataattgtgtagtaaaatacatatttttaaaggggcattctgggctactgttgtgtatattactctttaaaccctttaaaatagtcttgaactcaatctgacaagattactgttctcatgtaagaacaatattttccttttactacagggtcaatattcttgcacaatagtattgcattcctttacttattcagctgtacctaattagttaacaagttcactttaattattttcataaaaataattccatttttgatgatccttccatatcctcatcatcaataaaagcagcagtcacatagcactgattaaagaaattacttcaaaattaaaactacaaaaataaaggcttcaatatcatagtttctctaaatgtatcaaattcagctgttaaatatatttagagcctacgagtgttctggtattgtcccactcacatcttatgatttctttttcctttactttttaccaaacaaagctgctgtgttatcatttaggcatttataatttattcctgcttcttattttacaacaactttcagtgatatttataaactgtggcatattagtgattgatattatgtataaccttgggtagacttctggcagggcttctcttctgctctctctcctgtcactactggcagcatatacaaattgttaaattgccctgagtaaagctttattgtgccactaatatctaattttcttttgaattaaaaactacctttcatatattaagcatcaggattagtacttcaaagatacccattataaaatttctcaattaataagatactcatagaaaaatggggtcaattattggcataattatattcttttaatattttatatccattaccattctgtggtcacaaaactatctcaaggacatactgtcttttaatttggaaaaaaaaaagttgagcaatttgaaagtggttgtatgaactacttacagaaaacaaacgtgaatcctacactgttgataatgactattacactactattactccttacagtaacagctaatgcttgtgtagtagtaattaccatcaattaccatctatctgttatgtaatttaactccttttgtcttaactacaaccctatgagttaagtgacttgcccaccaatttactggcttaccctttggtcatcagataggggaactacaactcagacccaggtggtctggttctgattacataatggtaaaatggttattacagaaatttatctgaatatggactactttgtgactaatattcacttgaattttgtgtccccaatgcttccttcatattcaatcttacccgtgcctatactaatcatcaacagtttagcttgagagctgcagcagttgactagttttccaacagctaaacagaagattctggctatttatatgagcattctcttaatgctttactatattatgaactgaccctaagggctaaatattatttacaaatccaagaatacaaattcataaattctagctatttttatgccaacgtggactgccaatttgctttgaattatattaaaagttcaaaaactttaaagttctttacccccccgattccccaacttcaaaacgtattagctgttacaattcatacatggactagcattctaaagatgtgacagttccctttgaaagataatgtttggaagtctcaagacttgaattccagtgtcatctttgctctatgatgctggataagttacttaaactctctgggttttatttaattcctctggaaatttaaacataatttttatgagaatggacttttctaagatatttttacaagaatctaagatgaattagagattcacttaatgatgactgtctgaaggaacatgcatgaactggtctaatttaaagagatttctttgagtgatctgtcatttttctctcctctttgttcaaattaaagaacaacaacagataacgttaagtatttttatacttcctaaaaacaactttaactgacagagtgaaaggtataaaacttcaccctgtaataaatttgaggccatctttagacagaacaaaattaatacggccctgtagatgaaagatttacacagatcgattttctgtgcccattgacagagcaactggataatctgtggtagtcttttacacttgagcagttaaaacctcagatatatcctggactgaagattggtcagcagttcttttctggtccatgaataattaaaatcattcttattctgtattctataaatatgcagagaatgcaagatttgaaccatatacattccgctggagaagctgcttgggtccaagcgaacctcatcagcgatcacttcaaagatcaattcttcatgtccacagcatcatgtttaaatgattgtgtgtgatccagctgcttcttgtctccttgttgcttcatgcatgatctttactcatgatctcacaaactatagtgcttcagtagtaattctgcattttgtgctaaattttaacagtgattgccattttataggctaataggctgttgttgtgcatatttattataacacttttttcttttcctatcaataacagtgctttgcttagataatgagaagcaataatctctttaaaatatttacaagtctattcatcatgggaaaaaataatcttacaaagacagccttctccactggcattgcttttgattgtcactctcctccctcttcccaagacaggcatttccataattgcatcttatctttttgtatagactgagaaactggcaataactatgcctgggcaactgttttttgaggaaacacacaaatactacctgataatgtgattatatgcaatgatctaacttgctcttacttttaggactattaataatattaatgattttaaaatataatattatcatagtttcttattctgattgtagagtgagaagaaagaaatgtaaaggtagaatataataatagtaatattgtctgtacttaattccttggatggcctttcttttttggtttgttttattttttattttttaattttattttaagttctggggtacatgcacaggatgtgcaggtttgttacatatgtaaacgtgtgccatggtgatttgctgcacctatcaacctatcaactaggtattaggcccaacatgcataaactatttttcctgatggtctccctacccctgaccacccccacaggtctcagggtgtgttgttccactccctatgtccatctgctgtcattgttcagctcccacttataagtgcatgttcttagatatactctcttactaatctgtgtagggtagattcactccctgaagtcactcatggggttctaatttctatagctgagaaatgccttttagatgcccttgttctatcatacaaaaacactgttacttattagaattccagaaaagtttcctaaacaccatcaaaaattgtatggcaaagaacatgtttgtacctcatcaaattttatttatgttttgattatctaatgtgctagtcatgtttgtgactttccacacgaaatgatttcccatgttttctttctaccatgcaccatccttatcattaaggaacacaaatacatttaatatcaatgcaatcagtgtagaagtgaggcaatatgacacagtataaaacaggcagatatacagttatatatttatcaacatgtcccatagataacatatatctatattccttcaactaaaaagatttgtttaatattgccatttattatcccatatttctattttaaaatgttttgcagccataaaaacaaatgagatcatgtcttttgcaggaatatggatggagctagaggccatttttctcagcaaactaatgcaggaacagaaaaccaaatactgcatgttctcacttattagtgggagctaaatgatgagaacttacgaacacaaagaaggaaacaacagacactgagatctatttgagggtggagggtgggaggaaggagtggagaaaaaagacaactgtcgggtactgggcttaacagcttggtgattaaatgatctgtccaagaaacccccatggcttgagcttacctatgtaacaaatcttcacatgtacccccaaacctaaaataaaagtttaaaaatatatcaaatgttgggataatatggacagagtctcctagcaaactttttttcagaaaattatagtccactttttgatgacggtgatttcaaaggaaactatacttgagttcagctgccaaatctttgtttttttttagatgcataacagttcaagtaccattctctcttattttgtcacctgggaaagaggtcaaaagcacagtgggacactttacggggaacctgagagtctaagaaccattcttacatgccattagcatatcaattgatcatgaacatttaaatttggtagttttaggaacttagtttccttttcctaaaatgaagactttggattagtctctgaagcaactttctgctcgaaatgttgatgaatccgaatcaccttttcattcacttgaaatgtaatgacgtttttgatgtctacgttacagagattgaagtaacgcatctttccccttttacactattatattttgtgatgttttgctttaaaaagttttattttttattaatcttcaaatttcatatttttatccttgataacttccttctagagatgaggccagtgataagcagtatcttaattctcttctgtaagtattttttccttttgcatatgttctcccattcagtacagatatcaatttagctatttctttattccagacacaattctcctctgagattttcatcaataaataaagagacatgctaatatcacagctacttgacacctaccaaaaccctcattaactagtggactacaacataagagaatgaacatattttttaaaggccttattgcaagtcaagtcacaaagttaatacttccacatgtatttgccactcttttccttcaacagaaaaagaaattccagttggttgtaaagtcaaatctcttgtcttttcagtttaaccagctgcactctaagtctcaagacaactccctccttattctatgtttaattgactaccttccctatgccattatccatctgcatctttatgaacataatcaaacctccaacccttcagatcatctgtggggcattgctatcaccaaatagcaatttaatgctgagctttatctttcctggggattttataaagccttgaaagaataaagaatctagcagttggcacactcacttgcatgcaaacttagattgttaggaaaagaaaaaaacatttagataattaaataggatcatttaatagttcactcatttcataggatgagtgaggcaccaggggaaaagtggattgtttgagataacacagctagccatgatcccatgtaggagaataagactgctctaatatttcactctagcaccatccctattacatcacacaacttcccacacttccttcgtattttcccatgataaattataccttctgatttttccccaacctctcgaatgcccataatgtaactgaagaaatatagttccttaaaagtagctatggtttctaaaggcaactcaatgatttttaaaatacaatacaaattgttttttaagtgtttgttttgctttccagcttcaagcagaaccatcgatgtgacaaccgaagacaccaaagaagcagtcctttattattcaagatgtcattaaagtgcagggatcctaaaaccccattctagattatcccttagtatggatcaggctaaaatatttgcttcatgtgaggccctaggtcttgaatattgcatggtttcttgtactctgcaaatttcttctgaagaacccccttgggtgagtgactgttgtcagtatttatattaatgaacttttggagcacaggtatatctccaaagaggaaaggcctaattttgtccccagagctacaaaggtgtatggcatggctgacactccccagtagctgcccaaggatagcatggtggcagatgcattatcagaacaaaaagccaagagtgcccagagctgaggacctgatcaagtgaaacaatcagtcctctctgtgctactttgcaaatggttcatatacttttcaattagcacctgtcatctggatgcaccaattttcgcagaaatattttgaaaggacaattttatttcacgttagctggatgaaaataaaaccaaattccttctagtcagaaatatgtttggaaagattgaatccaaaggttcatatatccatcattggctccagatttcattataatgactgcaggtcaaggattcctgcaaagattttttaaaaaaatagtattttagaaatcatattttgaaaccaggtttgcttctgtttagttaactcccagagaaatatactgtttttggaactcccaaccccaccccaccaaaatataatttgcttttaagaatgtaaaaggattatggtttacacaagaaactaaaacaaatataagaagaaagtgcatgtatgccaaagtaatcgctctctctcttactcattctctctttcttatacacacacacacacacacacacacacacacatgcacactgacattaataagtcagtaatgagtatattagtgtctctatttaagttttctggtggaaaccaaactcttaatgctattttaatgaaggatttgtcagtgaattgtttccaagagtggtaagggagcatgcaatcacatttttataatgtttggcatcattttggggtgtaggaacaagcagattaactaactgaatgatacaaaatggtccactcctcttttcttaaaaagacacattgctccctgcaaggctgcatgaaatacaatttattctttttggacaatttcataaaacaaaagtggaaaattcatcctagaaaatcagatatatagaacactacaattttattactatttctggacaaattttcctaacatccttgcagccttctattatgattcacaatgtctgcaatgagagattagatgacagagtaacctattaaggaacagttactatgctgctggatgcagctaataattcctttatttttcatttttattactttatagtttatgaatgtacaatctactcattacctattataaatattttgattcagcaatggaaatatacaccagtaaacaaaacctacttgaagctttatgtattacatacccacccataaatgtatatcatagcatttgctgcctactagacttatttcttgagaatctagatgaactcttaatcttagctgtaataactacctgcaaacttagtatcatctctgctgctttcactgttttatctactgtctggagtcataattaattggcctcattactgtttctactatgaaatacagtcttctaagacattaatattttatcagagatactagtcttgacctaaaacagagaagaataaaaacataattgtgagttggaaatttttttaacaataacataaaataatcgatgttttggcaagaattatgacaaggctgcagatagcgacacacagctcactgagtgtaaatggagagaactaaacaggctctcattggtgtaacccttctaaaactctctagctaacattcatgccaaaacatccaatatatcaaagactttgtagcaatctggaataaaatcatttggtttcctctagactgtttctgcaagaagtaaatataacccagatacaatgaatgaaatgaaattttagtgcactgagttatggttttcaaaagtaagagcaactttagaacactaaatttaaagtcattcctaagaaccttctggaacctatgaaaattgtattaggttggcaaaaccttctctcgtcttcctatttctttttttcatttttcttgttctttttatcagtcaatactaaataagaatgtgctgcccaaaaagtgaagctataaatcgacttctgaaaagcttccctttttctccatgggtctctatttcattaggtcttcttttattttacttctgttgcccactgtttaatttctgaggccagtattttaatatcctttcaagtattgttttcaagatgtattgtgtagcagatcagtaaacaaatagttatttgcctcttactctatccaaggcaccgtactaaatgctatgcagaggtgaaaagtatgcttactgctatgcaataaattacaatctaatgaggagcataaaaaacacaataataataaaatagttcaagtgattttcaaccttggttgaacgacggaatcacacatagagttctaaaaagacttgacactaagaccttacctcaaaatccattaaactagaaactactgttgtcaatgtttaaaaactgaatgatagggacaatagtatggttaggatccagtggaagatgttctaaatgagtactcgttgtaaatagcacatcaagtgtccctcaagggcaaggatccagtggagctttaaatctacgtaacatgagggaaagtaatgcattagtactgttctaaagttattcatggaattctctcttctgatagcttattatcttctgagttcatagtagatattccatatctcaatgaactggttttattaggaaaagaaggtgtactggttatctgttgctgaataataaattaccacaaaactaaatggcttaaaacaaccatacacacgcattatcctcactgtttttaagagttagtaattcaggggtacttaactaagcagttcaagctcatggtctcatgtgattgtcaccaagtttctgaccctggctatagacagccaaaggcttgagtagggctggaacattagcttccaaggtagtgcacttacagagctagcatcacattgttcttagtccattggttttgtatttctccttttccttacctgtatttaaaagttttccttaagttctattttccccactgtgatacctaggactatcaagtctacttttattcaatacattgttactgagtatctctcctaatcaagacattatgccttctgtctttccaagcttgaatacatcacaagttaaagggggaaacacatttgttcacatgcagctactatgcctactgtactgttttaatttaccataatggacaccacaaacaaagggctacagcaaacgaaaggaggaatgattagttacacaggagtggtgtataggaagaattaaaaaagtaagctggggctgggcgcggtggctcacgcctgtaatcccgccacttttggaggcagaggcaggaggatcacaaggtcaggagatcgaggccaccctggctaacacggtgaaaccccgtctctactaaaaatacaaaaaattagccgggtgtggtgctgggcacctgtagtcccagctactcgggagactaaggcaggagaattgcttgaacatgggaggtggagcttgcagtgagctgagatcatgctactacattccagcctgggcaacagagtgagaatccatctcacaaaaacaaaacaaaacaaaaaaaaaggaggcaatggacttgagcagtaatgataaatttgagttttgagaggcaagaaaaggaactattgacttaagcctcttttctgggaccactggtactttgttatcctgcctgacacttatagcaaaattaacatatgtctaggctaaataaacatattaaggaggagatgatatatgaatataaagtatattaggggaggcagaccaaatagcttcaacatttatagtaaaacaaaatacaacatcattggtagcaagtgagagaggagggtttgaaaattcttaagatgtgaaaatgcatgaattttacttggaactgatccacatttttttttgtttagacttttaaaataactctatagcaacattcaataacttgggattgtactggaaaaagtaaacagtgaaagggacacagaccagaaaattaaaaatggctagatgtcaatgggagaagaaattgaaggtcccagagagggcagcctggaaaacggtaaaaaagatctcctgaagtctgagagggtataatgaatggcaaaactgtgaagagcctggagaatcaaggtcgtactgcaggtgaagagctagcaaacctattgccaggtcttctgataactgaattaaagtcataattcagttcttggggtcaaagattgaaaactcagtatctttttagcctgaagtcaaagaggaatagctattttcctcaagttttacaaagctaacaacagcaaggtacattggtctaactttttcttaacaacctagtgtaggaaacaaactctgaaaaaccaacagtcaaatgagctctacagtttgtgacatgggtctttacattcttgaatgtgtttctgttattgctgaaccttatttttgtacaagggtccatgtttgaagcatttgaaagatttgaaatgttggaattccatttttagctgacttttttatatactgagttttctaggcattactttggacaacaggttaatgcttgccttgctctctttggatgctgtctactccacacaggtataatcatacatacatttctatctagacatcatgaagattccacttctgattcacaagagctatcacaatgttgtacaagtccatattcttaggataaaaaggttaactctgtgtctcagctttgtgggcagaagaaaagagaagacatatgccctattatttgtgttatattacatgcattatattttcgaaatggcatttcaaagaaatagctacaaaatcaatagttcttttcttcttcatttttttcttagagctgaaaactgttcaacagctttatcgtattaaattaggctttcttaatcttaagcagtgactgggtgagttttcctggggaaaaacaattctgaattccacagtgtttaggaaataatacaatccaaatctgagagaaaaatttaacgccaatactgtgtaaatatttcacaaaatatttgttctcaaatattcaactttctatgtatacattatacagttttgactcaaagatcactaaaatgaacctaaaataaacccaccatggaatagtaacttccaataatcagtctttcgccttaagtgaataaggatcacaataacataaaatgcagaggctataaagtaaaaagcagcactcaaattgtagagctgggataatacaactaggtgaagttaaaatttgaaagaaataaatgggttggttttgagtgatggtactgcccatgattttttactttaaattttttgtcactattaacaaaaaataaagttatttgaaataaaaatataagaaataccgtgtgtgtgtgtgtgtgtgtgtgtgtgtgtgtatgtttgtatgtaagacatagaggaaaagacctaaaagatacaaaatgctaccttccaattcaactgtagctattggctctgtcagttttagccttccaagttgtttatttccatgagctcagacaaattataccactgactcatgtgctgctccctgggtgcagtgagaatattaacctttagaaggggccttaaaaatgagaagtgttatatgaattgatattttagttgtgtgttgtgtataaacttttctggatatggcttgccatttggttgggtgcttatttttggccactcaatgtgcataccaatgtgtgtgacttcatatatgggaataaatgttggcatttggattatttttggccaaagagtgggtgagaaattagacacactcaggagccaaaaataaccaaatggcaagccaattacataaatgttttctggcataccaaaaaaaatctggattagttatcataaaacaagagttttagttccagttattattactattactactactattacttctggtgttattcctactaaagccactaatctctattagacacttatgcttgttaaatttataaagtttaacatgaatcattccatttacaccaaacactaatcctatatatgaagtgaatatcagtactataaatacatggatatcagtcccacacaaagacaagaaaaattatgcttagaaaggttaagcatcttagtagagtcacacacaaataagtgacagagttgatgagaacccagacatactgaaattaagaatcagacaattcatctgcatggaaattctgctactaatatatcatgtggccttgagcactcatgaaaaactttgcattttagttttatcatctgaaaaatgaaaatgagtatatgtgctgtagaacatgagtgtaagtgctataaaagtagaaactgatggaatgtgtaaagtggatgattactgaaatattttccctttcctataaacctaatagatcatttattcttgcatctgagaaaaaaatactaatgatcaacagaagactacatgaaggcagtaactctaatattttcacggtattcttcaaagtttgaatatacattatagttcatttgaattctttcaagaatgccaagaaataggaccttcaaagtgcaacatacggaatatatgttataaaattctatgttgtataagtcacacagatgtggagaatggaagaaaactggacatcaagcagctaagcactttccacacaaaatcttgtacatgattgcttataatagcattactcatgattaccaaaaggtggaaataacccaaatatccatgaattgatgaatggataaataattgcagtatattcatacaatggaatattattcagtatttaaaataaatgaaatactgatacatgttacaacatggatgaaccttgaaaacactatacaaatgaaaaaagcctagtcacaaaagatcacgtattatattattctatttatatgacatgtccagaattagcaaaggaatatggagaaaaagtagtagttgtctagggcttgggagaaggagagagaagggatgtctttcagggggttccaaatttgattatggtgatggttgcacaactccgtgaatatactaaaaatcattaaattgtacacattgagtaaatcacattgtgtatgaattatatcctcataaaacaaatgaaaagttcaccaccacctcccaaagaaatactagaaaacttatttatttgcaaaattttcaactgcaaaaattatatgtgtgaattcattaaacacttatacagtacaataagttatacatgcatacacacaaatacacacacacacacacacacacacacacacacacaacaatttttttcctaactagacattttgaaaaccagttttaggacaggttgttgtaaacaaaagtattcacgaggtggtcagaccaatttgaaattatccaattggcattttcaccatgtctcatgcaaatgtatgtcagaagataataagatctcagaggacatttttttctttctagtcagctgcatctacccaggcttaatttcaatctattgctcctcattatatccctttggagagcctaattccattccccacttgatggccataccctctgtctaaacctgagcatcagtataccacatcctctgcagtaatcacacctcgggacagcacattaaaaattacctggaactcccaaggagctgacattatggaccctcaggttgacaatctgaaacaatgtctggaaggttttgttttgttttgttttcagctttgctctactattgaagtaatgtttgaaaacgtcatttgttaaaatgttaacaaagcaaagttatatataacatatatagtatatatttaattacatatgcaaatgtaatatatattttatttattatgaattacacaaacaatgtgtgtgtatatacacacacacacagaaatgggcagtacacacacacacacacacacacatacatatacacacacatacaaacccagtgaatccgaatctgagtactgcccattttaatatcatgtcataatattgaaattaatatactaagtgtacattaggttaaaaacagctgctcttctagcactcttcttcaagaaaaaatacatagaagaaattcataaaagtatgttagatgctaaaatctaaaattcagcagggacttaccgatggggtataaacaagattaatcaatacgatgtgctagatttcaggagaggtaagacacattcaccaaactatcttcacattttatctacctgatttaaaatacaaaatctttccatgttagaacaggtgtatgaatttactaagagtataagtagaaactgctattaaattgctgtggaaatacttttcatatttacctaccttgtcacaagatgaattttttaaaagaatacctctgtaactcacctcttgaataatcccttgtggtcacaatggaaaaaatatttttttattttgatacttactgatacatgttatgccttattatagtaacttaatatatacaattaagaaatatatatttatatatcttccccttaatcttcttaaaggaatttggtattattaatctactcttaccaataaggaaacagaaggttgcagatgttagataatttgcttatgattccgtagctactatgtgacggaacttgactttgaatcaaatattatacttcaaaggccatctatgttctttcaagcatagcagttgcctccacaaaagcattctgatcattgaagagtctaaactcaagaaacaaaatatgatcggctttagttcttctaataattgttctaatccatactattctgaatcagctatcatttgggaaagttctcttaatatcttggcccaaagtttacagctttttggccatttcaaatctcttccctgctattcagtaccacaagttagggcctttgttgtttccatgtagagtaggagggacacaagcctaggttggtatatggtttgaagacctgcttttcccctttcttctaggcccagcctcttcttagcccttgggtgaagaagaggagaaaaaggcaaaccttcccttcctggacttggtgagctgctgtgctccactagttagttgtggctggcttacagcctgcaacggttggcaggagaacccactgtctggtgtccaaatgatggtgttctgaaatgcactgctcatttccctccagtggaagactgaatttccactcaaccacttttgcaccttctcagccagtaactcacactaccagggtaccctcatccagtgggcagacctcttatgtactagcacaatgaactcatgcccagcaactttctgagatgtccaatgtatcaatgagagatacagacatcttcatctcacaaacagtgagtgtacaggttactgcaatgctgctacccttttgtcagccctttactgaccaagcaggtatcaaatgaaggaaatacagttccggtctccctcctctgaccattcttgcaaatctttgtaaatctttctcacagggtatccctttccagttttgaaaaggggatatagcttttcttccagcatatgacattcactaaaatgctatttgctccatttctcggattattttgatttagagaggaggtggtggtggagggtcttggctcctgtccatgagcctgcaggggctgtactccaccctgcttcccagaagctcttagaaaatgcaggtcctgaatatccactgtcctcagtttggggtctgagctaacattcagggacaacaagcaaaagctcatcccatttaattacacttgaaaataacacgagtcctttaagttgtagcccaaattttaaaaaatcaagctatctttcaaaacgtgctaacattcttgcgttaacacatttgatgttaaaacatttgggtcttgttcattgtctctttgaataagctttaatagatatttctcacacaaactacatataatatagagactgtatgtaatttccatttcatatttgcagcaaatgtgacattttcctttattgcacacctcttatttcttcattctcaactctttgaactctgaaagcccaagccttaagtcaaaaaagtatgagaatccatgtccacactttaaaaaggaccaagaacacaaggttgtgaactactctaaacactgaaagaacaatttaagtatttctatagccttcacccctggagtactccacttctttgataaagtgactatttttgcaaaaagtctagtgaagttcatgagtttcacttctctcaggttgagagaatgagttaacttggactctagcgttcattataaacactagagatttaatatatggccaaatgccagagagtctaattcaaggcattaacataaaataataacagttaccatttatgcaatacttgtggtgcactagcactatgctaggcccttcacaggcctagtttcaggattacagtctaactccatgacgtgggtagtattggagccttcattttacaaacgagaagactgaggttgaggaattaagtagcccaaaactgtaaaggtggaaataattggggccaaaattcaagtttatcagttcaaaatagtttttgaaaatctaccatatccatggcataggtacttaaataaaacaaacaaaattataccctttgagaatttctatttggttctgtcacaacacagtgcctacattcttacaactaaagtatgtatgtaaataagacatgtttcaataaaaacatggaaaacatttaacagatatctgatttattttcattaaacaaataatagatataacttggtgttttcaaattatttacacttgttgcaataaaaaataaaatgagaaatgtcatagatttaaatctcagttgtacttaaagcctctgcaataattcactttgtaaccactgtatatatttattaatgaagtattaaaaaataattgtgctatactatatatgtactgttctatgtattaacgataatgctgtattagtgatcttattaatgctgtttatctctcaactctctaacagtatattttccattcaaaaccaaaattataattacttgggtaaatattatcatttacaggcaaataataagaatttgaagaaaatcaaaacagaattggtccagtcaagcccaggcaatgagacccaatcacaaattcgtgcataaacttttgcctaaagaatagccttgttttgttttctccttgtatccaatcttaaaagtgttttaatgaagatttgaatattaagaattcattataaaaataacaactcatcatcgcactgtgtttggtttattcaaaaaactctaaagttattaatttcagcttcctaattagaataatccaattttaatctactggcatttttggagatgaatggattggtggtgcattattctaaaagttaaatctcattaatatttaattgcacccacattcacaggtattaattagaagtgttttatgagtcatagctattattggaaaatcaggtacaattttataattagcataaaatgaactgtaattttgaataatcactgatagtgatcatttagtagaccttgtgagattattaaacttgttgatccatataataatttatatgtagactgcatatcaccattatagtgatacttttgagacaattaaaaataacattccctttcagccaagcaggaacacatatttcattgttgttttgactatgaataaaaaccctttctgctgaatacattttaaagcagtagtagaaaatagataatgtactagttatgaaattgaataaagcacaatcaaaactataattttattgatatttatatattattatatgtttatatcaagatctttcaaataaaagatatatttagcttttaaaaaataaaattactttcacatacataagacttgcactttgctcaaacacacactatttaagtggtttaatcaagtctaaataatggatagttactagaaattcccaaacaacaaaatgacacagtgatatataagttaagttctattaaagagaaagcttttgaataatctctatccatttttctggctttcataataaaatgtggacataccaaactgacttgaaaaaaatttaaaagtggccactagattcaagggaaactttattttaggagaaaacttgttgagggaagttcctcttataccttatgtaagaaagcccaatataagaattaaccataggaactgctgaaaaacctccccttaaatgggtagatgggttcagtgaaaaacacacatgcacacatacatatacacatatacatatgttatatttatatcattttgatatcatgcttagagtatctgtatcctaaatttaatagaacattgaaaataagaatccaaaatagtacttaataatcaactatttcttcttaagatgaaaatattcatagtccctaaaagatgattaaattcctatatcaacagactattaatttgaattataaaccttgtaattttcatattaaatgataataagacaaatataatatgcctgtgatttccattataacagcaaaagaaatgtgacgattcaataatcaaatattttcatatatactggagtctataaagcatttcatataggtaaacttgaatgaaacctaatattatatactaaatactaaggaaatatcgtcataatgaaggttaaagtttagagataactaaaaacaacagtatagtatattctgtaggcaaatgtttaatgtatcaattatacatattacactcttggttataaatactaaatatctcttagtcaaccagactccatttgatgtgtaataattttgcctcatcaagaagaagacagggtaaaaaaagaacaggaaatacgtgttcttcgttcatttaatacatataattgacaatttcaggaatatgctgtaatgtactctacacaaatcttgcatttcctttggctcattcatgggagcaaatcaatatgaattcctaatacatcttaagagctacactagacagaaaatttttgcttattggcaaactaaatccactatatattcactattaaagtttcctgtccttaaaactgtcccctcaggatttaatttaaaagcatgggattcactgaatatgaagtatatttttccaaatttataattgaaaaacaaagtttgtgagtcatcttttttcagttttaaattctactaacttctttataaatgtcacagaaactctcagaagtagaaaatcaacaagataagcagtttcatggtagtgaaaaaaatatgctttgaatttgcaaaaaaaaaaaaaaaatgggtttgcctagaaaagatatcaacactttaattccacagattatttcacccattaagttagcattccctcttcacctatatggctaatattaaaggcctgtgtgtgaccctacaacttaagtcttgtaagagcatcgatttgagtctggttttttttttctctcttctatacacagcctccaggaaagtccccaaacttagaagtttttgataaataactgttaactgaataaatggcaaagtttgtcatttatatgtttatttaaatctgtagcctcaaaattggtaaaagaagttgaaggtggtttgggacattacagttcctttatctgagtgaacgaggcagaggaggagcattcttaggaaacaaataaaccaaaaatattactcaggtcagcttgaaagaaaaaccaagggaaaggaataagatgcctttgtcaatcacacacagcccctttaacctttcacagtttgcttgcattatatgaaacttcaaggttaaatgcaagacaaatgtgaactgatatttctgcaagggtcaggtaggtaccagttgcaagtcattatgattgcaaagtggttcttcatcatgagaatttccaaactgcaagaatatgcctgcaggctttagtatgggaaacactcattaaagtagtaataaaaatatcacctttgaaattgtttcccagtttctaattcccctaagatgtgttctgtctttataattgctcatagaaattaacattggtaccatggcagacaggagctggttgttgtctttgacattaggagggtgctgcacattctggagatcccaagagctttaatttgagaaacagtggtcaagtgaacgaggtgagataatatctttattcattcaacaaatataaaatgaacatttacaataagctaggcacggttttaggtgctggatatacagaagtgaaccagacagacataataagttcctcacttatacagtttgcattctaatgatactttaaatattgaatacattttatagaatgaaggaataaaagctatgtgactaaggatataagaaaagacaggaaagaaaaaattgggatgaatatattgtttgtaaaaacaatggcactatggattgtatgtgaacttcagcttgtgaatttctgctataattgattttcctatacaacataatagaatgataagactgtataatggatctggaagtttcgttagtccaggcagccctctgatgcttaatctttccacactctacacaaaggaacttgtaatactcatgacctcttgaggtagcccattccatttctaacccaccgaaatttttaggtatttctagtcaattaattatcatgcctcctcgagtcattagctagtggttcaaagaatcttgtttggactcctaaccaagaattctaatcacttttaatttctttgatgattttataatttaacttggtttcaacttttttcatcaacttcttgttcaactctgaaggtattccatttaaaaagtgtgacaagcagagcactccacaaaccccagcagagtcaccactgcagctaagaggaattcaccacatccatctttctaaatattaatgcatcctaaaattgattagttttacttggcaacttcgtaaaactattgacttacattaagtttatgctgattactaaattgtaacagtttatttagttgttgtttattttgtgctttacttaaatgtgtccctcagttttagagttgtcagtcttatgttcttggatttgatacttcattctagcttgggatactcatattagtcataactttgattttcagcttatctacatactgagtaacaatatcttcttttattttaattcaagatattggataattttcatcaggccagggcaaggataaagccctgtaggaagaactagcaatctcactctgtgatcacaattcctgaacatatccagtaattgtccctaaatgggaaagtctttagcatacgtctttctctttttcaagtagattgcataaaatatgtatcagcaaatctctaatgctaaatattttcggttccttctaatccaatcagcaactctatattccatactttcagcatttaatgagtaaattaccaaataatttgggtcatttttgtccaggtagagactgatgtcaacattagtatgactaatgtaagcaacagaaacaatattaattccagcaggcacagaaaaaaatctactgcctagttataaaacagaattttaagataattcaaatatagtctgtattctagctactttcaactcttaaatagagagcttgacttctgatttttctaaggagtttactgataatttctctctagatttcatgcagaagtcataacatatcctacattttattttttaagtgactataagataatgaaactgctttcttgtatgatttttggaaaccacatagctctgtattgcaccatgatgacttcaatgtttcaaagtacattcacatcctgtttcattcgatcttcagaataattctataaggtggataggaaagtattattatctcgactttataaactgatgcagggtaaaataaaatatgtagcatctctaggactcagctcactttaatatagctaggtccctgatttgcagccacattattacctgaattgtacatatcacagaaatgagacagatggcggcaaccctcacaaaattcattttagataatatgttatttatctaattaccttcctattcctctgagagttgaattattttatctgatacagacttcctttacgttttcttataatggcattaatgcccctttacattccacctccattctaatcctactcccattctcctgattaatgtgctcctgtctttcttgtattgcattaaaagaaaaaggttattataaggctctgaaggtaaagaatgttacatccttattacacccctggggcacattttaaaataaaggcctattataaataaatactatatgttatgtgtcagtgcgattcttaaagctcaacaaatgaatccaattcatattaacatgacctgctaccaagtataaatattacagcttcctgtgtctaacattgtctcaatcaaatattactgggtgaaaacatttaatttataaataaaaatacagtaaaaaagtaatgagattgaaatcagaaaacctaaactctgatcattgcttatccttttattagtcatgccatttatccacaggccttaattttcttattcatgaaatatgcacagtaaaaagaatttctgtaccttttgaagttgttttaaaaagattatgtgtataatgctattaactttaaaacaatatttaaaataagacatcatgatattaataataatattaaaaaatcaggacaatctaaattaaggaattattgttaaatagtcaaacttctgcagagcaggcaattatttttatccattcttcagctcaacaacatgtatctcatgctttgcccaaccatatagccttatgcaaagtgaattctccaaagaaaatttaagcaagtacataattggcatttttcagctgatttcacaactgaatgtggttaaacctcatattcagttggtgacattggttaaatatttcaaggaactaaatatgcttataagtagataaagaatggagggagtgaagcaaagaaaagatggtgtcagaaaagttatttttaaaatactttgggcctgatacagtggctcatgtctgtaatcctaacacttagggaggctgaggcaggaagaatgctggatgccaggagtttgaggctgcagtgagctatgatcccaccacggcaccccagcctgggtgacagagcagaactccatctcaaaaataaataattaaattaaattaaatacttcagtgtcaaatgagttaattatctcaaatgtttataaacatcttaatgtttataattttaagatacttgttattgttttttcaaacttaatgctctactttgaaagagcaacacagtatgagaagaagggttcaatttaagatatttgattttgaagttgaatgaggatactgtatttaaaggcattgagccatacctctgaagtatttaccaatcggattttgaaaacagaattattacttcctttgaaccacttttaattttcattacaccaaatgaagagattctacaagatctacatttttcaaataatggaagtgagcagagactgagacatgccaacagatagagttttttctttcttatttttctgttttcaagccattatttaaaaaaaaaatcagagtgctttattgagcttagaaagacacagccttagggaacaaaatgactacactaattttctgcatatgctagttgggtggaaagttcaacacaagttttaatgatcaatgatgccacgttagcacactttcaaaaagtggatttcagatttgggtgtgattccaaacatgcacctgccatcctcaaagcagagaattcaggtccagaataatcacaagttctaaattatacacagtgtgttgtgaaatatcattattatttttagaaagtgaaaaaatatctgtgatagaacctatttaatgttttgtcagcctccacagatgtggctaaaaacagcttcccagtaatactttcaagggtcaaaagcaatgaccttgtcatgtttctgtgatcgtggtaaaacacctgggtcaagacactagtgaagattaataaggtaattataaaggaatcagaaatgttattgtagcaaagcagatgtagcaaaaacagcacctcctaatactattggtattgtcctcaacttttttcccaatccttgattatgaggaccaaaataaatatgttttacataataaaatttgctattattaagaataacaaagactatttaaaaagcagtagacttattctcaatcacatctttaaaaatcacctttgaacaggatgttcaacatgcatatcagagctgtgggagaatataaagcatgaccccatataccattgttattgctgtatctgtgcccattgacagttgagaaactaagtgattagaaaagacaaagcttaaaaaaacgtaaacttattggaccttcttttatctggctggatctataattacatgctttaaaactctctaggtatgtagttttttttaaaccctataagtaggggttcaactttcaatttagatcatgtttcagaaatgcctaaagagatggacagaccgaattataacaggggacctaaagaaacagtcctaggaaagcgtgcattctgtgggtctgtggagcaagtctgtcaacagaacgcctggttgaaggtcatctttccaacccagagtcctatgcagaaagaaacttaacagcaaagctttagactcttacttgaagtctctctgcagtatgacatcacttgcatacttattaaaatatttttgccacttctcttttcatctaacttattgttattgaaaaactagataagatatttcccatttagccattcatccagaaaacatttactgatgcctagtaatggctatgttaaaaggcacataattagccagacacaccatgttgtatctcaatttagctcattatttctgatggcctcctttgttttcttctgtttggcacactcctctcccatacatacctgaactacctcctctgcaaaggtgctcctgaggcatcaaggcaaaattcactcttctttcttatatgctactattataaatttcagtgcttccattattgtctttacatcattttattaaaattatttcttcaaaagtcttaatggagagttttcactattcaagtttattgaagcatatgcaatatctcatccacatttctatcccaagaagctaacaaggttctgttcactttaaagccctcaagaagtgattcatgaatgaacgaaaaactttccaccttcagtgggaattgggtgacagttagctcccagacacgtttttgaagagatctaccagctcttagtatgaataccatcctttctgacaaatggtgatgattctctcaaaatggaagaatatctctcacattctactggagatttgaatgtgttctccttaaagttagcaccttctttttttttttttttttctttctcagaatctaaacgtctttggtaaacttcatatttagccacagtgattatagccccctccccaccacatacccacggttttggagaaaaataagtttgtttatcttggagtctaagacagaatctaaactttcagcaaggccatagcttatataacagcattactcatttacttttttaaattagagtatctttagtctttgattaggggttggaatacaagtgagcctctaagggaaataactgcctttccaggtcctgaaacttatctgagatagaaaaacttcaactttgtacccagtgacattttagttaaatataatttaagattctatggattcctgttatacatatgcaaaacaaagtaaaggtgtcctttccaaaaatattcacttttattccatattgtttaaatagttttcaagagagatattccaatagcctttatttttttttcttctctattgccaatggatttaaatgtttgcttcattgtggcattccaaacacacaaaactccagtggctatgggttttattcctttgagtgaatagttatcgtacttcaaagactgctttggattttaagttagggtgacctgttttcattatattcaaacaggctttgatccatttctcaattaggtattgcagatgacaaacaggtacgtctagctttcctgccatctaaattaccctagaattctatgaagatgataatttgttctgtgagtacactacttctatgtgttatccacacaaatttcattatttcaagtattgtctttttatgtatctcttttgtggggagactaatattccaatacaaaactgtgttctgttttggggaaaaaaaaaaaaagagctcttagacagtcagaacatgagaagtttaccaaaaataatttgtcctcaagtctagttgataaaaaggccctatgaggttagatttatacaattttattggcaatgacaaaatctagaataaaatatataattattgaggtacttacatttttagtataaactggaataacaaacacatcaactttacaaacctctcatactagtgtctcactttaaagatattcttaggtcaaatacagtggctcactcctgtagctgcaacattttgggaggccaaggcaggaggatcgcttgagcccaggagttagagaccaacctgggcaacatggtgagaccccatctctacaaaaaattcaaaaaattagttgggcatggtggcacatgcctgcagtcccagatacttgagaggctaaggcgagaagattgcttgagcctcgggagtgtcgaggcttcagtgagctataaccacactactgtactctaatgagaccttgtgactatatatacatatatatacacacacatatatatataaaatctctctctatattatatatattatatattatatatataatatatatattatatatatataatatatatattatatataatatatattatataatatattatatatatatataaagaaaatattcctaaataagtggctctcatatgagccacaatttaaggaatattttcttaaaggcagacttagagagaaatatgagtcacactaacacaaagcataatcagcctaactcctcagtcaaacaccctgaggttcacattaccaaagagagaggtttgaacatgagggaaacatattattttcactatactgtgatggaaggaaattaattctggttgtgcaaacctagagcatttctctgaattctctgaactagggtggattgttaagaccaagacagagtgtgcataataaccttgatgttgggaaaagactatgccgtgagtcttaaaacagatcctagttgatgattatgccaaccctgctgaagaaattctgaaaagatgcagaatgccttgaaatacaaatgctttttctggcccagataattgatattgcattagaacattccatgggatttgaaccagcctctttcacactttagatttcaggctagtataattccctcaccacacaaggcagaaccgaaatccctgaagttcaacaggacgtatccaatttcaacaactttacaattttcaatatctgtacaggatttttgcaaaaacccatttcaaatatcccattatcagttccacgtctttttgtgaataccaaaatatattagctagaccgtcatcttattttagctttagaatgtatatcagattttttttccagacacaagcaattaaaggattggaaaatagctcatggaaagctccaaagaattgatcctcagagagcaaatcttgtaacaccaaacaaccacaattcccctaagccactctgctgacaaaagttattgctagttatgcaaggtaactagaagatatgcacacaaatcattgcaattaaatatcctgcccaccatataactgatacttgccgagcagatggttggcagaattttcttgctaatctcgtgttatcaatgtccatattgcagagcatccttgaaggtgctcctctgtttgttttgtattggatacacctatttgtattgttgtatagttatctgtgctgtgtgtcttacccagtctcacccagttattttactttagaatctcatgggctgtgtatcgtgaagacaaacaacctgttggaaataaacaacaaagaactgaatccctcttatctgttcgctgcctaacaaatcaaaacacactgaaatctgggattattagagaagttttggggatatagaaataaaataaaaaccagcttgtcaaatggggctgcctgctgctcagtaccatgtgttaccacagcaagttgcatctgttcagctattaaacctgttagtgaatataatatagacagccacggcattaacaaatattcttaatgcctattaaactctacagctacacattttaatttttacattgtattagtaaaattcaagactatagcacctttaggacaatttaaaagtgcaatgaaaaaactataattttggttatatctcacatgcttaaattatatttagccatcattttaagaattggccatttaaaaaaaagttctttaatttttaaatgtggttctcactgctaactgtaatttagctcactatagatgcaataggactgaagtaattaatcacatgtagaatttgaaaaactcaactaggtacatcttttttccactactgaacatcttacttcctttcgatttaatattggctattagcaaatgccacagaacatatgagttactcccttgatataatccaccctctgagctcaggctcaggaacttcgtcatttaaattggctatcaacagctaggacatgtatgttttactaaacactttatagcagaatacatctgttgctactctgtttgttatattaagattaagcacaatgatgttgacagtattaatacatttaaaagcctgtcacgttccatggtgttcacgagtcctggggactgcaggattgaaataaaaagtgactagaggcaaaattaagaattatggaatgtgtagaaggtgaagaacacagaggtagactctgaaatgagtactgctacccaggaggatattaacctcttgcctgcctggcttttcccataatattgtgaagccacattttactgaaaagagccgcatgcttcatgaaatagttatccaacctccttggcctactgctgcttcatgaatgctgccagaataggggaaagtttgtgactgaagttaaaggggggttggtttcaccgctatactagtgtaattattaaaatgcgaacacactcaaattaaatacaccagaaagaaaatcattctatggagctcagtttcctaagaaataatgagaccaatttgcttttatatgaaaacactccagtttgtgatatcttcatacactgctggtgggagtgttcaacagtacaatgttcttagaggacaactcagcaatatatacattggttcggcttgtatgaatttgtacataaaaatatgcttttacacatgtgaaacgatatttttacaagattttaaaatgttatccatttgtaatacttaaaatgctgaaaaaattaaaatacccatcattagggtctgctaccctcataacatgtagcagatgcatgttatgaggtaaatatgagatcatatgctctaaaatgaaaagatgtacaaaatatattaaataaaaatactcaagttgcagaatagtatgcacatgataatatttcatctttttaaagaatgttcaggtatgttagcatatatacaaatccttgtacctatactatacacaaaaaagaaattgaatgtatatgcataagattaaagattagagttttagacaccacagtaaaaaagtgggtatattatatgctgtttttactttttactcccatcattgttgtattatttaaatttttcaatacaaatttttatgatttaaaaattaaattgatttaaaatatgggctttcctgaaaagtaaatactttcatccgtaggcaacaaataaaattcaattccttctgaacagcctgtcataaaatattattggccttcaagaccctacagtatgcctcactagtctattgaatctagtttatgtctggatgcttagaagaataccaaaaaattagtaagttaaaaaaaaagttaaataatataaatacagtctactgagaaggacaaagttaaggaaaaactagttaaatatggagttgatggttatagcatgttcctcacataacaattaacaatatctacatagcactctcaaattccagaaacatccccagccactgcatttatccaacacccttctcaataaccagttacaaataatcaaataaccatcggtcttgatttaggtatttggaggcggagctagaatttacaactttttcttcccaccttatgaaatatctttgcaatacctgttttttaaagatcaaatgaacacagttctggagcctagacgagtagctgtctaaccttactctgcgtaatagggctaaaatttcaactctatttctctgctgatgctctatgggatttggagcccccaaagcctgattttattcctaattaacagtaatgaacagatgacatacttttcctttgaacacctctgtcgggaaaatgtccaatcagcaagagctacaagcaatagacaaattccctttctctgacctcatttacatgcttaagtacacagagactccccctgcctttagtttggggtgcggggggaaagaagtaggtcaagacattgaggctttatgcattacctttagaatgtggtgaaggctgaaagtcatggctccaaccagagtttccagagcaatgtgggttactttcatattcatcacacataaggccaataccctcctagcagtattagtttagttctacatttaggcacaactcacaaagcagcaaagatacctataattgtacccattaagagacttataatagaaaatactatgtgctatgtcatcacactttgttgttatttagtgcattcaccttgagggtcacagaatctctggaattccatgtttaaggaatatcataaaataatacactacaaagactcactggtttcacatcagtagttgggattttataatcatttgcaaaataagctgggccagcctgaaattttcctttgtacaaagaaaaatgaagctttgaagtcatatacaactggttcaaagacaggcagttatttactatctgtatgattttggtcaatttatttataatgcagtctgctcattggtaaaactgagataaaattcatacctcaatgaattattgtgaatatttaataaaatctaattttatgcaaaatgtttagatcagtgtgtgttccacagtaagcaatcagtacactctaaagagtattgtttagttaccgttcttctgactaagccaaataatagggtaagcatgatttcagagggggaatttaaccctacttcagatgattcactgatagtacttccaaacatttaatatatattaattaaaataatttttacaactcaacaaatggagaaccaattttacctccctcagctaagccaagtgttagaggttggcacagcagaagattaaagagagagagagagggagaaagagagagagagagagagagagagagagagagagagagagaatggttaaattgccagggtagtggagattgatcatctctacattcctaatcaattagggaggattactacaggacagttttttgtttgttttcattctcctagtggattcttctcttctcatcaagtcaggatgcagggaaatatatcacataagtttttgtgtagatattagaaataaaaatgatacagagaacagacaagaagcatacctagactcagagaaatgatcacctgtgtgtagtatttgaatctgaaggtggagctagccattaacaaaagaaaagtcttcctttcataagaaaataacacaggaaaaatgaatccatttcatgacaggcctcagtcctcaggcctctgacttttgtttgcctcaggaggttgtaaatgggaagtcccaggagaacatcacgtgctttcacgattatcctttggtactgtacctcatactatgctccaaggagagcacttctggagtgagcgcctgcatgacaatggaaaactaccagcaggagggcaagagaggccacagtcaaaagtaaagcagcaagagttcacttatttctccattcactcaggtatgcattgcttcctctgtaaaccattactatgcatctactaagcaccatgctagagtatgaaaatacggacatgtaaagatacatagtattatacattgtcagtgaccctgaagagtttacaatttaatgggctacaaggacatataaagacatagttataactacagtaagtaacacaataggattaagaacaaagtattatgattgtaccaagaagggcataattagtcttgccctaggggacaaaggaaggtttcacaaatacataaaatatataatccaggcctcaaagatgaataaaaaagcaccagactaggaaaaagagaaggacaggtaggaataagaggaagtaggagtactttaaagaaaggaacagatatgaacagcggcactctggaggtctctttttgctgactctcattattggtacatttttttaaactgtgtttctcggtctttaaaattatttatgccccaaacttacaaatcaaactagttgcaaatgctagctagctaaccacaaaatctttggggtaactggccagtcagataacttcctatgtatttatttaactagagaaaatgctttatgtagcagatatctgaaatgctccataatttatgtgatatgtggtatactaaagggtagggttgtttgacttcataaaacttcattacacagaccaaaaggcagagttatctcgttcagcctgatgagggattgtctcctgaactctcacctgcatcacagaaggcacagtggttaagcacatggatttaggagtcagactgactgagttcaacactggttttgcagctcactagttgtgtgactttcatttcttcattaactacctgagtatatattttttccttttgaagttttaatgcatattagatggacttacatatgtaaacttagaacagttatgagactgttgattgcttttataaaagccacacttgtagactgcttcatagtttaaaaacttttaagtgtgcttttacagtgtgaggatttgaaatatcagcctattttctgtggctaatgtgccagtagaataatgattatgtagtaaattataaggtacttgaggtcagaagccatgccacatctgactgtatttctagtgctttggaaagtgcttagcacttagaagaaaaggaggtagaagagaaagaagaagaaggaggagaggagaagcacaaggaggagggggagaaaattttgttaagaacatgtattaaagagtgaatgtgtgtgaggtagaatgtggagtagctgaagatgaggctggaaaataagtctagattgtgcatacatcagaggtccagctaaggaagttggcctttgaagtatttgcagtagaccactggttctctatcagaactagaatcttgcttcaagataccaatctataaataggtaacacataaactggaaacatgctgatagttagctcagatttgtatctctaacccccccaaaacacatttaatataaactggcttctgatattgcctttaacctgagcagcaccgacctattgccattgaacattttcagaacacacatagtttaagttggtagaacttccagaatgcaaagattatttcaacaaatactgattgctcacttgctaaattctaggctcatgctgggctctaggaatactaaagtgcacgaaatagataaaattccctgctttcatgacacttgctgctcggcatcatgctgttcagtatggatgaagatttgccatcagagtttaaatactttaacctaattccaaattttgtctgcttcataaaattgccaacaaaaaatgcaagagtacacaaagacgggaaaaaaaaaaaaaaggaagtttgttgttgttattttgccaattttttccagacgtttgactttgctttgtcctggagaagtaaattactaagtgtccgtgtctataattttaataaataaaaattagtttctcttcatatgctattaaatacacattgggaaaaatacttaaagaatactatgagggggcttcaaattgacaactgaacagggagcccatgcccatctctgaccagccttgctaccaggtgagaggtggaaacacacccttgcagagcagtgggagaaaatgggtgaaaggactgatagagtaccaggatttgtgctttttttccactgatgagcagctcataagtgagcaaaattactgctgaaagtgggtgaacattatcagccaggtatgtcttgaactaaaagaggttgagacccactgtaactgaacatttgaagccagaggttgaaacaccacaattttattttataacaatcattctggtagcagtgcagaggatggattagaaagggaagatgctggaggcagagagattagttagaaggctattgcaacagttcaagaagaggtcattaaactaaggcaataatagtggaataaaaagcaagcagataccttctaaaaattgctgttcagtaggcaagccagtagccatatgttgagcatttgagatatggctaatgtgaccaaggagctgaattttaaaatgtatttaattttaattaagtttgttgtaagtttaaaagatactcaaacttttaagtatgtttagaataacttgagtatgtgaatctacttttacaactgtagatataacaaaatataaaatgcttctgatggaaaatttagattctgaaatgagaggtgttgttaagtgtacaagaagttccttgttttgacagcttggcataagaaacagggtttgctaaatgttaagtgtaaaacacacattggatttgaaaagcttattatgaaaagataatagaaaacattaataatttatatcatttatatattaaaatgataatattctgggcatattgagttaaaatatattctcaaagttaattgtatttagtaaaactaattccatctttttttccttttatatgagtagtagaaaattaaaacttacaaacatggctcatatatttctcttggatggtataggttgagagacatggtagcaattcggtgacaaactgattagattgtaaaggcaagcacggagtaaaagatgtcaaagatgtagcctgtgatcgtgtagatgagtgggtgattgggagatgatgagttcagttgttaatgtggtaagtttcagtcgcctgtgagacacccaggtagagatgctgagtaagcagttggaaatattagtatggtagtgacagaagtctgggatggagatgtgtctttgggagtgagcagccggcacttatttgatagctaaaattcagagtaaaattttaagtatatgaagataccctttttcataggccaaaagccttactaatcaattaaatttgatctttcaccaaacttttttgtctgtcaatcacgaatttccattctttattgggcaggaaggatttaagggctaaaattccaggaagagcccaccattaaagcatttacttagaagcctagttgcagtgtgatcttccagggcagttgagcgtcccccattcagggctgtgctctgttggcaaaaaggttagacagttttccagtttgttttgaggaggagagaggcctcctctgtgttgtcgatataagaatccctagttctggtctagcacaccatctcctaaagtaactcctagagacatcacaaattgttttcatcagaagaattttctcagaccccataaaaattatgtctagtcctccgattctaatttataatttggattatttatgtctactattaacttgagtaccccctatctatgcacctagattatttccttccattgtttaaataaacttgcccatgtctagagtgggccagcatcagcattaataggattctaatgctgtagaatcaccatcatcatcttgttttctggtctttggctgacatatttacaatgctgtttctattttgtaaccgctactgccatgcattttgcttatggctttcagcgcatttttttttgtgtgtgtgtgtgtaataaaagtaattttcctgatcattgtgcaaatgacccatattcagtatgtattccccaaactggttcttaaccctcaagcaatgtctttgtttctttttttcttccatcaatctatattgtgtttagagttctgcaaagcctccttaataacgtgcttgcatatagtttaaattattgctcatcatttcttcccgagacacacagactctgtctggatcataagggtaaacatattggatatgttctaaatacaggagttcttaaccattacttcttctaaaaattccagaataactaagatgctcctggattcctaagtcagtgtaagattataaatgtttgctcttttaagcttctaaattatggaaaaattggttacacaggaactaatcacacacattataaattgcattataggtgatcaaaaataatgtgtttattttgcctaaaatgtttcttaaaggtacgcttttgaaaaatagttagtagctatagaagaaattgtggtatagtcagtagtcagaaagaattcaacaagaagttccttgttttgacagcttggcataagaaacagggtttcctaaagccactcatcactggctaacttaagaatagatttgaagccattctataaaatagcttggggcccaccacaaagcagtgggtcaaaaggagtagtgatcacaggatggagcagaatcaatggacatgattttctccagctaggtaatgtcctaggaattgtttctgcaactcttccaaagagattccggagacctaacttctttctgctagcttaggaggtgaaaagatccaggaccaaccctgaaaacactcactatttgaaaaaactgttcaatgactgagtcaaatctatatagtgagagagaatgggaagaaatcttttgaacaggaattagaaatagagagatgacaagaagctcattttttaaaaaaagttaatatgtttcactggagttgaaagataagtagaaaaatgggaaaaatggacacgaaaagggaaagagatcaaaatgctgaagacattaaattttaggtacagaatttgcctttacccatatataattgcagcggcatcaatgtgttttaacaaaggaataatatgatcaaagaaccagattagcaaattaacctgccataagtatataaaatggatagaaaagtactcagaatggagacagaaggatagctgagaaagtgaggcagcagtacaagcctctaagtggtaagtatgtgaaccgagaagaagctagaaatagctgttttgttctcatttcttaaatttcacagcaatagaatttcagatgaggaaataactctagaattctagaaaccaaaaacatagagattaaatgacacactaaagatgatgaccagtaatttagaagttgagaaattgaattaacttccaagggaaaaggatgaaggtaggaatctgtattgattcatttacctctcctacctcccacataataaactatttagcacttaagccaatagaaatgtgaccatcatttctcacattttccccaaaaatgacttttacacctcagaagtttggacagtaattttacaatacatggtgaaaaggcattatttaacccatcttttgaaattgtagtaaaataggccacatgttctctaattcatataagaattaggaaagctacctcgtgatacggcaatagaaaaaataaataaatgaatgtaaaagaactaggaaagcaaaaccaagcaatatatatacaacatatgatttacaggactgaatctgaatactatatggcaaagttaaacctctataaaatcagtgcatctgttgattagaaagagtatttcaaatggaacataatttctattcaaggaaaaccctgaggggaaataactgggtttatcttgttgatataggtgtgcatctatgtataattactgactttaaaaaggtatttctgaatcaaatcttaatagaccagcaagataaataatgtataatggagagaagcagagaaagatgagaaagacttgacacgtcaccaatattggtgttattttgggacatgtaatatttactataaatacactgtttctagtctacactaaaaccaatgatcaaaaggcatatttctaaatcaaaatcaattaagagcttggtttcaaaataaggcttccggcccagcaaagtacaaagaagcaacacttaaggcaaaaatgtgcaacaattcactcatcaaatttgcaatgctcttttatgctcccaagatgaaaggatttcaaaacacactcttcactcatcccctcctccaccctcagtgacatttcctctggtcagaaccaatgcacatgttaatatttgtggtagtgaatgcatccagatttatagtgactttcttctgtcagagaggcattaagtaatttccaaatgacatcactaaactgctatatgagcgcttttctctagaagtgacaacattggtaaaatttctagatatatcttatataatataaaaacttgagctaaatttttcttattgcttctaagaaattatttaagtcattatcagttaaataatcctcaacacatcgtaacttaaacatgtcttgtgtaacacttcacagtttgcaagttatttctttatattctttatcttaaaaatctattatttgttaactgtccacacaaatactatacaagtaagaaagttaaaactgtaaggaagagagatgaagaaatatcaagacagaaaaataccaagaaataccagtcatttggggacaaaatgtttgctataaatcatataagttaactggatctcagctagcttgttcattcattcatccaacaaatatttattgaggtggttactaaacaaccagctcatttatttttgtatccacagagcctaacataggcctgggtcatattaggtgctaaataaatatttctggagaggcttctaggatgtactgaagtaaatgatgaaaagtcacattactgtattatttttctttcttttcttttcttttttttttttttttttgagacggagtgtcactctgttgccaggctggagtacagtggcacgatctcggctcactgcaacctccaccttctgggttcaaacgattctcctgccccagactcccaagtagctgggactacaggcatgtgtcaccacacccagctaatttttgtatttttagtagagatggggtttcaccttgttggctagcatagtctccatctcttgaccttgtgatctgccagccttggcctcccaaagtgctaggattacaggcgtgagccactgagcccggctatttttcttattaatcatcaccattattataaatcatgttctctgccatcagaaagtttatttctatttgtaaataatggacagatataaaataactagagaataattcatgataaaagtgaattacaataaataaggcaattattaacaaaaaataaacattcatccaactaaaatttcaccatagactttctttaaaccaccaatcaccataaccaattcttagttgaagatttctgaaaactacctttaagatttgaagcttctcaataatatggctgcttatatcaagttctatacttttctgtattgtaatcaggaacctggaggactttctcagagttatatagaaattaaaatgtctgtcactttacttgactgttaaataattgaagatctacactcatcctaagccacagtattttcaatgtataatttattaaatctattaaattctttcagaaaatatttattgagcactcatattctaggtactatactaattaattgctcttcacttcatgtcttaccttctcctcaccccttcataaaaccttaacaatttcaatagtaatattatatgactttgaggttaacagtggtagcatcaatattaatatgacaaaaaaatccatctatcaaaactgggccacctgactcaaaaaccattttattccaagttgttatgtttttaagagtacagttaatcaaaatttttaaaaatccaacatttttattctgaaaaattggatgacaaaccatgtcaaatattcaaatcttcattaaaattatatgccaatcagattttttaaattatctaatttaaatagcagtatatatttcagcaatgatggagcatctcttaatgcaatcaactttctaatttattggcttactctatcaaataaggatgaaaatattaaatctgatcagtacatagtatacttcactgactttgaaagcttacacaaattttccttgaagtttaatggataatgaataagtctaacttttacagataaaaatgtatcattgatagcatagcaccaattaggttaatttttaagtcagttatattcacaaacctaaatcataagcaataatctagaatttataaatcttatttttccttttaaatttcaataatgaaagaagtagaacaatttattgggcaaaccaaaatggactcaaagatacctaaataatttgataaaacagcctttcaatattctcaaatctaaatattaagaacagttctgcttctatcacccccaggcattatcttgtgttgctttgcactttctttgttcctttcttccctccctttctttctttcttctttccttccttcctttcttcttggcttcctgtctggttttcattttttcttttaatttctaattcctctttcttttattattccatgcacccaacattttgggaaagtgctggaggtaaacttaggtagtaaaaagaaaaccactggccttgtgttaatttttattatatgcttaaaacatggaaaaaggccgggcacggtggctcatgcctgtaatcccagtactttgggaggcagaagcagttggatcacctgaggtcagaagttcaagaccagcctggtcaacgtagtgaaaacccgtctctaccgcatatacaaaaattagctgggcgtggtggtgggcacctgtaatcctagatatttgggaggctgaggcaggagaatagcttgaacccaggaggcaaaggttgcagtgaactgagattgcatcattgcactccagcctgggcaacaagagcgaaactttgtctcaacaacgacaacaacaacaacaacatggaaagaaatgacttatctccacatcaaagacttgttgagtctgtaatgtctaatcacctcttctaggcaatgggagaaagaaaatttaatttgaccagatttgaactcagactgagtcccattagttgataaggagtgggtagggctgacaataaacagtatttgagaagcccaggaggacacggtttacgagcaagggagattttgaagatatcaagtccaagagaaagggtgtgtagagacatgcactgaatccaaagagaacgaccaggcaagaccaagatcggagattcagaaagaagaaggccttcacagtgcagctatcagaaatccatggctcgtaaaggagatatggagggtattacgctagaatggacgccgagaaagtcaattctttacttatgacaggaccctaagaccacatttgaccagaattggaaagaaatacctattcttgcagtctaaaactctttgaccataaaataaacaacagtggtttgagtaattcaataacacagccccttgtgatttgagagtgatcattgtagaaccttttctcagagtaaaagtgtaattggttatggatcaataagtaatttattttagaaggaaaaggcccttgttttcatttttatttatttattttttgaagtagcaaagctcttaaatcagaacggagcaaatacattttgaaagttgagcttactctaaacagcaagattccttactgtactagtaaaatttatcttaactgatcatttatttatgatgccataaaaatccagatgttcttaattttgattgttagaaatttgctaaaaggcacctgaaattacttttccagagttcccctcttgagaactacattttaaattgaaattttactatggttcaataatggctgtgctgaggggttttgttgtgtttttcaagcttatcaatgaattcagcccttgtggtcagtgtaaactcctacacagcttattggaaattccagaattctaaggcaaaattaagattaagaaaatagtttaataaaaacagagaattaaaaacttgtaaaagtttgtgctaatgtactttggtgtttcatgtttttcttaattattttagaactggtacccgatgaccactttctaacaggaaagaacatgatgacctaatcaaatgtcctttggagagtgagcactgatagaaggagaacttatagggaaagacaaaacaaaatagaacaaacttccatggtcgcttaatgcatgggaaataaacagaacctcaaggataaaaaagaggatggggagacttacctgtttcttctgaaatcttccaaaagatagactttagaccaagaactatgataataagaaccctttagaaaagtttttgaatatgtgacacactacgattttttggatatatcaataaaatattcatatctcttaataaaagacactgtgcttctttacaaataatgcaagaaaatgaagatttaaagagttgcaaacatactcattaataatttttaaaatgcagagaaataagtgcccctgaaccctaaagttaattatggcaactttcaaaggaaaatgaagtttttcattcatgactattctttgctatctattatatgctgagtaaattactgtgggaggcttacaactttagagaaaagagaatgggcccaggatgtaagtggtaattatgaattaaaatgtattttcctgacacgtatcaaaatgagtacaaaatggcacagaaacaatctttttgccatcttgtttcacatccccaagtatccttaaagtatactttcgttccttttatttcatgtagcttcagataagtactttctctagtgagcaaagaaataaagacagaatccagatctttggatgtcaccagtattacaacctcctgcttccagccagatggtgtggtatctactaggcaataacttattttattcatttggcaagtctgcctaaagacactaaaatcactccaaaatttttttaaaaattattttgaacacagaattaagaggaattcacactccaaaaaaaaaaaaaaaaagtttgcattgtaaagaacgcgattaactacagcaataggtatatggtcttatttcctctagattgtattcatatttcctataacaaagtactggtttctgggggaaggaagcatccaagaagcaaaattataaattctttacaaaaagttaacagtaaaaagtaaaagctgaatcttatgcaaaaagtacttactatatgcagttctaggtagtcacccaagcctgaagaactgtccactcgcaccaatacggcttctttctgaacagtgctaaaacctatggccagtctgtctgctcgtgtactgggtcggtcattaggaggccacttatacgtgatttgtccaccacctttgctaaagatatatgtcgtcccagctggaaaacaaaaaccaaaaccaattagtccaaatacatcaagtctgcacattagcaaggcatgttatattgatatatcagtaaagtatcaactctacacacaaaactatggcaaagtaaatcatagatttcaatcaaatgtgctcaagaaagtggaccaagttgttttaaaagaaatggagaggtagctcagtttttaatacactgattcaatttaccagtaggtgtttcagaacaaatagtaggttattgtgttttccattgagttggacaagaacggaatgtaatgaggcattatctcttcctgccagtttttaagaaatagtttagtagaaaacattgactggatgcttccaaaaagcaacagcagcacacatcaacttggtattgaaataggagctgcatgcagatgtgacagggtcatacagcacagtggagaaagtcgcaacaaatgtgctaggaatgtaacttttatggaaaaaggatctacttacatgtgacagataactaatggatgaatagccacaagccccagtagccatgtcaagaaaatacagataatagatgtcatccctagaagtcaggttttgtttaacaagcaacatctagtagctgtcaaactattcagaatcataaaaagacccacatcctctgccaccccaaggtgaatacaagccttatagcactgagaataatgtcacggactcattctgtgagtgttcaaattttaccttatggttgtctggtcagtaaattatccagcttaaatgaaaagagtctttttcaaacaaatttattcagcatttgatatggtttggctctgtgtccccactcaaatctcatctgaaatggtaaaccccataaaccccatatgttgagggcagggcctggtggaaggtgatgggatcatggagtggctttgcccatgctgttctcatgatagtgagttctaacaagatctgatggttttataagtgtttgacatttcctcctacacacacttctgtctctcctgctgccttgtgaagaaggtgcctgcttccccttctaccatgactgtaagtttcctgaggcctcctcagccacacagaactgtgagtcaattaaacctcttttctttatcaattacccagtctcagggaagttctttatagcagtgtgaaaatggactaatagagcatttggtgcactagtcttacctcaatgcatcattcattggccacccattttggttctattattttgaggtcctgaatagaaccaaaaaagaaagaaaaaagattggattttccctctgtcttcttctgactgcttaaaatgggacattgttgttttcctgcctttgcagcttcttgttctcatgccttcaaacctggactaaaatctacatcgttgtttctccagttgtcagtcccataatcgatacccctagcttttctggttctctaacttgcagacagcagatcatatatgatttgatcatatatacatgattatacataataagagaaaatatgaaaacttaggccacaaaacttcttgtatttatagaaaaatagcttgtaccaagagtaacatttatgtgtaaaagttgtgtgtacagcagtatgttttgaagaaaactatacattgaattgccatgattaccaagtttaccagttaaatggagttgacctactatcacatttgtgtacatttaattaaacagctgacaatattgattttgtggccatttttggaagcaactcttctttgttttctgttacagacatttccacaggcctttgagaaattccaaagacctctgcaatatgcctattgtacctgatgcttaaataggacttggtatatagacctcttccaagaaacatgttaggagaaaattgaatgcaaaagtgataaacatgaatactgttaaaatgcaaagctatagaggctgtacccttctctattaattttgcagataccaatgcatgaaaacagtttatctctttcaagagagaaaaggcaagccatatttcaaaagcaccagtcagtgcacaaagaaaattcagaatatacagagtgtagatcagaaatcccagggctttcctgagccacttatgttctacatcctcagaagcttgttcatcataatctttataggcaaacactatttgagaaatatttttctgcctggtaatttttgcaaatgattaagtattaacttttctagtgaagcccattgttgataaaaataggacaagaacataaaaaagtggagatggctttaaaaggaggatgtagtggttatctctgagtgctgatacttaataattaatttttttccttttttaaattggctttgttctctaatgactatatacattatgtgaaataagaaaaatattcaaaactagagatgctatttaatgatataaaacaacacatatctaagaattcagatggtttaagaattatataagtgtgaggtaagcattataaaacaacattgcatattaatttttaactttaaacatcactttcacaattaaaaaaaatcttatctacttattatggaacatagggcagacattacttccatgctatatctgaggaaatttagtcataaagattaacgtgctatctaaagttgcaaacttggttaattggcagagttggtataaaacccatatcctgatacctattccagtatatatatatatatatatatatatatatatatatatatatatatatatatatttatgacagaaatatttctgttatcataaccaggcagtcaagaaaaagttaattggatgtcagtctgaatttatcaaggccaactgttatcatattctaatgtcttatatccataaagtgacatttgctcttcattatcatatactttcttctcacctcacaatacttttaaaaagagaaaaataacatctaaatgtaaaatgacagaacatttaatatatgtagattaacatttagttggggtacacttcccaaacctatggaactatgaaagtttctagcacaattatagaacttgtgggtaataatttgaagttttacactttcagtaagataagtgtcacaatacaaataccattactcaagatttgatttcttctcagattttaacctttttcaatgaatctaaaacttgatgactagaatgagattagctaatctgtcttgtttagaatgactttacagttttttaggtttcaccaaaacaaagcaaaaaaatcgcaactactgtttgtcaaacattgccattatttctagtttccttttttcccaccagatatatcctgagagcagtctttcttagtttttcttctgtatgcacagtagtgcattgtattgtactcatcagcacaattttataataagcgagacaattagatatccagtccttcctcagctctcttctacatacttctataagcactctggattttttttaaaaaattaactttgcatcaaactttacaaaatctcctatattcttaaagccctcttttcactgagctagaaaattactctcataatcaaatatagtgggttagatggcttaaagtttcaaaatctacctcctttaacacacatctttctgaaccaaggacatgatgtacttactgaagcagaatagcttagagattaagaatgtaaactctagactcagagagatctgggttcaaattccaactgtgtcatttactagctatgtgaccttggtagccatttattctgtattgggattcctatttgaaaaaagatggggatagcaacactatcttatagagctctatcagaattacatgagatattacaaagtaacatttagtccatttcctagtatgtgataaatgcctaataaattttagagagaataggtgtcatgtgtgagggcagttgtgtgtgctgtaaaaatataaaataatgaacactgtaacattgttttattttaatatgaaagccttcagaaaagttggacatatttcaaagttatgtccaaatcaagtgactttcaaaaatgacattcctacctcgtaatttttattaatattttcaatattttgtagcacagattaggacttttatgtaaactcattatatcattatttatgttcagtaatagttgacaatggaaggaatattaaattgtatcacatgggagctttcatgagaaaaagaatattagctcatcaccataaaacatctagcatagtaagatttatagcataatgcaaaaaaaaaaatcacttgaccattaaataaagaccaaacttaccaaaaaaccctgccagctagctttttaaaaattttatctttacagaaacatgttttattttactatataagtgagttaaatatgcagtggcagtacatcttaatcacagttccaatatagagaggaacatagaggaatgtgtcacctttattatttatgcatgtttctatatggcaagcactaccacatcagtaccatgactactaatggatttactgcaaattaaccttgacatccatcagatcgctgaatgtatgaatgactgaaatttaaagtggttttcagcaatctccacatttaagctgtgcagcaagcctctattactcactctaaattcattaacaaagctggctctatcagacacaaatttagcaatgtcaacatactttacactccaataaatgtttgtaaaaaatatacatgggctcccgtatctcttgtttaaactgcctgtgatgttataatcagggaatatttttagatcttattgaacatgctatttacatatagggctctctcccttcttgttctttcttgccaactgtcccttgcctaagtgtgcccacttcagcctcacgtcaattctgcaaaggctaacatattcccttacatagattgaaactttctgaaaaagaaaaccaatcagcatgtacaggtctgctcaattattggttgctctggatccttgctacatgaacaataatataattaacttcggagtagattagcttctaactcataacataagtatatgaataaaaggttactttttgaaagcctataattcttcaaatgtcatcttgtagccaacacgaaacattcaggcaattatgtttctattaataaatgtaacaggaatataacacttccttcagtgaaagtttacagtgaaagccaggtacccagatgaatattaaaagtaaagcatttgtaagtaaggggaacctttattctttctacaaccttttccagatgctgttgttaatttgaaattttctggagaatttctacctatatggaggaattctttggcttaaggttcataaaaagcaaaagcacagagaagaccacattgtatgcaaaaagagttttagatcagggcaacatttctaaactgatgaaacagaatcttaacaatcactaaaacaataacaagtaaatacactttattttccttctgaattattgtaagttctttgtagaatcataaggaattatttcatgaagctgagcactataggttcctaattactaaaatttcatataggcatattaaaaattcagaaaaagtgaacatcttaggagaagttaatggaatcaagtaatgagtttctacctataatatgtaaccacttctagatttaaaaattaattacaataattactaatattgagaagtaaggcacagccctcaatgttacatatgcatgtaagggtgcaaagacaaagatgccaggaaaagaaaaagaaaatatggactatatatcataaattaagacttctggtgggaggggcagacaacagaattggcaaatgtgttataactagctaaagagattggagaattagacagatttttaatcacatctttgagaaagagaatgcatatgctctttataaatgaaagaaggcaagaaacatgacatgtcacagaaatggtttaggcacaggtcccatattctcaatcaggtcgaaacaaaaaatgtccagaagaatttagataattcccaaataatgaaagctttatggaaatagttaaggatgatattcaagacagcaacataggtcaacagatacaaagttacggttagataggaagaatgagttctggtgttctgttgcacagtagggtgactatggttaatattattatattgtaaatttcaaaatagctaggagagaggatctgaatgatctaacaacaaagaaatgataaatatatgagatgatgaatatgctaaacataccgatttgatttttacacaacatatatatgtattaaaacatcactataagtgtgtacaattataacatgtcaataaaaacaaaacacaataaataaatttgaaaaaagagaacaatgggaagtttgtcatatatagcaaattgtatgttctgtcaaaactctaggctaaagcattttttaattattaattttttattaaataaaattaagttattaaattttaaaaaatacgttgttgactacttattaagtcaaatgcaaactgagcaagacagggagactcaaacttgtgagcacactattttcttgcattggaatttcatgaaagtgatactgtctaggatcactgtccacacactattccaccaaacaccaatcataaatttggttcaagttaatccaaaagattcttgaactcttgcaaatcagacactgtcatacctccagtatccaggaggactcattaggtgttaacaattaaggttttccaaatttttaaggggatcagaggagggtgaaccagctagactccacggtagacattggaagtctgaaagcagaagagtattcctcttcaataagccagcccatctgagattaggctctagcccagccaagataccatttaaaaaaaaattgtgtgtgtttactcaacaagaaattttaatcaaaataaaacaattgagaaaatgaaataactaaaagttactgtgattccaatgaggtcaagaatcatttctctcaaatataatttcaatagtaattatgcgcttcaataaaaaatgaatttacctctacctattggcccaaaacttttctctaataaaaatgtttttctaataaatgttctacattttctatattctctaataaaattgctatatcttagaaagaattatatattcataaatacattttatcacattttgatgtttataaaaagagtatggtacatgaaaataaagtattcattcttctaaaaacaagtgtataccactctaataagtgaaataattatttaaaatgtaaatagatccatggctgacctatcttgtcaatatcctagacattcattcagaaacaccaccaatagcagcaaagactgcacactggacaatcaaatatgcaccattcatatagaatgagatgttaatgatgttcattggtgtcgtataaaactatgactctacataatcaatgatcaatgattgatagagattgtgctgatttgaataagttattctcttttttttctgacattataagggcattaactaacatagaaaacatttctaagccttcctatctcttgatttgctgataagtgccaactgtgtgaaaggagctaagaatataaattcagaaacagccttttctcttcagcagataggatctgttcattaaaggtaaatattagggcaaaatagtttgtgtgagatgtcagaaaaatggtggtgttctgttgcacagtagggttactatggttaatattattgtattgtaaatttcaaaatggctagaagagaggatttgaattttctaaccataaagaaatgacaaatgtatgaatatttgtcaaatatttgacaaatatatgttattcaaccatgttatcatctattttggatttttaaactgctttttaagaaggtgataatattaaaagcactgattaatgaaaacctaagattatcagaaaaaaatgataagaaaaatctatgtgtgtatatgtattttcttttaggtcaaagtcatgtaaatagttgagtagtttgaaataatgttcaacccaatgaacactacttttaaaaatgtatgcaataagtggtccacttagtggtatctttgcaatatattttcttttacaatctacttattattttcctggcaaatgtgtcatttagaagtatcccctccaggaacagttgagttcaatagtttgagctgcccagagagacaaacttgttttgagatcaaattcaaagtcctgggaactgcttaaaaggctcttggtccaggttacctggctgagtagaaaaacaggtaagtagtagaacttttgccaatcagatcagaaaaaattccataaagacagcaaagtgatctagaattaaaaataaaacaaagcaaagtaatcccacaaccaataatcctaagaacatcaaatgcttatgtcttcccttctgaaactaggctccctccagcagtaggtgaactttattaaaaagtctctggcaagtaactcagtaatcaatttgtattaaagctataggcagcagggataggaagaaaaagaatcacatcatcaggaactttaagaaaaatctattttgaagagcataacctaagtgtgcatgttcccagtaaactcttaaaattattagctggtcggtagaagttgtagttgcctagcaatgtcctttaacttacttatttcaaaggttaattgtgaaaatggctttcattaggattcaagagtcaagaattttctttactataattatggtctaaaaaatgtccagtttaaaaaaaaaaatgacataaacatagaacttactgccgaaatactcttggagaaaagtgagtaaattttccaatttacaaataacaaaactgaggcacagagaaaccaagtgtcttctcaatgtcaaacagatgggtgcaggcttgtacttaactctattcttagtgattttttttttctatacaacaaaaagctaagctcaaatgactaattcttatttagaaaaataaattataattcacaaatcaaggtctcatttcaatcattttagagtttttctaatgatgcttccctagtctgatttggggaaagtttctataatgacacttaacagaaatgattcactcacattctgacatttttagagtctatcctgaatctttaaaaggtgtgaggtatctgcaatgctttattgtaaacatcctctctaagcagccatccaagcctttggcttattctgaagcttctaaattgtggaccaaagctacagaagacaaattttccttatttttaccacagtcacttttactctataccagaaaggctttatgactttttggcagtgacacttctttttgtccttagcaatggaattaaatccttaatacaaaagaataggtatttattttgaattatttgcatcgcatagttaaatagaagggaccatgcaaacaataaaatttgtagtaattttaggctaaaaccagaaccttaacttttgtttatttcctaatgttagttctactcatttatcttcttcctgcctatctgctatacttaagtcattctttacctgactaggccctcgtcaaaaccatttactaattattttggactggaacagaagggaatattagtttttgactcagaaattatctcagactaagctctaactggatttacctaggcattcacaaatgcaatacacattctcctctcaaagtcacttttacttctgctggtttaggcttctctgctgcaccttgatttcttttgtcatgctttccacattcattccagccaaggttaattctcgcctttcaacatccactaacttatttttaatttttgaactattataatatatgagaattgtcttttattgaaatatccattttaaaaagtatgcatcctgaagaaagggatcttgctttaattctaggtatccttataaaaaattatgtgcttttattcacttactaattattaataatgactaatacactcctcaagctaagtcaggaccactgattcaatgatgaataccataagactcctgattctgaaacaagcataggaaagatttatttatgtgatccatcccatgcctacatccatcagcatgatggagtatctgcagctatataagaaattggaatgatttcacctaatacaacaatctcagataaggacacagattgcctaaattattctgataagaaaaaacatggtcgacttagttatacctgggtaagaaataagtattatgaagagacatgggactcctcaacctggtaatggtgatcacatgaaaaggagcaccagatctcacagttcacttgaatagcatagccaaaaattctgcatattttacagggaaaagctggatataccttgctagtcctcaggctttaatgatttattaatactcagagaaatctgacagatagcaccttaaccaggtgatcaaagctagcatcaccagtaatgagacatatcaaattcaggttctccaaatatggtacactgaggacactgcaacattctgtgctatttttggcaaaaattcacagtctcagttttagttttccaaaaatgcatagtctcaatctaatcataagaaaacatctaacaaacccaaattgaaggacattctagaaaataactggcagcactcatcaagagtcgagggcaggaaacagagaaagactaaggaactgtcctagattagagaaaactaagaagatatgacaacttgatgaaatgcaagatcctggctttgatagtggaccacagaagagggcattagtgggacaactggcaaggtttgattaaggtctgactcttacttaataatactacattaatgttaatttcctggttttaatcattgtactctggatatatgagatgttaacatttgtgggagctaagtgaagacacaagaaggctcttttaattttttataacttttttgtaaatctaaaatttcaaaataatttttaaagataaatatattagtcatgaagagcaatttagaatctctctcttttttattgagacagagtctcattctgtcacataggctggagttcagtggctcaaacatagctgatttgcagcctcaaacacctgggctcaagcaatcctcccatctcagcctcctgagtagctggggcttcaggcacatggccaccatacttggcgaattttttaatattttcttagagataaggtctcactatgtttcccaggttggtttcaaacttctggcctcaatagatctttctgccttggcctctgaagtgctgggattctgggtgtgagctatagtgtacaatttagaatcctgaataagattcttggccatgggaatttatgcaagagaggtagcttgagaaacacctacctcttgaaatgaagtagagtttgagattttgtttggctataaaaacaggagagcatttagaggtgggcagaagacatttaacttttgttctacctaataaatttgcttaacgcagagctctttgtaaataaatcattattaagtctttaaaatgaacatattctaaaaatgcaagttaaaatagaaattgcctaagtagagtagtcaactctgggatcagttcacccaaaaagacagacaacttattcattcatttaattcttttatcataatgtcattgtaaatatcattgaaattcttatgaaatgttttccagtcttaaaaccatgtagatacatagttttaagtcagaatacatttttcctgtcttgtaattagaacttcttcacattagtgtgagctaattccttccctaagtttggaatctaagagggaaactagtgtaaacaaatacttgtatgtgtagaaattggcatacgttttgggctgggtatggtgactcacacctgtaatcccagcactttgggaggccaaggcagaaggattccttgaggccaggagtttgagactagcctgggcaacatagcaagatcctgtctttacaaacttttttttttttttttttaattagctgggtgtggtggcacacatctgtagtcctagctacttgggaggctgaagttggaggatcacttgagcccaggagtttaaggctgcagtgagttgtgatcacatcactgcattccaccctggacaacaaagtgagaccctttcttaaaaaaaaaaaaagaatgaaatattgtggttatgatgaaaaagatgattcaaaaggcaggggatggtgataattatagaggaaggactcatatctcttctaataaaacaagacaaaaaaatcctatgagagatcacttttagatttcttgaaagtttaaaaaccagatggcttagagaggtggcagggaaaaactctaactcaaattaatgagtggggcattttgacacaaacaaacaaatcaacaaaaaacaatgcggagacaacagcagaaatatattgctggagacagaatacaaaggcaataaaatagtataatttaagaataaaaacatctgtatactcaataaatactaattaagcatttactatgtataaagcaccatgctagatcctgatgatgataaaaaggtgtgacatagctctgaaatccagctttttctcaactatcatgacccatccaaacacatgtcatttctttcctttctttttttttttttgagatggcgtcgcactctgttgtcaaggctggagtgcaatggtgtgatctcagctcactgcaaactctgcctcccgggttcaagctattctcctgcctcagcctcccaagtagctgggatcatagatacgcgccactatggctgtcaaatttttatatttttagtagagatggggtttcaccatgttggccaggcttgtctcaaactcctgacctcaggtgatccgcccgtcttggccacccaaagtgttgggattacaggcgtgagccaccgtgcctggcccagatttcatttttgaatttctctttcatatttccattcttaataccatccgcatcaagttaaaaataaataaataacttttctaataaatactttactgactgacttgctttactgacctgctaccttcttacctcttaatttaaatctcttttataaattaacatcagtttattttttgaaatagtattgctaattgcttctctattcaaagaccttcaatgattaagtgactgtctcccaaattaagaatttatggtaacttggactaccttatgtacaaaccaaccctgtacttcaagcaaactggagaatttgcttgtctcccaaatactcccaaattattttcatagaagataaaatttaatatggctctgaaaagataagagcaaattttattggcaggattttgatgaggaaaggcaaaaaggcacaaaatttggttttcaggagtaggttgtagatccacttatataaatggaaagtcactttttaatattttttttttttagcggaagctgatgcatttttaaataccactatgtcttatctctttgtctcttgaattaaatctccagataaatacagagcacaaatcacatagtagaaattaggactattcaaggtcagtgttaaaaagagattagataagttctagtatcttagtttattaaaaattctatgaaatgcaaatttcctttaacaaggagtcacataaattcacaaaagtagaaaaatgtaatattaatgtcataagaaagactgcacttagtaagtgtcttggtgatattttgctatttatcataaattgtgtcattctatctttatgagaaataaaatcatttctcattttttcaaaatttaaatttaagtaccgggatacatgtgcagtacgtgcaggtttattacataggtacatgtgtgccatttacctatgtaatagatattgtattacatatgtaattgtatatttattacacattgcatatgtaataaatttattacatatggcatatgtaataaatttattacacattgcatatgtaataaatttattacacattgcatatgtgtaatattacatattgtatatgtaataaatttattacatgttgtatatgtattacatatgtaattgtatattgtattacatatgtaatacaatatgtaatagatgcatctattagcccatcacctaggtattgagccccacatgtgttagcattcatcctgatgctctctctccccctggctccctgacaggcaccactgtggtgagctccccttcctgtgtccatgtgttctcattgttcagctcccacttataactgagaacgtgcactgtttggttttctgttcctgcattagtttgctgaggataatggcttccagctccatccatgtctctgcagaagacacgatctcagtcctttttatggctacatagtattccatagtgtaatgtatcacattttctttatccggtctatcattgatgggcatttggagtggttccatgtctttgctgttgtgaatagtgctgcaattaacgttaagtgtacgtgtatctttataatagaatgatttattgttctttgggtatatacccagtagtaggattgctgggtcaaatggtatttctggttctaggtctttgaggaattggcacactgtcttccacactggttgaactaatttacattcccaccaacagtgtaaaagcattcctctttctccagagcctggccagcatctgctgtttcttgactctttaataatcaccattctgactgctgtgcgatagtatacgattgtggttttggttcacatttctctaatgatcagtgatgttgaacgttttttcatatgattgttggcagcataaatgttttcttttgacaaatgtctgttaatgccctttgcccagtttttaatgtttttttgtttgtttgtttttgtaaatttgcccaggttccttgtagattctggatattagacctttgtcagatggatagattgcaaaagttttctcctattctgcaggttgtctgttcactctgatgatagtttcttttgctgtgcagaagctctttagtttaattagatcccatttgtcaatgtttgctattgttgccatttctttttatgtttttgtcatgaaatctttacctatgcctatgtcctgaatggtattgcttagattttcttctagggtttttacagttttgggttttacatttaagtcttttttttttttaacttttttaaaattttatattttaaatacattttgtccttttttttttttcttttttcttttctttttttttttttttttttgagacagagtatccctctatcacccaggctggaatgcagtgcgtgatcttggctcactgcaacctctgtctcttgggttcaagtgattctcctgcctcagcctcccaagaaactgggaatacaggcatgtgccaccacactcagctaatttttgtacttttagtagagacagggttttgccatgttagccaggctggtctcaaactcctgacctcaggtgatccacccacctctgcctcccaaagtgctgagattacaggtgtgagccactgcgtccagcacatttatatctttaatccatcttgagttaatttttgtataaggtgtaagtacggggtccagtttccattttctgtatatggctagccagttttcccaacaccatttattaattagggaatcctttccccattgcatctttttgtcaggtttgtcgaagatcaggtggttgtagatgtgcagtcttatttctgagatctctaaactgttccattagtctatgtgtctgtgtgtgccatgctgtttggttactgtagccttgtagtatagtttaaagtcaggtaacgtgatgcctccaggtttattctcttcatttaggattgtcttagctatacagattcttttttggttccatatgaattttaaaatggttttttctaattctgtaaagaatgtcaatggtagtttaatgggaatagtatttaaactataaattgctttgggcagtatggccattttcatgatattgattcttcctatccatgagcatggaatgctttttcatttgtttgtgtcctttcttgttttcttgagcaatggtttgtagttccccttgaagaggtccttcacttccctctttagctgtattcctaggtattttattgtttttgtagtaattgtgaatgggagttcattcacgatttgactctctccttgtctattggtggtgtataggaatgtttctgatttctgcacattgattttgtatcttgagactttgctgaagttgtttatcagcttaagaagattttgggctgagacatgggggttttctaaatataggatcatgtcgtctgcaaacagagacagtttaacttcctttcttcctatttgaataccccttatttctttctcttgctcgtttgcactgaccagaaattccaatacaatgttgattggaagttgtgagagagggcatctttgtcttgtgtcagttttcaagaagaattcttccagctttttcccattctgtataagatttgctgtgcatttatcataaatggctcttatgattttgagatatgttacattaacacctagtttattgagagtttttaacgtaaagggatgctgaattttatcaaaagctttttctgcgtctattgagataatcacatagtttttgtctttagttctttttatgtgatgaattacatttattgatttgtgtatgttgatttcaccttgcatcccagggataaagccgacttgatcctggtggataagctttttgatgtgctgctgcctttggtttgccagtattttattgaggatttttgcatcagtgttcatccaggatattgacctgaagttttctttttttttgttgtatctctggtaggttttgatgtcaggataatgctggccccataaaatgagttagggagaagtccctccttttcaattgtttggaatcatttcagaagaaatggtaccagctcccctctgtatctctaggagaattcagctgtaattccatctggtcctgggcttcttttggttggtaggctatttattactgccttactttcagaacctgtttttggtctatttgggaattcaacttcttcctggtttagtcttgggagggtgtatgtgtccaggaatttatccatattctctagattttctagtttgtttgcatagaggtgtttatagtatactctgatggttggttgtatttctgtggggtcagtgatgatatcccctttatcattttttattgtgtcaatttgattattttctctttttttttattagtctagctatcagtctatctgtcttattattttttttcaaaagaccagctcctggattcattgattttttgaagagtttttttgtgtctttagctccttcagttctgctttgatcttggttatttcttgtcttctgctaccttttgggtttgttggctcttggttctttagttcttctagttgtgatgttagggtgtcaatttgagctcttcctagcatttttatatgagtatttagtgctctaaatttccctcttaacaatgctttagctgcatcccaaagattctggtacattgtctctttgttcatttctcaattttttaagtggtggttttatgcttagtagaaacagtaacagcaaaagaaataaaaaaatataactttggtttgtttgtttactcattccttatctcaagcctactccaacagcctatgaagatggcagtaagagtaaagttcagccatttctgtgatttatctatccacatttattttttttgtagacactgtcatgctctgctgctctgtcacccatgcttgaaagcagtggtgttatcgtggttcactgcaggctcgacctcctgaactcaagagatcctcccacctcagcctcccagatagctgggtctacaggcgcacactaccacacttggctaatttttgtatttttttgttgagatgtggttttgccatgttacctaggctagtcttgaattcctgggctcaagcgatccacccaccttggcctacgaaagtgctggtattacaggtataagtcaccattcctggcttatccacatatgtttataataacggttataaaaaacaaacaaacaaaaaaaactggaaagttaggtcacttacattgacaagaaattgtgggtatctgtaagatttataactcaacgatataagattttttaacccatgaagttctttggccaattaaatttaacaaaggaaatggattttcaagtgaaaaagaaaagaaagaggttctctatggagaattttacattttaccacccatgtgaagattataactatgtatgagagtcatttttgaagttgaaataattgaaacacaagagcacggattaaagtaccaaatcagacatggggcaggtaagtgtcaaatcttttttcttttgtatttggttcaaaaaattctatctttctagactaaaattacaaggtggttccaatttgcacatcagatccttgaacactcaggtccccaatctcaaaataacctcacatttgaaacatacgtccttaagctctgaagtgaaaatggtggagaaaaacctataaaacagaaaggatagaacactcagaggtgaagcaggcttccaacttaaaaattcccagttctagggtcattttaaaaattttaattcattttaaatgggttattgtattcaaataaagtttgcatgccatctgttttcaaagtcatttaaattaagttttatgactcatgaggaagagaggccatttttaacacattatagtctgcttattactatcattaactaattaaaattaattattaagagtgattccttttgctctcaaatcttctagatcatttatcaaagaatgacatgactttctcttccttccttggaatactgaagtcacagtcatatgacttttgggtagatgctattgaaatgatgattttagtcagatgtttaacagtaacgctgtctaaaagctacatttaaccaagagagcagtatttttgaaacagcaggcagtataaaactgctttgtgaatattaacatattctagcaaattagtttgcactcattatcataagcaattgcttactgtttagatgcagcttgtattaaattggcaagcaatttgcaagaattaaaacataacatggagagctttctgaaaactcagcaatatcctgggagaaatgatgctactaggttcacagaccatgtaccaaacgtttttacccattaaacatatttagcattagaacaatagttggttggctacataggtttttaatgtaagatcattttctaaccgctgtttggacaccatcaacagaattttatatatcagacatttaaagactttgttttaaaaagcctgaggagaaagtaggaaggctttgttttctaaaaatgaactagctatcaatttgactaaattttgatacttcaataacctattgcattgtcttgagttactttatgctacccaatttgtccctttcacaaagtttctgttgtcttgatcattctttccatttattcctgagttggattctgctgatgtttacccctatccactttactttctttaataacagaacttttgagtgtcagctgagcagatagataactgcgtagagcctacatttcccattctcttttacagcttgaagggtctattgactaacttctggccaatgagagatgagcaaaaatgatgtgtgtttattctagttcagatcctgaaatgtgtctgcattctcctgcccatttccctctttcttgcctagtgatgacaaaattgaatcagctgcttcagacttcgagatggaagccaaaggttgagaactgtacaatcctatcctaggacgactgaaatgtgactattatgtgagaaaaaagaatcttatactgtgttgagagatgagtatttctgggtctcatattgacagcaaagggtgtttatccaggctttgaaaaaaatgacctaacatttccatgtatttttttaaccttatgaggcaagtaaatttgatagagaagctattattatctccattttatggatttaaaagagattaatattcaaagagctaaaattatttgtccatggtcacaaagtaatgtaaaactttttctgtcaaaaccttccacaggaggctaccgataatctattacctttttaatagtaaactgaggttacctaccctgaataattctatgggaggtcacatgtatttatggatttccccattctgcaattctttgctccttaagaaaacaaaatttgcaaaacacagtaaaggatattgcttgtaatatgaaacaaagttaaaataactgacccacacaagcccctcagcttgaatagacagcatttactttagaaaacttttaaatactttctccaccttttgagatttaaatcttctcccagctttttgccagatttacggcttgaaaatgtctttctcaagggcctaggagtcatctatttgaaatgtaatcatcaaggaagacagtgctctgtctaccagtatctgaaagggtaagagcctaacctctggaagtgccaacgagtaattttttctgtactatacatataataaaggactaattaatgggaagttggataataaagaaaagtgtaatgtattaaaatctgtacatcagcaaagaaagataatttaaagagtatcgttaaagtgctacggagtactgagaaaagagactatccaaaaacaaatctagtagctagttttatggtttttcaaatgataaaattaaaatataaaacaaaaaatttaaattttttattgataaagtatctgcacaattttttttttggtttcccagtgcatataaaggttgtttatactataatgtagtctatttaagtatgcaacagcattatgtctgaaacaaacaatgtatataacttaattaaaaaatactttattgctaaatcatctgagcctttagcaagctgtaatatttttgatggtggaggatcttgcttcattgttgatgggtgcttactgattagggtggtggctgctgaaggttgaggtggctgtggcaatttcttaaaacaagacaacagtgcagtttgctgcatcaaatgactctacacaaaagttttctccatagcatacaatgctgtttgatagcattttaaccacaatagacttctttcaaaatttgagtcaatcctctcaaaccctgctgctgctttttcaactaagtttatgtaatattctacatccattgttgtcatttcaacaatgttcacagcatcttcatcaggagtacatttcatctcatgaaaccacatttttcattcatccataagaagcaacttctcatttgttcaagttttatcatgagattgcagcaattcagtcacatgtccaggcttcactcctagttttagttctcttgctatttctaccacatctgtagttacctcctccactgaagtcttgagcctgtcaaagtcatctatgaaggttgaaatcaatttcttccaaattcctattagcactgatatttttaccgtcttccctgagtcacagatgttcttaatggcatctagaatggtaaatcctttccagaaggttttcaatgtactttgtctagatacatcataggaatcactatctatggcagttataactttataaaatgtatttcttaaataaggcttgaaagttgaaattactccttccttgggttataaaatagaagtgttatcaaggataaaattatattaatccccatgtatatctccatcattgggtgacaggtgcattgtcaatgagcagtaataatttgaaaagaatctctatttctaagcagtaggtctcaatattgggctcaaagtgttcagtaaatcatgctgtaaacagcatgtcattcactctttgctgtttcatttatagagcacaggcaaagcacatttagcataattattaaggaccctaggatttttagaatggttaataagcattggcttcaacttaaattcaccagctgcattagcccctaaaagagagtcagcctgtcttttgcacctctgaaaacaggcattgacttttctccttttcagctgtgaaagaagaagatacctacatggcatcttcttcaaaaactatataaagctgttttgtctacactgaaaatctattgagtatagtcaactttatcaaattttagctaaatttttttttataacttgctgcagcttctacatcaggactgttgcttcaactgacctggaaggggagtagaagatgtgccattcactcagataggaaacatcagagaagaaacatgatgcttaagtaatataaggggtttgttatgttagaatttagctaccttcctccaggtaagcataccacatcatctctacattcctacttagcatactgaagtgtacatggaagacttttttttagtatcctgctaattaatcaagtaaataattaagaagacatcttcaaatgaaaactctgccctcttttgtagatttttgccaaactcaaagttataaacacaattaactcctcatctcttttaaaatattctccaaatgtaatatttagctttcaataatacctttccatgaaacacacatgaattggctttatctgaatatttgcagtgttccccttttttccaaaaatgttaagaaatcattttatgaaacaggtttcactatactatattgtcccaggatgtcatttgcatgtttactatttggttttctaaatacatttatcggtacaagttattgtacttagttgatctgcttcctctactcatcaaggtggtttatcatttgtggtgcataggtgagcaataggatctagtgtaacgcgggcttaggttcaaacccctgcatgtacagatgaaattgggttatctgcacttcttgtacctttcaatagtgggaggagagaaggaaatccatcactactggaaaatatgctctgtactctatcaactctgttgaccctcagcataaaatattttaaagcatttccctaacaaacaactctagttagacaatctgtatcataaccactacttttatctatgagacccctctgtctcttagaacatagtggtcatgggtactggtagcccatatgatgcctttaggaaaatagaaaaaaagcaaatctccaaaaccctctacttctgcctattgaaaattttcatgatttttgtcagaacaagacatttgcttgatatttcctagaaaattgtcatattaaatatgcaactccattgtgaaaacagtataaatggtgccaccttaacaagtgtacaacttgcacaaacatccatggcatccttttagtaagatgtaggaaatgattaggttttgggttaagacggagactcaacacatttggaccctgttgttctattggaatacaaccacactcctcagagggagaaaatgcaagagacacacaaaagaaccataattcctattcaatcactttttttaatgcaaagcaaacaccgatgacaaaagaagttcaagctttttttttttccgttttttttttttttttttttgaaagaagccgtcttacagagttgaaataagattagtcacagacctaacctgtagaaatgaaatttctgaaaaggaagacagtatcagagcagtgttaatccaagatgtatgaagaactaaaccatagcagcttaagccatatatttgaagcacagatttcagcaagacaaaactgtgacttgaaaaacgagacactcaaaatcctcaggagatcagtctcttctcctgttcctctacggctcctccaaagtacagattcaattttgagtcaggttaaattgggggctgaagtgggaatatatggttaatgaattttgtacagtcttccttcttttcaattgaaaaagaacagagaaaaaaaatccctcaaaaagacttcatgggttttactaagtctttccaacatttccccccagattgatttcagatcatgtagagacaaccagactgctaattaaactattaactctttcttctaaattgcaaatctttgagcatttacactgtagaagccacctcactaactctgaagccccgaggaatatagactttccatagattgggagggaagtaacatacacattaccctaggccaaatttgaccctgaaaatgaagtcatatgcactaactctcaaaatatttaattatttttcccagactttgcttaacaagtgtatataacaaggaaagcctctaaggtacgctcagagagattcattttctcctggagttaaattgaaaggtgacacaatgaaagctctgttatgattcttttgaaagcagcaagattatgttctcagccaatgtaatgtatagctgacacagaataaagtgttggccaaaacagaggaaatgtgctgaagtccaaagcctccatagacttaagtcacaagacataaatatacttatggaactctaatgccctaggttattgtataaaagtgatatgtgtgttaaatttttaaataaaccaaccaaaacagtgtagcaaattcagctccaaaatagattcctttaattttgaaagatatgttaacaatatagaaatatgtaaaaatactatttcttttatataaagtgaattctttacctcttccatcagagcagtgtctacactctaaattcattaataaattctccttgtcctatgtgaaaatgagtaaaaaataagattgcaaatgtggaagttctcaaccttgaatcaggaaactatagatctagtcctaattccttgctttgtgactttgccaaagttattgaaactatacaataatcctcattttcttcttctgaaaataaaggagtttttccaggtaatttatatgggcatctccagctctattctgagtttaaaatgtcactccaccaaagccggcgttaaccttgaacttgattccagagtacactgagcatgaagtagaaagttaaatttatcagtgaggcaattcagcagacaacatgcaatgacttctttggtttatatttatttcattcttatttgactttcaacaaaattgcacagaatgttttctgtattttatggctgtgaaacaacacagtagaggacattttattttgcctagcaattctttctatgattaaaattaagacataaatacagaagaattgaatagtgtatgggataagcactgctagcagttaactttttaattttctaaaatcatataccctacatggctgttctagcaactccacccaaaatcaatataatacaaaatccatagaaatagtagtctaaaaccagttccaggtttattagaacctagttatgtaattactgaggtcttctctttttaaatctataattactactgttatactaaaaaggttgggttaaatgttattaggcaaaaccaccctggctgatttgttttgtgaatacatgttaagataattcctacttagaagaacagaatcattccaagctgaaattcttatgagccttagtaggttctattgtcataaatatgactcagatccagaaagggattcattaccctattctagcagtcaattttagttgtgaaaatataaggaaaagtcaaagcatattctctacagatgtagctgcagtggtgtcattttcctccatgcttctggttgagaaaaaccaggcatcgcctcaatggtccacagattattaattcccattgtaagataatcctgccaatgttcaccaaaattatagccatttcttcttttgcatgtgttcttatgtgttggagtttttggcaaagaatttaaagtccttcatagatacccagttaaataatcctattactcattccctggtagattaataccttttgaaatgcccttagacctttcacatcatggaatagaaactcatgttttcttctgagttacatgacagtactccacacactggctgaattttgtctatcatctcactttttctttaaagcactaattggagactacatggcaaggtgatgatcatttttaccaagaggaaaacacacatacacacacacacacacacacacacacacacacacacatacacaaacagcaaatgacctgttcagtgtcataaagttggtgagcaggaggaacacataggtgttccttctgttatttattcctcagatttgaaagttctgcccttcatataactgtcccatactgaagcagtagaaccaatgtacttatggtaaggtggcactgtgtgtactctcaacaaatgttaattaaatggacttagggcaatctcccctctcacctatttgagaggtccaaatgacacaaattattatttttatataggtagctattaggtcttcaaacacatatgaacaattctgattgggatcattcatatgttatatataacaaataggcttaattacagttggtcattaaataatatatctactgcagaaactgtggaaagtacaaaattaaaaacatagggacttaaaacaggtgagaaaatttttaagtgatttgaccactgaaggtgaaggaaaataaataaagagaagaataaaaacaataagaacaataacattggttcaagaaatcagagtatgcatccttttagaggtctccaagctgtctgtgccttccatcttaacacctagttcaataacacgcctgtttagagggtggcagctacattcaaaggagtcaacataactttgtatcactctattgattggctatttggcttgggaccagcatagaccagaattggtctagaggttgctctcttgctttggagatcatttagcaagtgacatcgtgtgaaatcaatggcctgttactgctttcatcattctcaagttcagtatcataagggtccttaagatttaatgaacctagtctgttgagtgaagctttcaacctgctatatttcttctaacataccaaaatggcttgtatgggaaatgattactatcttatgcagtaggactgtgcaatctaagacttatcaattaaggataatacggcagtaagataaacatttaaattagtttttcaataagatgtgtatttatatattttccttaaagaaaaacagtgaaacagctctctactggctaaaaaaaaagaaacaaagaaaatcagtcacaattgaacgcacacatacgcacatagaaacagaatagataacattgtagaacagtcgctaggtctctggagattcattaacatttcatatccaaggagactagccattcattccttctaaaacagaaagcattttcaaagcaatatccatgtacaggtaaacgacaaagcaatcattttgaaagaaggtaaattacggtcagatgggtagagaaacaaggaggaaatgtcagacattctcatcagcagaaagaggcaacaaacagcaaaatatatatcatatatatgttaaatatatgtattatatatctatgtataataaatcaatgcaagaggtgaatgagaagtaggctgtcatgttctccagcacaaggatgatctccctaagtggtacaatgaaatgaagaaactcccccagaatattataacacagttatatgtcaattttcttaacagatttttgagtgttctgtacacacggcaggaagaacattgtggaaacatttcagtaaagagttataatctaggcctctgtctcttggagacaagaagtgggaacaagaccatgagtctcatatcaagaccacacatctattttctttggaataatgtcatcactaggaccagcagaagcttgactaatcacatgtgaaattaagtcaggggtcctagattttttcaagaaaacaacaataacaaaataggagtttaaaataattgatgggtatagcgcccaaagcattaattacatgtagaaaggttttttaaagaaaacctttaaaatttccagatgccagaaaattctttttttccaaaaacatttgatatgggagtttaatagtatcatatgaagaagtatagaaacttctccatttctgggggacttttcatagagataggccaactcaccaattctaggtttcctcatggtgggaatatatttgcttactggtaaaaaagtcttgggcaaggacaacaaacaccgaaaaaaaatgtgtactctgatctgatcttgaattcccagaaacaagcaacttcctgttaattaatcctagcaaggccagagactcaggaaagggcagctcttttctacgtgagattaaaactctctctacatatattataggtgcaccatcagaagagactggtctaagggcttatcataaagaggggagagtaactgcactgctaatctctccaacaaaagtgctactgtgattacatcatgacactataaagacctggataagtgttactgtattaccacatgagttactagttcctggacagaatgcccaagactgtttctgattcatttttgtgaaactacttccaatagcaacgaacaaagaagaaaaatacagaaaccaaaagcaagacatagcacaattcttcaggtaccaatttactttatcaagttttcaccttataaaaacagaggtgatatttggacacaagaccagaaaaagtcatcttccgagcatatgtcctcctcaccacactcattcacacttaagcaaatacatttcacccagggttcttggaagccagcattccacatttagaaataatttctttggcttaaagattggctattcttacatcttcaaatgcaagagaggagcaagttaaagctagaaaaacggtcacacaaagatagaggtttgaggaccaattttttattttatttatttctttgttattattattattattattattattattattatttattttttttttttttgagatagagtctcactctgttgcccaggctggagtgcagtggcacgatcttggctcactgcaacttctgcctcctgggttcaaccgactcccctgcctcagcctcccgagtagctgggattacaggcatgcaccacaacgcccaggtaatttttgtagttttagtagagacagggtttcaccatgttggccgggttggtcttgaacgcctgacctaaggtgatccacctgccttggcctcccaaaatgctgggattacaggtgtgagccaccactcctggctgaggatcaattttgagatcacttgactccagtttttccaagaaccaccctgaaatggacagtgtgaattcaacataactaaatatatattatatactataaatgtatatataatgtttataaatttttatatatgcattatattttattataattatatattatgatataactctataatatatataatttttatatatttagttacatataaaatatatttatatatgtatataaatacacacacacacacacacacacacacacacacacacatattttctttctagaagaactaaggtaaagttgcgtttgaaaatggtaataagagtgtgtggccagaaagaaggaagcagcaagttagttgtcaataacactggccaaggcaaactctgaccctgtctactttccagcttttgtctttcctcgatactgctttgcctaacagactcttccctggcattaatgactccgctgtgaagaaggatggtttctagtttagtgacacaaaaagatacgtttggtatttaagaaagcataaagggagcataactccattcacctatgtcaaaattacttggataaacaagtatagaaaacattagttattcttctttattatagaaaatggataaaactaaaactcaacttcatctctgtgtacagatagcatagctacctagggaattaattatttaatttgtgcacaccttatgatcatgcctcagaaaagaactgccagagcaatcccttgtataggctactgtgattctgtttttctgaggctaatgtgctctgtgaggttgtcagaaaagaaataataatcagttatttctttgtttaactggagaggcagatgaataaagcatataagaaaggtacaaggaaaagcagcttaaatataaatacaagctagtcccatttctgactttgtgtctacctttgaccaatggtgaatgaatttccttgtcactgtttctgcattttgaagaaagtaagctgtattcatattttttctcagaaatactatgttaaatgtattagtgtatgtccttgataaacaaaatgtaaaactcagaagaagaataatgtttatggtacatatatttcttcaaagtaagaaagaactattcatttcaataatgccacaattgaaaattgagccataaacatcctgaagggccccaaagttgaaaacaaaaatgaataagactaccaactttttaactttttcagaaggatgaagctgcttgcattctttggggagcaaatgttaggcttttttcctatttaaattaccacaacattgtcacgatctgacattcgatttataacaactaatcaagaaatatttacctaatgcccatagcatatgaggtattatagggaacgaaaatcttacacactggatatttaagacccctattgagggtaagccaaattagaagtaaccgttgtataaataatgctcacattttaaaagcactttatgattttcaaaatatgtttcacattggtcacttcatttaacagacattatcttatttgaagtccaagaagagagagatccagaggtggaagtgattaaaaaaaaaaatctgtgaatttaaggccaggcacagcggctcacacctgtaatcctagcaatttgggaggcagaggcaggtggattgcctgagctcaggagtttgcgaccagcctgggtaacatggcgaaacctcgtctctaccaaaatacaaaaaatcagctgggtgtggtaacgtgcacttgtaaacccagctacttgggaggctgaggcacaagatttgcttgaacccggaaggcagaggttgcagtgagcagagattgtgccacttcacttcagcatgggtgacagtgagactctgactcaaaataataaaataaaaataaaataaaattctgtgaatttaaacctgagctggcatttgaaagaagagttgggcttgaataagaaagagaagaagccaattatgactgaaaattgctttgttctttaattttcataaacacataatttactagttccttaagtacacaaatatatgctttcttattatcctacttaggcttagtactacacccaacagtgacctggggagcacatactgaattaaccaatagggaggatttgtccttctgtatctattttgatcattaacaggacactttacaaagtagctggggagttcagagtatagctcatggctatggaatataattgagctcacagactcagggagtcaatcccttcacttaaggttcattagcctgggttccaaggatcccagggggcgattccttccttttctgaatccccatagcacacatcacccagacaatgtctgtaggacaactttagcacttcaaatgaaatattgtctgtgagatctttgcttttcaattgattcgtgttatctttgtcttacctcccaattaatctccagagctccttgtagataggaactatgtcatccagattctttatctaggccacatagcttctagccaattacttgacaaagcataggtgcataaccaatgtcttctttgtgcctctgagttgcaaacgcagttgtatatctacgttaatgaaacgatgcttcatgcctgtattttaaaaactgatgcctagacaggtgagtaatgccaagcagactatgcaagctcttgtggtttctgattatcagataagagtcgcttaatttggtaattgtgacattgtagatatggaaagtatagtaaaagccaactagtgcagaaccctcattttttacatggggaaacagacttagacagggaaagtgccttgcctaagatcacaactaatattgtgcaagaatctgttgtgggctcagcatatggtaggcaattatttcaatgaataaagaagtaccagatgtgggtcacatggtcccctggcactccagccgagaaggcaacttggtgttatttctatgagtccttgcaggtgtggaatactgtatactcttccctttgctgtattgtttctgccaaaataattgtattttgtagctgtattttcacttaaatataaaagcagctaaaagatagtatgcactgtatttcccaactttgtatttaagtccatgattacgtctacgtatttacacagattccttttcaaaatacttacaaggcatgcaccaaaataataacagattatatctggccaatggaattcttggtgactttaatctgactttttaaacatgtcaacatatctccaatattgtcatgaatatataaacaaacattaattttatagctagaagttaagtccagtaaaaatatgtttttaaaaagaaagacactacttctacacctgccaaaagcctgccgttttgcaaactagtcgagttttctcatgatatataaattagcgcaattttgaaaatgtaaatatcaattattgtgttacaaaaaaacaacttttaggatgtgggaagcagaggttctgctaacatagagtttaacattgagccttaaagaggcggaaaggtctaatttgggaaaagactcgttccttaaattttactctagtttttctttctatttccctccataaggaatttataaactcagactttaaattccattatttggacttacaaaaagcacattctgttaaaacaaaattaaattaaattaaattaaattattagattaaattaaaaagccctatctgcatgataactatcccctccgtttctgaccaaagtctcacagaacttcccccattatgtgttgaaggaaatttgtatttcaaggtacaaatgagaatgactcaaaaccatgtgggagaatcccagatgcattatatagattaagtgggtgtggtgataaaaaagattaggggttaaataaaatggttgctggtcaccatgagcctcttattttgtattactaaaattcaacctaccatcatttgtaacatgagcgtggggaaagtaaattgtgaattgcagactattttgtatacatatgaaactttaataattatagatccactagctagactgagaaacactaagtacttctagaaaatattgagcgttgtgagaatttgcttaccttaagtagtattactatttgtatttggagtcctctaaactatgcaaaaggatttaaaattggagatctttactaattaaattgtttattcatcctttctccagaaaaataaaaggtatgtctcagctcaatatatttcagaactatcagaattttgaattctaaaacagatttttcccattatacacacagtttatcgacaccgtgaaagtataacgtacaagcaaattatatatttatatgtaaaatgcatatagatatagtttttttttttttttgaaacagagtctcatttgttgcccaggctggagtgcagtggtgcgatctcagctcactgcaacctccacctcccgggttcaagcaattctcctgcctcagcttaccaagtagctgcggctacaccacacctggctaattgttgtatttttagtagagacgggttttcaccacgttggccaggctggtggcgaactcctaacctcaaatgattcacctgctttggcctcccaaagtgctgggattacaggcatgagccactatgcccggccatatacagatataggtttttgaataattgtctttcaaatactcatgccatttatgggtatgtatgcaattatatgcacaactgcatagttacaatgatataacataaatgaaaacaattcagaatactaaaaagtgttactcataagtaatatagtaaagtagtgtgaacactactggacaatattgatacaaaacacaaaaatgcagtatttcacattagcttttaggctacctgattgaaatgaccttttaaaactcttgtggagtctgataattgaacttagctaccaataatggaaagtatcatgatttaaagaggacagaatgttgtattttgtctacaagaaaaaatatattttctgtctacagaggagtataattaagatttagtagaggaaaaaccagtgataattgtcatattcctctctttcactctcagcatccaaatgatcactcaaaatggtcattttttaaattggtgcagtgcaactaagagctattttaggaatggttatttccataaaattctattctattttcttcagtcttactgaaaatggtgctttctgtctaaaccatcaaggtgttaaaacatattaggacaggttgaaacccaatgagagcaagtgacacattttaacaagattttataggtcactgtcttgcaaaaatgtaactcaaagtacatttatgggcacacaggaaaattttaacaactgagaaacctattcataaatcttgtacttattttaaattaatttattagattatatacatgactggcattgctaaaaaatgtaaacttgcctattttggtgaataacagtacaataatggtactttccttttccttcataaacaaaattttttaaaaagacaagagaaaaaaaatcaaataaaactaaagaacagccaatctatgaagaagtatttcctatggactgcactgaaacttggacctaggtaaaggacgaagcactaggtcaaaagccacccgagaggtaatggactatgcagtctgagttcctccaagggggggtcacacaatcccaaggatagacttaatatttatttacagaactcaaagtgcttggaattggggaaatgggtgtgaggacaaattgcaggagggtccctgaccttggggagcaggtctgactcagagaacacacaggctggctgttttgcatgaaatagatgatgatttagcaatgtggcggagaaaacgtagaaaacaagaagttctgtaactctccattttggtcaaccaaagagaagtacattctatcaccacaggtcagacctatgacaccagttcactatagacctaccatctgcaagtggagacagccacaggaaaaggtgttttggtaagggtggagaaagagacagtaggagaaacgtagctgactgcttctttagtttaccactactatattagcattcaataaaacttgatactgaaaacaacagctcccattgaacaactggaggtagaaaaaagtggcaaacagaaaataaataccaaaaatttttccaagatttagccagaaaatattgagaatctagtttcaatgaagtcaaaagaaaacacagattctctgaaacaagagtctgaagaagagatgaagaaagtaaaagtagactaaaagcaggaaaaaatggaagagtaaataaaactatggcataaataaaatccactccaacagttaattcttcctctttcaatagaggctcaatagatacagcataaagtgataatctccccaaaagggaacttaaatatacaaattacaagaaataaaaggaaggatcataaattttccagatttagaataaaactgcaaaaacacacagattgccacataaacacattctaaaaatgcatgctacttattaaaagagaaatttaaaaagaaacccttaatgaaaaaaaatgaatttgtaatacataaagaatttttacaaccaataagataaaacccaaaaattcaattaaaaactgggcaagtctgcataggaagttcatgaatttaagaaattgaagaaacatcttaaaaaacacataaaaattttaaaagaagtggctctaaacatacaaaaacatgtccaaccacctagtaaagaaagatcaatgaaaacgacattgaggtaccattggcaaatattgaaaagattgacagagagcgttgggcaactctcaacactgttcaaaggaagggaagtttggattcaaatacattggaggaaaatttggcaatctaccaaaatgaaaactgcacaacattttccccccaataattacatttttaggactttatcatacaaatgaactgaaacctgtttatataaatagccagtttaattaggccaagcctgcattaaagttagttctcaaatgagttaaacagtttccattttccactttcttttatttgtctatgtcttaacccaaaactcatgcaaaattttccagcatgatctctccccaaaatgtgagtagatgaaagatctggatggtttgtgttttcgagtgctattggtaaatcagaaattttttaactttaatgtgcaaatctcatttttacagtcccttattaaatttaaatttggtataaattgaaggagctcactatatttaaaataacaatagaattgaaaacctgacataggaagggcctgatacatcttaagaaaaatttagtcaagtataaccttaatatttatatacacaacccaaagtccatgttaattccacttggtattactatataaaagagattattatttatgcagccaaaaaacatatgaaaaaaagctcatcatcactgcttattagagaaatgcaaatcaaaaccacaatgacataccatctcatgtcagttagaatggcgatcattaaaaagtcaggaaacaacagatgctggagaggatgtgtagaaatgggaaggcttttatactgttggtgggagtgtaaattagttcagccattgtggaagacagtgtggctattcctcaaggatctagatctagaaataccatttgacccagcaatcccattactgggtatatacccaaaggattataaatcattctactatgaggacacatgcacatgtatgtttattgcgacactatttacaatagcaaagacttggcaccaaccgaaatgtccatcaatgacagactggataaagaagatgtggcacatatacaccatggaatactatgcagccataaaaaaagatgagttcatgcccttcacagggacatggatgaagctggaaaccatcattctcagctaactaacatcattctcagctaactaacacaggaacaggaaaccaaacactgcatgttctcactcttaagtgggattgaacaatgagaacacatggacacagggaggggaacatcatccaccagggcctgctgggggttggggggctacgggagggatagcattaggagaagtacctaatgcatgccgggcttaaaacctagatgatgggttgatgcgtgcagcaaatcaccatggcacgtgtatacctatgtaacaaatctgcacattctgcacatgtatcccagaacttagagtataatttaaaaaaagagactattgcggagactgaaaaagagatagaaggaagaaaaataaactaaaatctgtaaaaatagacatcacttttcaatataaaatgtatctcaaactttctgaagatattgcctccattttttaatctctaaaatgagcataggctggctgccaaagtccacaatgtaaatgttaacaaattatagtcaaaaatgcctttcaactacttaaaaaaaaacccataaaaatgtagttagtagtcgatgttgcctaaatagagtctcgaagcctacaatctgtaggctgtagaagtgaaccaagtcaaaatttaaaaacaggcttctgtacaacagattttctctgtatacttaactcacattagaagtgtggcatgtgttacaaaattgatgtcagatagcttagaagacttcatatgttttgaatgacaaggtattgaccatggtttctgcaaaagaaactaagcatcataaaaacagatactttaaacaccaagaatatcatcactccatttgttctgctcctttagaggtcctgtgtaattggaagtgaggctactggactacaatgttatcttttacaatgaactaccaaatttagatgtcagagtgacagttgaagaaaattgcttgaatgggaaataaatgaacagtcacagaataaaccaagtctacttgcccaggccttgtgttattaactagagggatgattactgcagcaagaagtgatagcttataaaaattctatgaaaatcaatatagatttgcagattgtaacttcaacaaagatttgatttgtcaaatattagtctaacttgctttattcagcacatgcatttctaaaattattaaagacaaatattcatgattgaaatctaaatgcaatattttttagaactcttgtttttaaatatttaaagtttcagacagaaaaaaaaaaatctattcatgggtagttgtcttcacttactatagtcccagaacataattgttgccccttgacttttattcgaagatttggcttccccacacaaaatttgtctttgtctaacacagtaacactttatgatgtcaattaataattattgattcattgagtcccttctaattcacttacattaccaatcagtagttcattttggtagaattcattccttatgtttaggtaaatgtggaaactttcttccaaatacagctccttcaaatttaaaagaaaagtgcctaatctttgtctcctggatttttggcacgtagttatcaatagaacatagtaaacatagcagtgaattgctgtataactatagtgtcaaaagccatgtttgtttaatgtgcctgcattctgccaaataaattaaattgttcaatcactgtttttgatgataataattatcatattattacccattcctaccttgcaaaaaaaaaaaaaaagcccagtctgcaattttgctggttaatttaaaccagaaactaaactgcaaaatggaaatatttaaaggaaagtagcctttgtattcaagcagggcttactcaaccatagaaacgtgagaaactcaagaacaaccacaacaaaaaaaggcttcttgatgcttcttttgattctaagggggaggtttctttagcttaattttttatattattgcagggaatccttcaccttatcaaaaccacacagctgttaaaaaataataaaaaataagaataaaaagcctaacactcattgtgcttgctgtctctttggaccaataaaaagcggaaagtatgagatgaacatgatacaagtatgtttatataacgggaagaacattaaaaggtagagtttctgcaaaaatgaaaatacctcaaacaattaagtttgttgctttaaagcaagattatagtgtagggcttgagataggaattcattagatatttaaaatgcagcaattattaagtctgtgctaggatcaagttttgcaatgggaatacttacccttggatctcagaggagaaagaaatacatccttctccattagagacctcagctacatgatagtaacttttatttaaaattttaaaaagaagagtgaccaaggtgttatacttattgtcaaaggcactttgcttccctagcgaaaacttgacaacattgtaatctttctctaacagacatgttgcaaagctgcttgccatcttgtagtcctatatgatttccttgcatttccagttctttaggaaatcccctgttttaatgatctttaagaggggaaaagacccttcaatagagaacttgctatttatgccaaatttgaaaaagtagccaaataaaaatgggctataaatgaggtctctttggccatttcaatccaatatagtcttacttctagcccccctgctttgactagggctctcatttcatgtaagcatcatggatttgatatttacctgtatgacaaacagttctacagaaggatagccttaccttttaattaacacagttagctacactatgaaagtagaaatattcgttcagaatgtaagaatgtttttaaaatattataactctctctgtataaataaatggagtttaaaacaacaacaacaaaaaaagcctaacatttgtatttagaagatacaaataactcaggagccacaaaacaacagtcgcctgttaagaatcctattaagaattctgactttttctttactttaaataagtaaataaataaatgttaaaaaatggagtataacactctactctgctgcttgctggctttcctaacaatgtgagcagttgacattgcttggccaagaggaactcaaaaaggtccgtccttccttccttccttcctccctccttcccttccttccttcctccctcccttcctccttccctctctccctcccttccttccttcccttctttttccttcctttcttcccttctttttccttccttccttcctttttccttccttcctttctcttcttctctctccctctttctctttctttctttcttagccaggagattttaaggagtcagtgtctagaccatctttgttttgatcaccaagctcagtagtcaatccatagatgaactattttagaaaaatattttcatgtcagtttgtagctggactgctttggtagcacacccattaaagcacaaactcctttaaattcacagtgctttgtgtctgtttatacaattcccaaagcataaaaatttcaggattggagctgaagggtgcacccatctttatttttctgcttttgatgcacccttcaaattgcttcacacccttctatacaatctaccttgatcagaaatatgtatttatcatactattaggggaaaaaagaaacatatgttctgagtggcaattaagttaccagcactgttaaggtcctggttattttatgtaatctaccatataactcaaaacatccaacaatattggccaaagacattgaccatagatagtgctttcttatcttttcctttctctctctctttttttttttttttttttgagatgaagtctcactctgttacccaggctggagggcagtggcaggatcttggctcaccacctgccaggtttaagtgatcttcccaagtcagcatcccaagtagctgggatcacagacaccacccaccaccacacctggcttttatatatatataatatatatatatattatatatattatatatgtattatatatataatacatatataatatatattttatatatatattatatatatatatatttagtagagatggggtttcaccatgttagccaggctggtgaacacctgacctcaagtgctccgccccccttggcctcccaaagtgctgggattacagatgtgagacactgtgcctggccattgatcatagatagtacctttaaaaacgtatctcaatctaccacttctaatctgagtgaaaccgtttgaattgggtccaaaggttaatcaagggcccctgtattttgttaatatgaactctctaaagggctttatatttacgatttgttttaagctgcttactaaagcatggtggaacatattttacctgctaaaaaatattctacaaaagcatcaaaactgaaagatgaaaattaggccttactgagaaaagaacccctttatgtccaaaacggtccaggataggctggaattcaattatagtatggcaaaatattgtgaacaggctgagataagcaacagctcgaagacttcttgggttgattctagtaaaaaattatttaaactacaaaataacttaatgatgtgtcactggcctgacaaaccattaaaataatctagaagtagagatttaattacaaataaagcacctcttaaaatattaattcctaaaataaaaatgacatgcttatccaattatatcacaatccactcatttcctcttcccaccaggctgaagtttctctttttatattttaaggcttaaaataacatgggtttaaacattttgatatctgtggcatcatttgtcagggactatcctattttgtgggaaccactcttcaaatcattggcctgtacaaaatacaaataatggtgttagtgttactacttgtaccttttccaccaaatgacccaccagttgcttatcagctgatacagttatctataaaacagccctaaggtactggtcatcatcaaatttataataatatcactgtcaacattttctgttaaagaggaaaatagatcaatctaaataataacagcttaaaagttacaaaatgcatcactataatgtgtatcttaataatgattagaatttcacataacatgctagcaaaatacttttgacatgaggaaaaaatgtttaaaactgaataagaatgtcctaaaatactgtatgcatttggcctcctttttcaccaaaatttaacttttttggttgtctgccccaggatcataatgaccatgatgattatcctagtttaggtaatttattaataaggtaatgactcattaattacaatgtttacataaataacatatcaaacaactctgatgaagctttataagtaaatcaaactgaaaatgtgctctgtgattttactaaagacagccacaaagctttaaatagtgcttgtttatagaccactttgaaagaaaaaaaattcacttcgtatctcttgttgacaaaatgccaagaatcattttcaaattagtagcgataaaatattaagtgattcataaatcataatggaaaacagaaaagttgaagtaaatataggcttgaaaatattatctcagaggggtacaaaataatttcaaatggcagtaacactaagccacttacttgaattttaaatgtgaatttgtcttgaaattgtagttcaggtttccctccaattaagaaaaagtattctattaaaaagctaagcagggcttgcataacagatatattaacgcctgtaatcccagcaatttgggaggtcgaggcgggtggatcacgaggtcaagaaatcgagaccaccctggctaacacggtgagccctcgtctctactaaaaatacaaaaaagtagcagggcgtggtggcgggcgcctgtagtcccagctacttgggaatctgaggcaggagaatggcgtgaacacgggaggcggagcttgcagtgagccgagatcacaccactgcactccagcctgggtcacagagcaagaatcagtctcaaaaaaaaaaaaaaaaacagatatattagaagtcaactattcactttaaaaatgcattattaatttatgaaatgattattaataagattgttttaaataaatgggatttcaagttgaaaatctcctgagattttctgaggttaccccatatcagaagcacacccccatatagccatgtggcatggatcctgatgaacctcagtctttggagtttaacaggctggggttggaatcccagctctgtcacttgttggccaaatattgtatttcatctattggaagctcagcctcctcatctgtaaagcgggagtaacaaaggcctaccttaaaaacgctttgaggatagcctgagacaactatggcacatcataggtagttaagtggtgattacattggttaacattaaatcagagaaaatactatgattcaggctctgacggcgctctaattgatagcttgggatctccctcccaatattctcccaagtccaaagtggacataggatgctcctattgagcctttcctgagggaagaatatgattaatgaaagggaggttttcctgtttttgtttggtttggttgttgttgttttgtttgtttgtttctgttttaaagtactggagatttgtaatttattttgaacaatgtttcaaaagggtgaaaaaatatacatttcagggaccatgttaaatggaggccaaggaaaactgtatttttattattttttattaaaaaatccataataggccgggcgcggtggctcatgcctgtaatcccagcactttgggaggccgaggcgggcagatcacgaggtcagaagatcgagaccatcctggctaacacggtgaaaccccgtctctactaaaaatacaaaaaaaaaaaaaaaaaaaattagctgggcatggtggcggcgcctgtggtcccagctactcgggaggctgaggcaggagaatggcatgaacccgggaggcggagcttgcagtgagccgagatcgcgccgctgcactccagcctcggtgacagagcaagactccgtctcaaaaacaataataataataataatccataatagtagaacaatggcaacatcacaactttgttctgtcctttttgtttgaaacatgaatgtgctatggagagccttagtgagtgaacaaaaccctctgcttggattcaaattctacctttccataactataataaagtcgcttaactttttttttgtgggattgttgaggctcaaatgagaaaacacattagaaaatatctggtgacttgacaaacatataaatatgagatactgttattattaatgataaagatgtgttcctggtccctgcactaaggaaggaagtgaggaggtccccttccacaaaccaagagctcaaagatgataaactgttcccaattaattcacaaattcagataagtaaggatcgcaaaaatgagacccagtcatctcagatttatttgttggtgcaaaatcttttagaatctgaatctgtactatgatcttgaagtttcagtgctcaagaacaaaagcaaaagtggtttctattagcagtagaaaacttgaactccttcccaaacatctttaaagactcatcatccttaaaataaacatatcaataagacagagttttaaactctatatatttggtcttgagaaaaaattttattaatattgagaaattaattccattgttaccataaaattagtcatttcccaaaagcaaagccctacttcatgcctgcagtatgaggcattgatacatttaatcaaaatgtcttacagttattgctttttagttttatggtctttgctgtgtgtgttatataacaacagttttggagcactacgtcagaagtaggaagcagaagatgtggctggaaagataggtagagcctgtatcataaagagctttatatgccatgctaaggattttgaaatttaccacttaagtgatgaggatctaccaaacagttttaagccaaggagagatgtagttctatttaattttaggcaggtcactcagtcagcaatgtagagtatttttaagacattaatcacagcctcaaactaagatattacagttgacccttgagcaatacaagttggaattgtgcaggtccacttaaatacaaatctttttcaaccaaattctgttggaaaatacaatattcacaggatataaaatctgagtgtatggagggaacacttctcgtatacctgggttccacgggaccaacagtgaaacttgaatatgcactgatttgggtatgatgatgaagaaagaggtcctagaactaatccccccaaaattctgagggactattataattaagtttgacataaatggtatagtttgggtcatactgttgacttcaagtatttctatttttatattatacttcctttcataatgggaaatcagatgaattctttgaaaatatgactcaattccaaagaaaatccaagttaaaatttttttccacaatttgttgactaattggagcagcaaaataattttgagtagtcgaggcaaacagatatccatgtgctttgagtgttggcaatatgtatcaattaacaatattatcaactctaatctcactttgaagtcaaagagtaatcaaattaaaatctttggcacaagttaagaacatagatctcttttaccatggatacttgcttaaactctttgagtcatgaataatttatctgtataatgggaacaataagatatttcacctatctccttttatttttgagacttgtaagctctgtgaaggaacactgtatgccttcttcattgttgattgtcaagctcccatgcctcctggcacacagtaggaatgaatcaagtgaatataaaaaagtattaccaaatgaaataagaatgtgaaattgttctgtaaaccttagaagtatcatacaagcattagtgctattgtttttgtttcacctattctgttattagcctccaactttttaagatgtactaaaaagacaataatctttcttcaacaaaatttaaaactaccatctctgaagatgcatttatgtgttaaaagtatttttatgcaaatgcttaagaaataatgaggagttctttaaaaattgaatctgctgcctttctaaatatctttcttgtttaaaacacaaaatacatatgccaaaatgaatcaataacttccttgtctggtacagaatgttaaggcttgaatttgaacaaagaagctgaacttagctttggatatctattataaaagatatccaaatgaagaacgcattgacacaatcgttaattagtattcattatactactcctcaaatagaacgatatcaggtctcctatatatcagtgattatttctcttagcttatccaagtttttccttttctactgcacataactgttacacatttgaatctgtaaccaggttttatgatttaatatatgctctgactgtaacacctatattttctgactaaatgcctcctgtatttcaatggacatctcctgtagcccctattaaaagtccctctccctatatccattcttctcagaaacaggctcatttcttctcaaggctagatttggagaactctaggtaaatgccaaaacaaaacaaaacaaaacgtaaaacatctttctctctctccttccctcattctctttccatgctatacttttcctaaccagagtaaagttccttgggagaagtgcttattttcttcaccttgccacatcagcaaaagcaaagtgatgcatcacaaatggtattacagattcctatgattctgagtcttcaatgcacattcatgattgagacactgctttctcttggaaattatggtgattctctgacataacactggtacagtgacctttgaggattctctgtcaacagtcattgatgaaagataacaataacatttcagttccttaaaagtggtatttctcttcatgtcttaatccaaggccgatactgtaccatctacttggaatctcttactcatcccttctcctccctttgcctaatgaacactgttcactcagcaaatgacagtccaaatgatgttcccctatggaggcctttgctggcctccctcactaggtcagggtttcccattatgtgacatcacagcatcctaattcttcttctatgacacttaggatggttttaaaattacaacaccttggggattcttttaataatggctgcctcccacaacgacatataatcttcatatggaaaaaggctatattttgctttccatcatccacgtaggggagtgtctaccacagaatatattgtagtcagtaaatgctttctcttctgtttatccttactcaccaaaccaattctagcctcctcccactcttatctacttaatgtagaaaaatcagtggggctaggcaagagattgttcttgatattttctgtttcttttcaaatttatttatttaaaaaattgtcatacaaaatttatatatttatcacatacaccacaatgttatgaagcatattcagtaacaccttgcttaacctcatggataaattactggaaactgcaactttcagcaaaaagatttataacaaaaccattttaccacaggctaattgattaaaaaaagagttaagttcctggtcacaaaaacatcaccaaacttctgtataaagactcaaaacacttctaatattaaacattgaattaaatgtgaaatatatatacatttaagaaagattaataaaaagataattatttatccaatttttggtgaatcaatgagtgatggcagttgtagttgtagtgggttaaatcaaggaataaatgtttgcaatgcaaaaattctaacgagcaccttctaaaacaaacaagaacaaacatggtgtgcccactgagtgctttcaaactgcattccttattgttgtgcatttgaaagattattgcaagctttatgaattttttattttacaataatttgtatttatttattcattcattcattttccaatccactcattctagttcagagtttgggatggttcaagcctatcccagcagctcagggtgcaaggtagaaaccaagcctggacaggaggccattccatagcagggcgcagtcacacacaaccccccacacacactcactcagactgggacagtttagacacaacaatgaacctaatgtgcacttgtttggaatgtgggaggagattggaatacccagagcaaacccctgcaaatatggggaaaacatgcaagctccacacagtggtcctgaccaagaatcattttttttccctcactaatgttataactaaaagactgagagaaacattattcaaggacctgttgtatagattgtaaaatggtcagatgagaagtatatattttttagatttttacttaaataaaaagacagcaggtagtaatttaaatgtttcagtatgcctacaatctttcagaaataacttcatgaaattcaactttacgaaatgatcttcaaaatacccatacagcacacctttcaataaacggagtttcatttgacagtgtataaaagagtttttttgaaaaacaaaaaaaaaacttgaaaaaatagcaatgcatgatggaataaggtattctcaactttcaactgttatagagaataatagaaaattttaacaaacagctacctaagaaaagatatatctctcaggtagatttttaaatatttttaaaattaacagataaaattgtatgtgtttaacacatacaacatattcttttgaagtatatatacattgcagaatgactaaatctagccaatttacatgttacctcacatagttatcatttttgtgatgaaaacacttcacatccactgtcttagcatttttcaagaacacaatgtattgttaactgcagtcaccatgtacaatagatctcttgaacttacttctcctatctaactgaaatttggtagtctttgaccaatatctcccaaactccaccaacaccacctcactcctaccccctagtaatcacaattctactctctacttctgagatcaacttttttcgaatcaacatatgagtgagatcatgtagtattcttctttttgtgcatagctatttcaattcacataatgtcccccagtttttccacattgttgcaattgacagaatttccatctttattatggctggatagtagtctgttgtgtatatatacctttttaaaaaatattcattcatccattgacaggtagaaaatttatgtaaagcagttaactagcaaaagcagttaacaataacatcttaatgtgccacagatattatgtgaagaggtagaatgataaaccaaaacaaacagccaattcatcaaatcaacaaaactagaaaaatctctgacatcctattattgatgtgagtacattaaaaaattgtgaggcaaagtgactgctacaaagttgaaaaaatacttcacataactcataaatatatagaaattcatattatcgcagaataagcattaagataaaattagaatttgcaattaagtgttcttttgataaatgggaaattatttttagctcctaagatacagcctggctttttgtaataataccattgctgctgcttcttcctcttcttcctgttatcattattttacaatatagacatgttgattttggcatttaagtgtaaattattgatgaatagaacttatattttgttgaaggtgctttgtaatttttaatattgtaaacatcatgatcatcaataagtacaggcttgcaaattacttccctacatgacttaactgagcttaatattttttcaacaagtatataaaaaataataatccagggaactatgtgctaaagctacttacgttcagtgctttacatgttttgtgtacctaggtctcacatttaatatcatttcctataatttcctggattgaaaattaatcagacagtgtcttctctttctacattcttcttctcaaaataataggacaaaaatgtttaatccttctttatggattttaacatgccattagtgctggaaagcatgaaaaatattacaggggaaggtaaccacaaatggataggagactaaaaattgacattgttgtcttccaaatgttcatataatttccattttaatgcttttgttttttagatatatttaaaggtatgttctcttctttacactgcccagagatcacattgtctgaatattagcaagtcttatttccctaagatggaaagtgcaacagagggaagatgactaaaaatagcacgtctctcaagatgtttgctttctatcacctgactctaggatgcagtcttcattagggtacaaatgtattataatggaatggtctgatttctgtttccatattttatgattctcatagtctaccacttgttaaatttaaaagtacattttaaacagatgaaaataagtgttagttgcttgctgataagaagatttaatttcccatatgttgcagcacgcttaattcatttaagaggtgatattcaaaaatattacttagtatgtattaaatttttatctttaataacctaggaagtttgctagcctattatttcctgatacatgaatttataaataatctggttatttgaatttggaatacaaagcaccctactgttgaggaaaggacctcgagggcatgtatagacacaacaaagagggaggtgaccaaaataaaagtatgtattattgatgcacaacctaaatacatctttgaggctttatccagtggaaaaaaaactcaaataaatttttctcttggatgttcaaacagcatgtaattatgttgtatcatatgaataactttccatcaaacatttactgaacaccaattttctaggagttttatttaacaatgaagctaaagcagtggttgtcaattggagaagattttacttccagggacatttgacgatgttgagagatagttttgattgccatgactaagaaagaagtgccactagcatctagtaggtaaaggccagggatgctgctaaccatcctacaatgcacaagacagcctacacagcaaagaattacccaccccaaaatgtcagtaatgccacagttgagaaactctcagataaagacataaggatgacttaaagggagataaaaatgaagaaagaataccttttgtattagtctattctcatgctgctaataaagacatacccaagatggggtaatttataaaggaaagaggtttaattgaatcacagttccacatggctggtgaggcctcacaatcatggcagaaggtgaatgaggagcaaaatcacatcttacatggtagcaggcaagagagaacatgcagggaactcccatttataaaaccatattatctcatgagacttattcactatcactaaaaatcacgggaaggacatgtccccatgattcaatcacctcccaccagtccttctcaggacacgtgggaattatgggatgtacacttcaagatgagatttgggtggggacaaagccaaaccatatctccttttaaagaggtgactgtactaaccctaactagaagagatagctccatgaattaaataatggttgaaatgagacgaaaagtcagatgcagagattgtagggaaagagcatagacaggatacaacaattgagcggctataagagaagctcgtaagaaaggtgaggaatctagggcaattcccgggtttctgcttttgatgacctagtagcaactcacagtatattgagatagggaacgtataaggagaaatagaactggatgggaagttagcttggtttgggaaatgacttagaggagaatgaataacatgtaaatggagccagttgcaaagaatataattatatatgggaatgtgtaaatctgtagagccccaaggttaatattaaaaagacaagaactagccatcaaataagttgaaattttacaccatagatattactattgactaaaagaggtagctgttaggtgcccttctcacaatgcaaatgaggagtgtggatctgggtagctgtgattacccccataatggtgaagttcccctctaagtcacttatgcaaattttagtagtaatgcttcccccatctaatattattctccacagaaatatccacttattcactgccttttcatatgaatgtgtggtataaagctggactgacagaaaaggtaccttaatagaaaccagaaactgatatatttgctaaagctctgtattatttggcttctttcctgctacatgaagtaaaggccatttcactgtattcctaaaggcaatttactattagctatgaattttcaggtaggcttaattaatcaaggtcttaaattaaattgaagtatttattacaagtatatgcatcacaaacatatttatataatttataaatagatttgtgtataatttacttgtctgcaaaacacacagtaccttactgctattgatttcaagtagaatcaagacacttggattcagtgcacaggaaggaaatatgatatctgtccattccataatcagctaacctttagcaaattcattaattttttaaaaggaaaaatataatatttagaattccaaacctcaagtggtaatcacatttcctgagacaacccagttattgttagcacttatatgctaagaaacaattagaaattaattttttagtgaaattagaatccaattaagcaagacagtaagttataatagtgagaaaatggctttcagatttgttcagaataaacgataccagacattttatctacttcagacacatgatgaaagtacaaactctgaaagttcacatttaaaaccaagaaaggagaaatcaacaggtgaagctcatttgcgcaaaataattaacgacaaatgagtagtatttctttcccataaaagaaaagattcatgtggcacttaattatttcatttacccaatacttcgcctgaaattgaagaagctctttttcaccagctgctaaacaaaagcaatttattcaattgggtttgctttgcatgagttgttctgtatataataagggaggaagaaaataaaaatgtgtaagtgccacacttccttccaaacatttttgaaagttatttgtggttccttgatacaagtcataggcataacaccaggcctgcactttattgtaatcattaaatttgtgtgatttgagtattctttcttattaataaactgagaaaataatgtctggaggaagagaaataagacagtgctagtttcctacgttctctagccagctaggcaacaagctctccatgaaggaggccaagccactggaaccacactcccactgtacagcagagaggactggagggggctgttctgtgggttcccaatcacctgttgctttggagttagaatgctggtttaggccaacatagaaatggaatttggttttaaagaaataaacaacagtggtaaaatgtccagatctcttctggacaaaacatggggccaagaaaggaatgtagctgttctagaaggcactctgctgcatgtggctgacagtctgactgaataatgagagctttcgtcaaatgcgactggcaaaggaaccctttccaaactgcattttttctcagggcctatttgcctgcagttgaggtgcaattacccgtcaaatgtggatgtaatgtagccacgtgacaccagcatatttctatttctagaaagatagcagagaaaaatcccctagtgtaatcatgttagtgtatgcttactgtcggaaggaaagggattttttattttgctcctggagttgaaccacagaagttgaaaaaaaaaaaaggctctgaattaaggggaaaaatctgatgttaggaaacattggctcacgtgcttcccactttcaggaactgaacagtttcaacaaataacctggtttatttttttcccagatgcatgcatctattaaagcatttctcttcctccaagtacataaatgaaatacgcataactattttaaaacgagttaagagtttaagcttaagattttatccttaactgcttaattgggcacccactctacactagatatcaaagggcatttgggccagatttgtaagaatatgttcaacaggcgatactttgccaggctgagaaatcaaggtggccagatgttcagcagtgcatttgcaacccatgaacccagctctagagaagcattcatccctggaactgagactccctgaaaaagccatcctcccatggatcacaagggaatttccccaataccagctagaaacaatttaacgaagcccgaagcctgccgaattttcaggagatgagtgtcctgctctctcagacatactgttctgctatttttccctaaggacaaagtccctaaataaatccaaactgacttttatttgaaaagagcaagtgtagattggtatgtccaggaacttaagtcacaggagcaataaattctagcaccctgtttcctctaaacaaaggggcctgcaaaggactattggtatttacgaggactgcagaggcttgagtaagcattttcacagcagccctgtaaggttctaatgcacagcagtactactctatagccagcttattaaaccttaatggcactcttttagtgttgtacaccaggacggtagataactcacccacagcgtggcttctggaagctgccacagcactgcaaccattctgcaggttaccacccttcaacttgaaattcctagatactggtttcttcattaaaatcaggagtcagcaaaccaaggtgcttggccaaatctgacccactgcctctttttgcattgctattagtaaaggaggttttttacattttaaaacagttgacaagaaatcaaaaaagaataatattttgtgacatatgacaactatataaaattgacatttcactgtccataattaagttatattggcaagccaccacacccattcatttaaatattgtctagggctgtttttgtagtataacaggtagttgaggggttatgacagagacttatcaccccaaatcctacttcctggctctttggagaaaaagtttgatccctgatttgaaagtactatcagtcattttcatcctttaacaggttctgaaatgcattactatcaacttaaaggaagactccatgtcagcctctttaaccactggtcaaaatgaatcatttcccaacagtcagatccattgtccccacttaagaaaagcatgcaagagctctgggtgggctaagcaaggatcaagactaaaatagtacctttagaaagctctggagttgctccagcaacatatagctgaaaagtagtatcactgatatttttttcaaactaacataatagaacttgttctcttcaaaggagtaactttgaaatttgttgcaaagaatctgccaatgttcaaaacatatttggagtgcacctttgatgctgcctttagaggctctttttaaattatcttttaaacaatctcaataatgccaaatcttgattcattatacttgagcttgattcatatttttaatcttaagtcattcagaactacaatcagtgaataaaagggagaagtacattgcctggaatagatggcgacctcaataaatattagtgaaacgaattgagctggttcgatataaagtgacactaatgcaacttaaaggaataaaaacctactgaagacatacatatccatccattatctgtgcccctaagcgtacataccccaagtctttctgattctacatttagttttcaaatattgctggctttctgggaatctgcatgattttatctgattctccactgccttcttccattcccaagcctgcctcattgtcctgcatagaactcgtctcagcccctgcttgacatctgactgctcgctctggacttcagttgtcacatctcttttccatctctcagaccacttctgatcaacatgcccatatagttatatacaccagtgatagttctcggcccaaagtgcctttcatattcacatacttctctgagggaagtagtcataggtttccacatgcatgatatggcaagccttacatcatgctaccctgtccatgatagactacacggatgcatatcgaaggtagccctgcatagggaagaagcgggggagacagggatctatgaagctatgtagcaaatgcctaaaagaacaaaattcaatactgcttcgtagatccctgtctcccctgttttcccacagcagggctacctttacatggaactcaagtagaacttttcttaggaagacatgatacactggtataagtaaaggagaaaggaaggagacataggaaatgagcggtctgtagaaatacacactgctattagaaagagcagtgcaccctcagaaatcagtcaagacagaaaggtgagccacagaatgatgccttcctggaggcagggggagatagtaaacttgcgagttcaatgaatttgctataatatcccaagtagtgtaaccatgttctagttctttaggatgcctggctgtgtgactgcaaggaaggtttcctgtgttttctcacattcctatttttcacagtaacctaaatgggtctcttcattgtaacctgaataaatctgtattcacagaaatgaaagtggttttctgttcacttactaacttggctatgacttcaggagcagagaattctaaaactgctttgagtaacatcagtgtctgtgcactaagtgtatataatcccagatgacttactaaaagaaccaaattccaatgaaacctttggtaaacttttccaaatagagcttcatgactttaaagctgcttctactggatgtgtcaatttatggagtaaaataaagtaagagcaaaaaattaatttacaatactttagggaatgataagacagcctaaattgccaggtagttatctgtatagcagtgtacattgtgtctaagtcttattttttaggaattgctcaatgtttctgctatgcttaaacaaaaataacaaattatttatttacagtatctgaaaacagtaacaacagagacatttatagatttatgatactttgtattctgttataaaaataaaataaatcagaaatagcaaatagtaatttattcatttatgtgtttattaaaaaagcatttactatatgctaagaactgaagacaggttgtataaaatgacttctctgttctggtgaagttcattgtgaaggagaatgacacctaaatcagcgatacaacaaagcatcaaggagggacacctgatccagcctggggtggagaggaggtagagtttaggaaagattttctggagaaggaatggtatttgatccaaccctgaaggatgaggtacatcctgccttgttgggacaggctgatccatgttgtttgatgagtaaaatatcagaacttgctggccaaaggtgcatcatcactcatcactgaagacacaggaataatggatctgttttatttccagagttactttattaaaatactaaactctcctgggaaagtttaaattacaagtctgtccaggtaaaaccttatccctatcagtcgatggaggaacagacgagacagaataaagagggaagaggaatggtttcttaggaattactgtttggtccagccctggctatggacatgtaagaatttgatttgggcaaactatattaactattggaaacactctgtttgcatgttaaatgcctagaaaggatgaatcatacatatttcctatgttccattttctgactctgttctttttcctgtttctgctttctatgccctggccttcctccctaccctccattgagggtacaatagcatgtggtatcaattaatgttaagttttgaaacttaagtttcagtaaactttgggtcagcactacaaagaacatctttatatctacatcttttaaattcaacctttgattataaggaaccaagagagtttggataggtcaatgaaaatctatcccaagtcctacaaatgtgacacaaggtaaattttttatgaaagatcattagacaatattgttcatgttttctatttttcttctactcaatattaaatgggaatatcacaaaatattgaggaagagtaaataattgtttaatattaccatctttagcaaaaaaaatcatttactactgtaatctctgaatagaaggaatatgagcaataaaataaatctgaatttacactccaatattgttgaattcaatcttgttcaatcttgttctataaaacatctttcacaaatgtgggctctgaattttattttatcctgtcattgcttaatttaccagattctgaaccagtcttttgggacatttgcagactgatttctaaggcaatctgacaaaaataacttgaaatttcaatgaggatgaagaattgctctttaaagaatgaggaagtcagtaggcataagggaatttctcacaaaaccgcaatgcagaccacttcacaaataactgggaaaattctaaatttttactgcactgaaagacaattgggagagaggacaaaccactacttacctgtaaaagcttcaccagtttattacagtaatttccctagaattcaccctaaagttttttgaatagagcagcacctttaaatctgtcttaattatcagcatatgcaaaatatagaatgattgctttacaaaagccattactccagatgtgcagactaggtgaatttcctctgtgggcacggcatttctaggcagacaatgttaatattcactatgactatataaagatgaatggaatgcttaggtttcacgcctacttgataagtaatcattttagataaattatagattgattacatttaattacagaactacaatgctcatacagtattctaagcctttgtcacttatccatctgactctctacacaaaggaatccctgaaaggataagtgagagaagcaaatgcttcaaaagctacagatttcatgcaattgccacaagagttgtgaacaacatcttttttgttctttcttttttaaaatacagatcatggggatacgagtgcagatttgttaaatggatatattgtataatggttgggcttctagcgtgcccatcacctgaatagttcccagtgtctgtcacttccctctgcatatccatgtgtacccattgcttagcttctattattattattattatcattattattattacttgaactcctgggttcacacaattttcccacctcagcttcttgagtagttggaacaacaggcatgcactactggctggctatttttaaaatacatttgtagagacagaatctcactatgttgcccaggctggtcttgaactcctggcttcaaatgattctcccacctcagactctgaaagtgctgggattacaggtattagccacgctgctcagccagctgccacttataagtgagaacatgcagtatgaattttctgtttctgagttacttagaatattggcctccacctccatctatgttgctgtaaaagacacagtttctttctttctttttttttttttttttttgagatggagtctcgctctttcatccaggctggagtgcagtggcacaaccctggctcactgcaacctccgtctcccgggttcaagcaattctactgcctcaggctcccaagtagctgggactacagatgagtgccaccacacccagctaattattttgtatttttattttttagtagagatgggtttcaccataatggtcaggctggtctcaaactcccgaccttgtgatgcacccgcctcagcctcccaaagtgctgggattacaggcgtgagccaccgcacccggctggtttgattctttttaatggctgtatagtattctgtggtgtacatgtaccatatatttttattcagtcacctattgatggacacttaggttgattatgtggttaacatcttcgatgatgaagaaccatggagttggcaatttggctatgaatacaaataagaagtagtgctcatcaggtaactatagcttgcttttttaattcacagaactacctttaaatatattttattgcctgtaccttacaagcatcagaactaaagctcataaagattataggtaacttgtacaaagctaacaggttgagaatccaagttcaaaaaaagctttactactttgtcataggaaattactatggacttcaccctaaagttaattcagctctgccctatttcaacgtttgcattctcttttcactctgccataatatttcacaacagaagtctcaagtgtaaagactcaagagaaacaccgggtggtaatttaatcaagacaaagttcctgggataactgtttatattaaaataattaaaactctaaaactctaaagtgtaatgaccatacaggtgatataaaatgtgcagctgagtagagaagagagatgtaacttttttcttagtgttgaggaagtctttccaaagagataattttaaaatgggttttaaaggatgcataggagttcaaccatgtataagggcaacatgggtgacctgagcaaaggattagataaaacaaaatccgggcacttgacatgctcagggatcaaatagtccaatgtggctcagggtttgtatcctccttaccttcctctttttgtgatcagcacatctcaatattttagctttccctaatcggcttaattttaatattaaaatattcaatattaatattaagattaataaaaagacaaaattttgaaatgacagcaaattcaatgatgaaattgccgtaagtgctaaagcaccaaagaactaaactaaaaacagttgcacctcttcttggctccctttcttcagggtcccaatatctttaccactgaaaattatttttttaaggcacagatttttcaggaaggaaaggaataaaattaacacaaattgaatagaaatatgaatagttcaaaattagacttttactctcttttagactttctaattccaagcaacactatccgacaggttatgatgcctcagtttgatgacagcttttttcttgaacacttgccaggatgaggaaacccagggaaattttcatgaaagacctcctaaaaattatgtgaaaattcaggcaagtatttgaggcccctgctagacttttttagtacatctgtaaatttacagattttttttttttatagaacaagcaaaatcaccaacttaaaacatccatgaacctgaacaagatattttatccaccacttctttccttcccaagagggagattctctctaatctcaggaaacaaatattttcctattgtgtggttcctcagacctggcttttgaaatttctgctaagtacacagttgtaatcatttattacataatctatttctaatgtcttattctacacataatgtttgtgaaatgcatgtagcttagttgtctgtggatatattccttgcctcttgcaagattcttaaaacagatttttatgattaataggtgtctctgttgctaacctcaagtcactcaaactctccttttgaaatgaacatttatttcagatagtacatgctctctgcggatagcctgtccacttttcaaatgtaatgtcctgtcttccatagatacgaaattttcaaaagatattggcataatgcaggagaaaatgccatccttttattatgttcaaaattgatctgacccctgaggtagcactttggggaattgggctacataatcatgtagaccctttcaggaaatggcttatttatggatttattttttatatacagaagatttcacacttctggctttatacaattgcatcctctcttcctttccaatatgtttccaaagtaggaaagctatatatggcaggagaactgaatttctatatcagctagaaatctgtcatctgctatatattggctctaatgataatgctttaagaatacatttatcccatatatgcatccagtcctctccagcagaacttttgcagttctcatttactgaataaagtaatgctaaagatagtgctatatcctggtcattgtccaatttttttttttttttaaaactgacttctaaatttattttttaaatgtctttttccccctgaagaattgatgtattttacactcttagataataaaagtttagtaagtctgcatgtgttttttctcactgcttagtttacatttagtaggtcatctttattgtattaaaatttaaggaaataaatcatattaagtacatattaaaaacatagtataaatatcaagcccttgttttgtctgaactttttattattcaaattgttctttatttttaaaagttaaaggaagaaatgtagttaatctgtatatccacataaagcaacacaagtagtccaactaaacccgctgatcttggttccagtcctttcgaaatggctatgttttaaataaaacctatttccttaggctaacaaacagtctataatccattaagtctttatgaacaaatccaaggcttttgaaattagtgcttggggaagaaagagtcaagtaatgaatttcaaagaattatgaaggtgattaaagaggaacaaaggatcaaactcccatcaccatgatttctagaacagagcctatcaaatgggcatttgggaattttatttatcatctaatcctgaatatgaaatagaaggtagagggaagaaggcaagaaacagtgttaatttagaaaggaggtgggatagagaaatagaaaaaagaatatgagagcaatttttctttaatggacatttgtaagctaaagagcaaccaggaaaaggtaataatactgacaaaaagagccgttgtttctgaagtttcaaaatgtcattttaactttttaagctggactgagtaaattgggtaagaccaccctgatcctagtgatgccagagatatcttagttacaaacaatggtttgagttatacttgttgtcacagaactgaaaattgcaaaactaattttctcttatgtactcaagtgtactatggaaaaacagagatactacaaagccaccaactccagtgggaaagtcatctctgtgctggctccaggagggtttatctgtggcagagacttaaaattgtcccattaataagctttctcattggcttccctgtctaggcagaattctgagctggccacaaggccatacaatataaagaaggaatttttcagtctcccttgcagctaagtgtgaccatgtgactaactctggccaataggatgtgagcagacgtgatgaggtccacttctaagccatgctcttaaaggggaatgtggtctttccctatgagaatggccatcttgtttttgtttttgttttgagacagagtcttgctctgtcacccaggctggagtgcaatggcactatcttggctcactgcaatctccgcctcccaggttctagcgattatcctgcctcagcctcctgagtagccgggattacaggcgcctggcaccacgcctggctaatttttgtctttgtattagagagggggtttcaccatgttggccaggctggtctcgaactcctgacctcaggtgatccacccttcttggcttcccaaagtgttgggattacaagcatgagccaccacgatcagctgagtagccatctttgaccaagcagataaggatgcctcatagggttagtgaacaaaaatacaaaaagagctggaactcctaaaaattctccagaaaagagccatctcacttgttcagatctggttattcagactctacatgagaagttagatgtaaacttctattttgcttaaatcatttaaatttcagcctcttttcctgcatcagaacttttacaataatagcaaacacactatagcccttaccatgtgccaggcagtgtcctgagtgcttttactatattaactcattacataagactataatttaaaacataacattattatttgtgtctacagacacagaattcaagcactgagaggttatatggttgatccagggtctgaatccagaaaatctgactccagagtccatatacttggtcataccatttagcacaacatcatacatttaacatatattaagggaacatttgtttaataagttaacaggtaatctgtctgtttaaaattgcataactgtgtttagaagtctcaacatcaacagattttttatgtgatctctgattttcttcttcaacaagggaaaagtcatcaatttagatggtaagcaatgtcctgtagggtactctgtaccctgcaaccttttatgtagccagtttctagcatctctgagaataccctggcatgtcagctactgctgagcaaagatgtgctctgacaatacaggaacacaagagaattgaaaaggagcacagatgaacagcatgaagaatcaagatgaggcccattgcctatttgttttccattctattagcatggtgcctactaagtgccagggaccaaatgtttggtgacagtggaagaggtatacaaatgaatgagacattctttccctcaaagaattaaaatccagcctcctttgagtacaaagtctttccaaagatctcttttgtgttcttcccttaactaataggcctctcgaggataagtcccagcaaatcatttttcagtggaatggaaaaaggggaatactgacaaacatgaagaaatatttttttaaaaaatttcttttaagaaccagaagttgttggggcaatgaagatatgtaggaaaaaaaatgagaaaaaaatataatgaagttagttttgaaactaagttttgtggcaattttatgacaaagattagggccatctctttgagatttttttcttctttccccaagtatcaaggaatgaatccttgaagtttcttttttgcagagatttaagttttcaacttttcaataatgaatagccactttgctttagataactttaattaaagtttcataaatgcaccaagagccatagggctttttgtattcttgaaataatgaataatttaatcaattaatacataatgggagcaaatgactaattgcagattcaagatacattttgtcaatcatctttattgacagttatagattacaaagtccaccataccaaaagtcaagaatgccttgattgacaattaattgctaagaccaattccattatcatgacttctgccctctattttccaatttggaaagcgtgttgcagtttcgatttatacactgggaagttgtattagtatcaactttagctcttatataaatgtggcattttaaaataaacattctcccaaattaatactttgtttctgcaaacatgagcaccaagcacatggctgaaaacatctttcattacgctagtttcaagaaaaaacactccttttcactgaaatttaatttgtaagacatttagggtatccctacactatatttttaattgaattttaaaggaaggatggagaaataacagttccgaatttgttggatatttattattttgaaaaataaatctgcattcatttatttgccatagtctaccaggccatccatccatccatccatccatccacccatccatctattcatttgttcatccatcaacgcatacatagatactttatcttttaagagtcaaaaaaaagtttttgaactaaagtccaaaaggaccttccgaactcagtctgcctagaacaccacgcttgagtcaaaaattctggaaatgtgttgctgtaaactcatcttctcatctggatctcattggagtaacataatccacattttcttcttttaagcatatacaaccccagaacacatccaatttgttcacagctatctgcataattaatcagtagtctttaggttcactccacacttaaattttcacatatctatgcatgcattggatacatacctcacaggatataatttctggacaaaagaatgttacttagaatgatgagcgtctgataaaactatggctatgctctcaatatcaagacagtttggctggtatggaacagacaaattaattgaaactcatgtaagttttattaatcacatttcagagtggccacatttctcttctttggctttatagtctttacagccaacttaagtcattatcatgcattactcatgacttgtgtatcatgtctatatacttccacacttggttatccctctgattgagagcactttgaaatcagtccctaaacactctgtgttataaatattctctgtaaacctttcatgtgtatttgcatgtaaataatgaaatatttgataagcagaatacaccacaaaaaattacatcaagacaaaatttattgaaaagcatcctgatttttgtcgttaaaactcataaaactagagcttaatcacctctagattctttttacaaaagttaggtaaaaacaatttccatttacattttttctacttactatcctatgacctacatagttcagcataattaataactggaaatttttgacctcctctgtgtatttgcaaaatgtaatattcccaagtataccttagcagagtcttctgtggcaaaaaaatattcactaagaattataatctagaaagcctttgtctatctatatagcttcagacaaaatagcattttatagatcataatggtaatgtaaacattcataacttaccccaattagctgaaagtcttgacatataagattacagccatagatcgatgaagatgcagcagaaaaggtatggcatatttagaaggctagttacactcatcataacaacagaaactaaaatatgtattcttttggttatctattctgggcacaccgaaataaattgtgaaccaaaccctataaagacaaacccaaaatgtacccagaactgtgcacattaggtaaatttttattagaatacaataggaattgaggacaatgcggtcttattaaataaactattaataaaaaggctgaaagggttgaagattttctgggctctctggagatttgaactatctttgattaaatgtgagctaaaaatactccagatatcaaaaacaaaaacttgtagtggtagcaacgaactataggtatatgtagtacttattcattccataccacaataattcaaaaattcctaggagccagctaatcccttttcagcatttgtgctcagggacttcttcactttttatagctgggtaatatataaacacaaatgtccctcctttttacttgaaccccagaggaaagcagttttacagagctatggaagcagatcttattaattaaagtctattttttgttcctctaaatttatcttttactatcagtgtgttgtgtgctaaggaatggattctaagacttatgaaatgggaagcatctatcacagtgttcaatgcatgctaaataaatgttcatcctccattaatataaaggtactcactgagaccgagtgtggtggctcacgctataatcccagcactttgagaggccaaggtgggcggatcagaaggtcaggagttcgagaccagcctggccaacatgttgaaaccccgtgtctactaaaaatacaaaaatcagccgggtgtggtggcgggtgcctgtaatcccagctactcgggaggctcaggcaggggaattgcttgaacgtgggaggcagagggtgtagtgagccaagattgctccactgcactccagcctgggtgacagagccagactgtcttgtagggggtgggatggggcggaaaaggtactcactagtttattaacttggtaaaattaaattgtatccacattaccagcaggcaaaacaagtgaagacttttaaaaaatgattttacagactcaagggctgattccttttcagaaacagaaacgagttacagagctttcaacttttatttatataatattatccccgtaaggtttaaccaagaagataaagtagatgtgattggcaaatcttttaaaacttgatgtacaaatgtttgttaaatatccagggtcctaaaaatcaaatagccatttaattttgtaaacatgtttttaatatagtcttgtaattccaatgatgatccaataactagatttaaaatttaaaaattcagtaaacacataccagaaacaagaaaaattttatttgttaaatttaagatttaagtcacaatttcaggccaatggattcaaaatactttaaatcttaacttgagtcattaacaattaatactaaatatccaatgccccaaatctcctttggtcctagattagctgatgacaaatgacaagttgattgctaataagcatagatcacaattttatgagaaagtctatttgtggcttgatattctcattaatattatcaaagtccacacttccaaaaattcaaattgcttttctgtaagaaacacaagacagagtctgctctaaattggtattcccaatgttcctgcccttgggagttataaagaaggtaaaaagctatcccttcttttccctgccaattctccgtccttccatgtgagaacagactttcagaaaataacattttccttctttcatgatcaatttagccctaccttattttttcttggctgaattggcccccacctgttgcctcctggttttgttaattaaaatgagacaagtgaaaagcactgacaacctagaccttgtgtgattattaaagaatgacaggtgctttggaaatcaaacctaacaccaaacataaagaagcctttagacctctatcttacaagataattacattaatcagtgaaaaactagattaatctattggggagttaagtaactgaaaatgggacaccctaaaaaattacttggtacaaaataagaaacaaatgtcagtgaattcattgagtagtctgggacttctttttaagtcactatggtattggtcttttactaataaaatagatgacttattaaagcaatatttacactgattaattcacaacggcagtacctgagacccctaagaaaacaactattcctttaaaatccagcctgaaagtagtgctcaggtgtacacactgagccttttgtctttaacttagcaaacactcagttcaaaaataattttgtcattcagaggagaagctattttatagataaaagattatgaatttcacagctgacttgagctctactcaggtcaacaacattggtttctactttgcaagtaggatttgttctgtcaatgcagatttctcagtaagtactttcccctttcaaagaaacatttacatttttttatataaatcaagtcactgattatattagctcagattcacatttgatgcacccttgtgcccctcctcctacacttcagctaaaatggaaacagactttgtttctaacttttaatactgacatttttgagtgtaatcaaaattccagagtgttggcttagatggagttctaaactgaagaaaggagtaagggctaaggtggctttttgtttttgttgtatgtattttcctattttataaatagttcttcagtttcctgtatgatactaacaatatgcatgtcatatattaaacaatatatgcattaaaaatgaggaactgtctgccctaatatgagcatttttttgtgagttttgttttgtttttttctgagatggagtcttgctctgttgcccaggctggagtgcagtggcgtgatcttggcttactgcaacctctgcctcccgggttcaagcaattctcctgcctcagcctcctgagcatctgggactacaggtgtgcaccaccacgcccagctaatttttgtatttttagtagagacggagttttacattttggccaggctggtctcgaactcctgacctcgtgattcacccacctcagcctcccaaagtgctgggatcacaggtgtgagccactgcacccggcctcttccttttatttagtttatgatttatccttattatatattttgaaagcttagagacatgtcaaattaggaaggatcaagaaggagcttaactttttgtagggggaggctctgattctgaatatctctaaagcctgaaaagcaatttaattagtcactaagtgggaaggctccatttgatgacaggctgtaaatggcattactcttggtcatctgagtagaatgcagaaaggttgcaaatgaaatggtaatggatttaattgcttattctgatattcataaaaatctgagatgtttctcaagccctgtttagactctaaacaattttatttttccttatattaataattagtgatcaggtcgaatacactgaagccttgtctatgtaaaaacaccatcaagtgactattttcatgactcctgacttactctcaactgcctccataatgactttatttaaaccatgatccattgaaatgactcatgaatttcagaggttccctttatcttttccgtggatttatacccaaagctctggaatagttgtatgaacactagaaaaaaagaaacagaaatgacaggttccaggtaatcaatgataaaactactttgaaaaccaagaagaaataatttcatttatggagttttatgagcactgtatttaagctgacattcaacttttaaaaattgtacgtatttaatgtgtacaacatgatgttttgacatatgtaatgaaatatttactgcagtcaagcaaattaacataaccatctagtcacagtcacagttaccagttacggttacctttttttgttgttgttgttggtagggagagaacttgtctcctgactactgtcttagcagttttcagtgtacaatataatatcattaactttaataatcaagctgtacattagatcactagacttatcctgaaaaacgtcaattgtgtatacttttactaatatctctccatctccccccacctccctgaccctgctaactacctttctactgtttctatatattcaattttttaaattattttttattttttacgtttttagagtcagagtgttactcttttgcccaggctggagtgcagtggtgctccttgcttactgctgccttgaatttctgggctcaggcagtcttcctgcctcagcctcccaagcaactaggactacaggcacatgccgcaacttccacgtaagtttttatttttttttaattttttatttttttccagttttttgagatgggagtcttgctatgttgcccaggcagctgtctaacgcctggcatcaagggatccttccacctcagcctcccaagtcttcaggagtacaggcttgagctactactacaatcagtgtattaaacatttttagattccacatgtaagtgagaccatgcaatatttttctttctgcgtccggcttatttcacttagtgttacgctttccagacattcattttcattgacaggcatcatacatgatgctaaagagcatggtagacagggagtcagacagatttgggttaatgatctgagcccaccactcatccaacgatgtgacctttaaatgggttaatttatcctagtcttgtgttcctcagctaaaaaatggggataggttgataatcgttaaggttttgtaagggttaaacgagacatgtttgtaaagcacttaatgaggtcagacacgcaggagctgcccagtaaatattagctacaaatttaggacctaacataaagggatctctcaagaaaatcactgaatgcaaagacaagtattttcttaatactttacagctgagtatttgatccaaggttctttcccatttatagatttgttatttgatgcatttcattttactttttatgcagatgggttggttagcccggcctcagttatcatttgaaactcaaaagggcagaatgtaaaacaagatattcttatgattccaaattgaaaaatacacaaacatcaatgtcttcaaaactatagagtttttactaggacacagtttttcctctaacttgatgaaaaatcaggagttctggcttccattggtatctctgacactaattaattgtgaaggccttggtctcctttatttgggatatgagagttttgacaaaatgacctcttaggtcccttcagtatgtctgaaaactaattcagaatgtaaccctaatgccgtttgtgaggaaaataaaagagacttttcccctgtatgtcataaatcccaacctgtgacaagttcttcacatgtgtaaaattctgtcctggttttctatggcagtccccatgatggaaactcttttagttatgcataaaatcaggccagtttatcacccagaaaaggaagagaggcgacatgcttccagcctatatcgtctagactaattttcttgttctctctgatgccactatgggacccttgccagctgcctcctaggaaataattattaattgcacttactcaaattagcctcctcctaagtccccttcaagatcacactacagagatgtcctgagagcctagcggaagcagagaaactaaaaaaaatgttcacaatctttcttcttccaaagaggttcctgcaaatagactcatgattaaaatggacctcataacatgtcagcttcttggaatggaccctccttccaaggctagaggcctgaggattgcttctaaataaaagaaagcttgctatgttttcagttccagatggtatatgtgcactaatagacagcaaattctaaaacgacatgcctctggcttcatcctggagtctcagaagcagagaagaaatgcattagaaaaggaaagagagagtatcttgctcttgtttgtgttgggatataccaaggcaacatttcaggcagcttacactgctcatagattattttgatcaaaattgttattgctcacttctttcatttcttggataagttaactgaccacttggaaccattccccttaaaatgggtaacaggaaatcctaggtcctctaactctcagcacatattcatagaaaaccaaagttgcaatactgtaaaaggagcagaaataactaactacaattcaatatatttcattcagaacgaggctttgaaaaaagcaatgatcctttgtgcccagggctgctcaatttgattactgcatcccctactttgtgaagtgatattttgtttctattttgattccaaactgctcaaatagagtcctcctcaggcaagtgtataagaatatagcatattttggcctcaaatgactcttattaaagaataataaatcaatttaaacattattattacttcaaaaatcaaatctgtaacaaatattaatcaatctgatacttctactgttattggagaacatttagtctataaactacattatggatgtcatggtcccatttcttaaaatatgtctaggtatatgcttatactgatgcataattagatatgtttatatcatatatatactgattcaacagaggagaaaatattcgtgaagacgagattaacacagcagacagaaagcatcacatcttaccttataagactgcatttataattaccatgtggtagaataatggatgatctttttcattattatgtttcttaataattttcaaattaaaatatttgaagaaaacaaatgcaatatcctataatttgtataacataaattccattttttccctagataatggcaaaggccgcatgactattaaaactttagataagtatgtacatatacacacaaagtagccttttttattttaatgtgggagaaataagctaagaagagtaatgctatctattcttctattagatagggttttatataatacatgcttacaaaaggatcatgttgtcaagggtacctcgtcttctctttaaaacaaaactaatttcaaaggttgcttaatcaaatcacaatgaagtttcatacttttcaatttaacaaaatatcacagaaaagcatgcatcatagaaaatcatatcttcctagataatgaatttccaacaggtaattttggagagtctctatttataagctaagaatgatgatttgaatatttaaagatatgcactgctgacaaataggagtgtatttatggagtacaagttttagttatctaaggtttctaaatccccaggagctcaagaatgaagaaaccatgcactgataatccgaacctggatagatgaattctagacagcaacttgtgtactcccctcacagccacagaggtaggtggaatgtataatacattgtcttgtggaaatcataagctcaaaaggaccctagaattatcttcattgctatctcatgatgaccttttcataatatgcagccactgatcttcacgtctcaaattataatagtcaataaagaatcactttatataaaaagtatttgacttatttcacttatttgaattccagggtagggagactgtttgcagggatatttagcttagctttcaaactatctgtggttcctaactgtcacaacattcaggagtatcctaaatatataatgaaatgtctgtaaacctaaataaatgttagtataaataataaatacctacacaattggaggaatagtgtcatattgaggaattaagtcaaaatggtttaatcatgaaaagctatggtagacactggggaatgaatggcaaaaataacagaatatagttagtgtccctcctggctttgagtaatatatgctgatgtaaaaatttttgattgttagtgttaaccactgtatttattcactaatctgtaaatttgacacaatggatttattaatgtaatttaatttacttggcatttcttctcctgagaaagactcctaatagatttaccctttaccagtccaaccaaattatgagatttctcccctatttctacctcacaggaggaacctggatatgcatagattcaggatcttagttttttacttttaatgaagaattatgctattggaagttgaacaaagatatgcagagttggaggacagtcatagtatgcaggggttaaaaaaagaaaacaattttgcaggcacttgatgtgggcatgacggtggtgtgtctatgagatggctgttctttgtgggtttttttttttcttttaatcttgggaaactttgcagtttttacacatgttcatagaaccatgatctaaatttcaatatagctagttttgacagtgcttttacattttcaacgcatttttattttcccctctgacaattcagcttattctattaagtgtacttccaacctctctctctccaggctctcatcctacacacatgttaaacctgaggtatgttttggaagtaggggatctcagacagtccatctgattttttgtcacatcctctcatctagtcactagaaaatgcttctatcagatttgtgtcataggtaagccaaatacatatgttgcaatttcagctacttcatttatcaccagctaaaaataaacaaaaacaaacaatggtaaaattaaaccaccctccatttcctgatcatataattttaagttttgatagaggcaggcagtgcttgagcactacataagcaacttgttagggcatgccacagaattctgatggagttcttggggctttcttgggagtcacttccttagaaagagagaatggaacatagatggctgtagacactaataatatatatcaagaaataagttaaagtatataacaacattatatatgggtaaatgctacaaaaaataaatcaagaagagagtgatatttctatgggaagatttaggtcaggaatttttttctgatgaagtcgactttgaatagagctccaaaactatagtacatattctaatatgtctagaattatctcatcagtatctattaatcaaggatggtgaataactacagtctcattctttttgccttatattctgctcactcttacttccctagttcccaccctaagctctcacgattatactattatgatttgattcttcactgacactaatattgctcctctgagtgcctaggatgagtgtttatttagtttatttatgcatttatgatgctcttgagtattttgacaatcaggaaccacagaaatgtgaggaaagccaagccaaatgcacttcaagcagtctccctgccatgaaagctgtgagccctgaagtcatttacctgataatctgttctatgggtgctagcaagcattagaccccgtagacatgtggtgctggggaggctgtaagccaaggaatctgggcaggtataacaggaaccgaagacttaagcagaaagctgacaagaacaccataccgctacttctctgaggtcaccaacagcatctcagtccaagagtagccagacccattaaacaaaagcataaatgatgggaatcagatccttttttggaagacatcaggattgctaggatatttagtgtctttagggaagaaaaagtatgaagaaaggcagctaaggacactggagacaaatgtctcgtgttttcatgattttacttgttaactttccactcggcagacagaatctgggcacagggactttgcctgcagctgtcatggggagctctgctgtaaatatattagcatataagcacagtatacaaggaatttgttagtctgacagcacataatgtagtttaatcaatataattattgaaaaaaataatttacacacaattgctcattcactcgagtatctgggaacctcaaagagaaaaagaaatggtttttctatgctgaagatgagagcttcagaataggtagattctggttgtaaggcagtcttaatcttaataatggaagatcttaatctttgatggtagacgctagtcctcctctcacataaatactgaggaatgctaagaaatgctagtttctgcagacatctttcctgcttcaaaaagacaagcttcactttgatctgtttcccatgtggactctgtatgatttctttcagagggggaaaaatgaagagagtcctgccactttaaaaaacaaaaacaacatgaaacaaacaaaacacctctctctaaaatctctagaaaacactccatccggcctttccctttcctcctcagctcaaatcagaagcaactcaccacaattaaaacaaagagtttccttctcatctttcatcactcaaaaggccagaagagctctaatccctcagagaaaaaaaaatcattccatataattatgggtgcattgacatcaatgattttctgagtttattttttaaatgccattgtttggtaaatgccatttctaaaatgtcattatttttttaatgccactaaaccacattaagagtggtttagtagcattgaagtgcaaatgaaaaaaaagaatatattttttgtaaatttaagagagtaagaataaaaggttcttaggactgtatactctccataagaatcatgaagagtaatgccgaagatcagagaaaactaaccagtatttataatgatgttcacttctattgtggcctgagccttggggtgtttggagcaatttttcaacccttctgagccttatttttctcacttttaaaatgagggtgttaaaggcaggtgatctcaacatcttttcccaacttacccagctttggatttttttttctggttataaaattattctgattattttttcttagaaaaaatatagataggaaaatgtatatttctgttaattctaccactcacagataaccagttcggtgtatattcttctaggtaatgcttgggttctttttttaaaagccataacgaccacaataaacacagtagaatctcttttctgctttatctctctgaagaatatgtgagcttttttttccccctgttttagtatttaagtgcttaacaattgaggttctggcaactaaaactgcacaggcagcagctccgtttttctcagaatcaagcgaaactgaacaggcaattaaaagttactgaactgcaaggtaaaattacttccctgctatgcttctgggtgactaaagaagggagacaatggaaaccatatttagaattaagatagaaggatggaacatagcagtctgctctactaaaatggaatctataagcattacacataatcagcagcacttcaatcatgctctttgctcacagttacatggaagattacacaaaacaaatgtgcaatattcaaatctgtggcattgctggttaacagaaggcacttctctcccagcccacacggtgatccaaattgtctcctgtacagtcagtgcccatctcacaaatgggctatgctccaagcatctacttgtaagctcattgttccattctctgtattaagtttctcatagaattaatgttataaattgtcctcagattcctaggctagcctatatgggccagcttattaaaaggcacattatcaaaaaataacatcaagaagactatgcaaattaaccaccatagtaatgcttcttttgaagttgtattcagaggtcaattgtggaagcacaagaatagctctcctcttctgaaaattactggtgacagtttccatccttagagacaaatggtaagacagaagaataaagtttaaagaatttcgggaattcaatcaggaggattcagggccagagatcaaggaaaaggattcacattgaactgggaaagcagtaaacggcatgagatgaaggagttggtagtatgcctgataatgcttaagaaaggagaaaatgattacagtatggagaaacagagccttcttctagggtatcttcccatgactttgagctcttatcttagttagaagcttggaggctataatatctggatgtcatctgttttccacactcagtagaaatgttgggggaagaggatttggtgaactggggtaaagataaaaatgagcagtggaagtctggggaagtattaagacatttccattccaactgaaaccttatgtctatcacctctccctccactgaggactctacctggtgacttgtattgggaatagttaagatgcctggaaaatgcagtggatcttgaaatgataatttcaaacatttaatagggtagctcaaacatcaaacaacaatgaaaataaataggaatgtggaagtcaagcaacggaagatcttgccacatgcaaccagtatagccatttgcacaataagaatcacattaaattggattaagcaatctgtgagaatctccttaggataatatttttacataacaagggaatcaacaaagcagattttataactgatgtcatgtaataaaatatgaaacccactcttaaaggttatgattctattggtacagttaagtataaatctgctggagatagtaaggtagtaagattaataagtaacaaacacatgttctgctataaaggtcacttttgatttaatgagaaatacaaatttgccgaaaatatgtcttccttctttaggaggggatggtggtactaaaatttaataaaatagggtaaaaaaatgtcaaaatatcaatcagaaaacctaaggtgaactgaaagcagttactgtggagtacagtatctactatgagatttcttttaggtaacttttttatgtcgtccaacctcaattatcaattttcctcaaaattacaattcgaaaataccaaaagaaaaaataataactgtttttgggatccacgaggacattattaaagagtattttggagttatatttgctgccaatatcatgtactgaatgttcagagaaatattttctgctctgcgtttaaaaatgacaaataactatgaaagacatgttactagacatggaggagataatcaaaagaccaaaatacatgtaatcactgttccagaaggagaggggaaagagaatggacaaaagactcacaattctacataattgattaattagacaaatcctaatatcaggaagcccagtgaatccaaagcaagaataataaaaagaaacccttaccaagacagacagacacatgagcaagaaataattgaaaatgcaaggaaagagatctttaaaacagtcaggaagaatgaaacagtagttagaaataaatgataactagatttacaactaacttttcaacacttacaatggaagctagagggcaatgggataatatctccaaaatataagagacaacagctgttctattacaattgctatacccagtggaaaaaaaaattcaaaatgaggttaaaataaagctatttcaaacaattaaaaaatgaaagaatgtactaacaaaagaccttcacgaatgaaacatctaaataatgtatataaaacaaaggaaaataatcacagaaaaaaacgtctaagatgaaagaagaaaagtaaaaccatggcaaacatctcagtaaatctaaagaaagccttactttgtaaaaatattaacagtgtttaatttatagagttcatacaacaaaagtcaaagccaccaacaacatgtcattccaaaaagatcatgaaaggaattgaaacattcaaaggtccttttattgtctgagaggaaaatattagttaacattagatgttgtaacctcagctattcatgttttatatttaatgatttcaaggtagaggtagaaaagtatatcttaaacaggatattaaaatacaaactataaagggaaatactgataatttaactatatcaaattttagaactccattcaccaaaatataccataaaaagactgaaaattccagtcacatactagaagaataaacataacaaaatataatgaattctaagcatcaataaagaaatgataaataatctaataggaaaaaaatggactaaaaatgtgaacagatatttcacagaaggggaaacacaaataacccagaaacatatgaagacatgtacaacatcattagtaatcaggagaattcaaattaaatcacaatgaaataccattgtacaatcaccgcactggcaaaaaatttaaaagtttagatgagaacacagagcaataggaagtcatcatcccccagtggacagcaggtgaatggtaagtaattttactaggaacgttacatgtgcatcctgtatgcattatatgtactgcaacaatactgctcctgagtctatgccctagagaaattcttgtgcatgatccagagtcacatgaaacagggttcaaggagcactgtttgtaagagcaaacactcaaaaccacccaaatatccatgagcatagagtgggttacaatattgtgattttttttcactcagtagaatgatacacagtggtaagaatgattaaattaaatgctataataaaccccaaacaagtttgacagacaaaaatgaaggaataaaactactattattccatttatataaaattcaaaaacaggcaaaagtaaacagtatatcatttactgatacatgcatatatgataaaactattttaaaaagtaagaagattataaacacaaaattcagaaggtagctagctatctcaggataaataagaggggcatacacagtgcttcagataggtactgctgtatttatgtcatgtgctggccacaaagtttttcaatttttaattacattttagtagacacacatgaattatataagttttaaaggtaaattattatcacaataaagaaatatttaatattgttaattgcagtttaataaacataataagtttaaattaagaagaaaagcttttcttttaaactaaatgtttaaaatttgggatttttattaaaaaatcacatttaaagaaacatggcaaaactggagtttaaatgggggttcttttctgagtcatatatttgcatagtgtcagtggaataataatgactctagttattctgactgaaagttgaaaatgtttgtttgtttaattattttagtttgtacttcatttttatagcattccctcacattaattatatattgtagttgcattatgcaaaatgaaaacaaataaagttagaaatactatgcttcataaaacgtagcataaagttacactggctgatactcacagtcatttgtatagccattgccttgaaatatactgatcacaagctcctttatctccaaaatgtctgaatgctgttaacatgagaaaaagacacctgactaacttgactgacctgcagcaaaattatttgttttcatcgaaaaggaaggtgccctcctctctgttactcacttttttcctttctgaactaatttctgagaaaattactcaattaatagcactaatttataaaattaattgtgtaatttgcctagattccaggcattcattagctctcatggaagcacctgtgtggagaaaactatcaggactctttggaaagaagacagtggcagacagtggcagacagtggcagacagtggcaccgtagcacctcaaataatgcaacaaagacccctacgcgagcttgcatcctgtcaaagaagctgttttctgctctattgaaatctttggcttcaagcactaacctcctctcatattcctttgtcccttaagctccaacttcactatgcaatcgtcctctctattcttgcctcctccagttctaactcaagtttcagtcttattagaaataggacatgctcactttggcaagacatggctccttttttacccagagggtaaagcactatagcaacaagaggtacacaggtaaaggacagtgttatcgaaacctaacatttccctaactatgcccaccctcactcctcatcagtgagcttctcctgtaacctggaccattccaaacactaacaatgactgagaagcaaaaagtttccacagccttctaacatcatcaattcaagtgcctaacaattctaatgagaagggtcttgaatgataatatttaaagctattttttcttattttatcagataaataatcaattttttaaaaaggtattcatttattcttatacctcaatcatatatatatatatatatatatatatatatatatatatatatatagtatatgattagcatcaggttagtctgggagtaggaatgggtttgtttgattaagaaataaaaaataagcatagtatcttactataaaaatgttatacttagaagagaatgtatacatttaaagagaattaaaatgaaaatgttttcatttctatatgttaatataatacagtgccaaacgatttggcaatggcattaagtgacacagaagttcaaagcacagacaaataccaatgtgagcaggagtcataaaggcttccaagaggaactagaaagagagctaggatttagggaattgatgaatggacaggagctaaaaacacagaggggaaggaggagggtatttctggcattggaaatcgaatatgaaattcagctcaagcatgtgaagataagtaggggctatgaccgtgaggtatggagggggctgatgccagtagctgctctgatgagaatatgaagagaagtaccacaaacactttgaagtctggctgtttcattcattgaactattggaatgtgcattgaatgccatctgattcaacagcaatggtttgtactcttctatcctctgataatttgctggcagcacacaccttctgtcatgccaaattactgcagcctgaaagttgtgtaggaaaatctgtggtggcaaattaagtccttgccatcctgaaagaatccaggcattcaggattgattattaacaactggaaagctgaggaagcaaagagaaaatcatcaccgtctacagccaaagtcccaaagccagtaaccatatagatattaacattaggtagcctcactggaacaaaagcattctttggtctctaaccacatataattcagagagatagcacagtatgcagaaaaaccagactaagtatcctggaatgcatgactctacaccaaagcgatatataaagtatccagagatacctagtatgacactgtcactggtccaacacattgtctgtattcctaaatctaagaaatcatagaactaacagggattatgttgttgaatgcagtatgtcccattagaacaaggagtgaagtgatattcactcactgggagaaataaactgcagttcgtgtctaagatatagaaagattcaccttttccatcctatggaccagtaacataatgtatacctttgaactttaaagagtttaaacagtgcatagctttataaatttgtagtgagaatcagggagacataaagttacaaaatgaacatttttttttcctaagtagcagtacttttcgagaaacggaaggtattgaatattcactaccttttaaaagatagcaaatgagagaggcaaggtgctttttgtttggttttgttttaaattggggaaaatgacaaaaattagcagttattaacttcacttttcattagatttaatactatcttccattctacaatattgtataatatcccattctacattgcactccattctaataataataaaataataaaacaattaaccagaagtagctaactagtatctatgaaaatacttacatgccagatatgacattaaatgatctagaaacattatctcatttaatttttatatttactgtaatatgtattatctgcccattttgtagatgagaattagctgagttatcattgatgcttagattagcaaagtggtctacctgtgatcacagacgtaaaaaattacaacatcaaaaaaaaaaaaaaaaaacagtctgtcatgtgcacttcaagcctgaaatggattaaatctagggactaaacacctactacctggtcagatgttacaatcaaagaaggttcctggagacaagggctaactagaaggttaacacaaggaccacgaaggccaattcctttttatcaccttagctatgtaaccgtaggagttgcctcaaaacaatcatttataaaggtgagaacaaacaacaacaacaaaaacccagaaacctccaaatacttcgtgattggaagagtgctgttgtggggtatgagcaagctggttgcatttaataatctgaccatcaagaaccattctgttcacttctgtattaattacagtaaaatgtgtgtaatatatctgatccctagaagatacctttttaaaagtatgcaaacacattttaaacaaggaattgacaacaatgatttcttagacaaggaatttttcaggtgataactgttttagaatgatgctactctgtaagtatgaaagttctctaatctatcactagattggctaactaatgaggatgagtagagacagaatatgaatttaaatacgcattcattccttgccttcaccaagatttatttgtaaatcaatgttattttattttcccattagttatatttgaagtaattcattccaaatatagaaaataattaattcttgaaaaattaaattcaaaagctacaatttaaaaattaagtttcatggagttaagtattaaaagacattagtcctaaacacagtctattccttgacaccagtgttttctctgtaagccattctgtataataagccgactaacattctaacacctactctaaaatgatgatctctctcctaactgtaaaataattctagtattatttttcattattaactatgattttgaaaagttgaaatgatttagttgtatgacagtatatattagaatttagtggaatgtaagcataaaaaactatttaacaacgttcttctaagagtcagctcataggtcatatccttcataaaacttatcggaagctttcttccacccaattaacaaatccctgaggggtcaactgtaccctatatggttgttcagagtctgtcattccttgagtaatacattataatagtagctctaaaactttaacatacagcagaatcttctggagtgctggttaaactacaaattgcagagcctcacagtcagagttcctgatttatgaggtctgggtggaacaaaataatttgcatttctgtacaatcctaaggtgaagctgatgctgtcagtctggggaccacattttgagaaccactgctttcagagtgtttcattttcaaaaagtctgcctcccactatgagactagaaccactaaagagcagatatggtgcctagcatgttctaggcactcaatacatatttctgaatgaaagaatgcagaggcccctgcaatgtttggaggagaaccaaatgaaaaatgagaagactgacaacgcaagtttcgggaaataaactatatatatatatatatatataacttagcagattcaaattttatttaaaccactgtgaagtcaatactctgaccttacaaatggttcagtgaaaatcttttgatgtaaagaaaaatgcgaagagtttgaaattaatacttggtctaggttcctctaagtccttttccaaaatatgcctatgtgtatctgttcattaagcaaacatttactgaatatataccataagcaatcaagctagaaaacataggaaacgacaagttgaccaaagtattacttcattttaacaaaagtggatcaaacaagtattcatcatacaattctaggaaaggggggtaccaaccgccagaaacaagagatgttctagaaactcaaagtagttcactagtgaggattttgaggtaggtagcagatagggaatcacagaaagagctggaaaactacgtaaacatataaagctggcccgaggacgggaaggctttgaatgtaagactaaggaatttgaacttacttttgtaggggtgagaagaaagcaatacttagcaaaactaaacttcaggcagggtatatgcttgagtagaaggagactagaggcagaaggactagtgagaaagctactgaaatgttctccacagaggtcagagcgacctaaaccaggtggtagcattaggagtgaaacacacagaaggcaaaatcagcagttaggcaaccgattaaatgcatggcaagagagagaaaaatgaattaaatggaaaggttttgagccttaatgacccaataaatgaagatgccacttaaaagctaaagaagccaagatgatagagtcaatatacttaaagacaattaatcataaacttcagaagcactcacttgcaggaacttctatcagagccctgggttgggggaatcctagcagtgtgttcactttgccatatacatgtgtaaagtgtgtaagtcttttattttattttattttatttgtttatttatttgagacggagtctcgctctgtcgccaggttgaagtgcagtggcgcaatctcggctcattgcaagctccgcctcccgggttcacgccattctcctgcctcagcctcccgagtagctgggactgcaggcgcccgccatcgcgcccggctaagtgtgtaagtcatttctatcttgcctgcttaagcttctccttccactcctccaacatttccttagtcacactcacctcccaccagatggccctggagaggctgtggtcatttttatttaacttttggcattctttccttaattggaactccttgaattatattagctttaagccctgaaaaatctgaatctgaccctgcaagaatagtttctggttgtgaggaagctgtgctcagttgtattcttggactttgatgcactacccagaatttcaggtggaaaaagcccaccatgggtttaaaaatctagcagaacatttgggactggggaaatacatgaggatagttgatgaaattactcaagaagagaaaacagacagaggggagaagacctaacattaaatttctgtaccctgacatcaagaacaggaagaagaaactgagaaagaagaagaggatggaacaatcagaatggatgaaaacaacaataaaacaatgtagtccagtgacataaatgccaagggaagaatgaatcttaactaagtaaagatgtagactgttccctgtgctgaaaagaccagaaaagatgagtgctgatataaagccattcctatggattggtggtcactggaagggaagatatgaatagagggagaagtttgtcatgccccccaccaggtcccatggcggagctacaggacagtttttctaacctcccttagggggatggggactaaaatttgctgctgctctagtgacaagcagtttacatatccactggaatatcgtaagatggtaagctagtatgattgacattttacaaatgagaaaacgtgtccaaagtgacaccaccaaccagagctggaactcaaattccagattttcctaactccaagtctactgtcttattctcatggccaattttaatagcaatgtacctatctatcttcactattattaacagtattattcaaataattacctggaatttagaaacagaatagccttgtctaattttaggactgttttctgaggttccacttcaattagaaatgcacacattagaaaatgcacgctattgcttcagtaatattttatatgtttgtaaccctttatttaaaaattaatctgataacatttgtgaacatgttaaaaagctaaaatgtcagcactttacttttccttcttcacagtttctaatctgtagagcctaacaaaaaaatgattaacatttcaaaagaaaacaaggaaaaacctggtagaaatatatttagcagagaaagtttctaagtatgatctgttgtttgaatatattttttaaaaagaagttcaaagtaagcattttacttcttgcattcataaagtgtttatcagttttcatcaaaacaaagaaaataagacacgattttgtttttttcatttcatgggctgatttttcatattttaaaaatattttacgtttgtagtccaatattaatatttaacacatggattaatgtacatgtgctgaaagatgaattgaataaatgccaggaattattaacaagcaatttcaactaaaactataaaacaatttcagcaacaattaccttaagtgataaattttccttcaatttaagaaataattttatccctcagctgtttattgaaattattattttgtacttgctgtatctgaagacagcaaaagacttagcccatgtaaaagtagaaagtactttttcataagtattttaatttcttacgataacacttagctattaaataaaattgcgggctggcagctgtaggctcaggcatataatggaagagaaagatggaaataccaaaggggcaggtagtcatgagcaaggacctgaaactttgatatatttgaagttttcacctgcaaccttatcttcagtttggtagtaacactactatttagtgttacttgcttatagttgtttctatccattaacttgctttgttaccttttgctatgtatataattatattctatgtacataattatatagagttgatgctatcctaaacaatgctttaaagggtatattttgtaattcctaggctgttctttgctaagggacttcagctagagcacacctatggtgcaatttactgtgttgaaactaggcagaacatcaacaataaaatttggaacacaccttaggtatggctaaaattttttaaactgacaatactaagtgtaaacaaaaaaacagaaacactgtaattctcatatattatcagtggaagtttaaaatcatgcacccaccttgagaaactgtgggacaaagtctaacaaagttaaacaaaatcctgtttcctagcctttccacttttaatatatgctcaatagaaatgactattgtgtcccaactcatttaaaaatgcttataggtataatagccccaaactggaaacaaaccaaatgttcttccacatgagaataaataatcaaatcgtggtatatgcatacaatggaatatgactcagaaataaaaaataaccaaccaatgatacatacaacatggataaatttcaaaaatatgatgatccaaagaaaccagacacaaaacagaacattctttacaatcccatttatatcaacttcaggacagggaaaatcacttatgatgatagttatcagaatagcagctgggcagaggagaactgtgactaagacgtagcttgagagtcacttcctagaattacagaaatgccctgtgtatggatgtgggtagtaaacacatgtgggtatatataggttaaaattattccactgacttatacacttaaaaacttgcacaattgtattgtatttaaattatatttcattgttaaatagaagtcaaaaccaaagaaaaccttcatcatgcttctttttcttttttcttctccctccctccctccttccctcccttccttcctttcctcctttctttctttttttttgttttgacagagtctcgctctttcacccgggctgaagtgcagtggaaaaatctcagctcactgcaacctctgcctcccacgttcaagggattctcctgcttcagcctcctgagtagctgggattacaggcatgagccaccttgcctggctaatttttgtatttttagtagagacagggtttcaccaggttggccaggctggtcgcgaactcctgacctcaagtaatctcccgccttggcctcccaaaatgctgggattacaggtgtgagccactgtgcccggccacttctttttcttacatggccacttatttttcttctttttcttatattttttatatgtgtattctgattttcctcgtaggattttttgcttgttgaaatgaagcagttaagatgtgactaatacaacagagagcatcttgaaaagaatgacatcatatagcaagcctgtccaatctgcagcctgcatatgacctagggtggctttgaatgtggcccaacacacattcgtaaacttccttaaaacatgagatatttttgtaattttttttgttttttttttagttcatcagttattgttagtgctagtgtattttatgtgtggcccaagacaattcttcttccaatgtggcccagggaagccaaaagcatggacacccctgtatagcatgagtaaacacctcagcaccaaggctagtaacagaagagatgaatgacttaataacatttaattccctcactctcccttctccaggctgcagcattctcaagaatgaattggaaacttcggttgggtgtggtggctcacacctataatcccagcactttgggaggccgaagtgggtgaatcacgaggtcaggagttcgagaccagcctggccaacagggtgaaacccatctttacgaaaaatacaaaaaaaaatagctggcatagtggtgggcacctgtaatcccagctactcaggaggccgaggcaggaaaatcgtttgaaaccaggaggcagaggttgcagtgagccgagatcgtgtcactgaactccagcccaggcaacagagtgagactccatctcaaaaacaaaaacaaaaaaagaattggaaacttttcatttcctactaattccgtcaccgctataaacttctgtcacctctcctaaattccaaaacctcactatgctagtaagagcctcatgcacttgactcctgacccagaactgcttggtcaaccttctaacacatcttgtctcttgttatttcaagcacagttatctgagtagatgctagctcaataccccctgcctgtggaaatatattaaatgcctccacatacagaatcatctccaaggggtagaagataagaaggctagaaaagaagttaacaatagagaaaaataccaatagattgattacaggaaaatattacattcctaaacattaatagcaccataaacaaaattaaaaggtatgtaattaactgagaaaaaaatgttagcaatatatataaaaatactaaaaagggctaacaacatcaataaagaattcttgcaaatcaatgtgaataaaaggaacacatcactaggtaatgcaaggtaatgaacagataatttggtgaaatacaattggcaaatccacatgtgaagatgttcaaacgcagtagaagttaaaacagtgtaaaacagttaaaacgatgagggtttttttttcttataaaatgataaggactgaaaataataattgcaatctgggaggcccattgtgctggatagtacaggaggtagtataaagaaacatacagaggaggagaactcagtttggcagtgagtattaaaaatctaaaaataactataccttctaactcatttccacacttcgtacacaatacaaatatttagattaaactatcatatataacagtagtgtgtgtgtgtgtgtgtgtgtgtgtgtgtgtgtgtgtgtatatatatatatatatatatatatatatatatatatatatatatatatatatatatttttttttttcccccccgagacggagtctcactctgtcacccaggctacagtgcggtggagcaacctcggctcactgcaacctccacctcccaggttcgaatgattctccagcctcagtctcccgagtagctaggaatataggcatgtgccaccatgcccggctaatttttttaattttaatagagacagggtttcactatgttggccaggctggtcttgaaatcctgacctcgtgacccacccgcctcggcctccaaaagtgctgggattacaggcgtgagccactgcacccggccagtgtttataaaatttttaatggaaaaaaatctatctgtccaatatcaaaaagattggtaaaataagtgcagtctagatgatatgccacgtatctctaaatatttatattatagaaggaaattaatatcaacaaaagatgtgtatgatgccatattagtttttttaaaaaggttgcaatacagtctgcacagtaggcttctatttttttttaaatgattaaatacataaaggcaaactactaaaaggaatataccaaaattttaatagtgattttctttagatacgattctggatattctattttcgttctcaaacttctgttttccaaatcttctatagcgataattataatcactaataaccaatgttatcgaaaatttccatgatctctaaatgccttaaagagttcgacagaaagaatttaaaaacataggctctcctttttcttctttcattagtgatgatgggctattaaaacaaggccacgtccttttgctttaacctcccatccccagggatttcacattagaatgtccttcctcccaatacctactcctaaccttccccaacccagaagttagtttctctccattaaaaaaatccccacagtagtataaattaagcaaggaaccattttaaactgtcagcttaatggtgcacacaggaaatatggctgctctcagtgcaagaaaattttaatgaataaagtagcttaagaaaaagatattttccaactataagtggaaaacttgttcagtttctcagaggttgtttactgccataggaattacctatttaaacttcttcacaacgttatcacttggatatggttaggttattctgcgtgtgggcgactcattaataaagctgaaggaaaagcaggacagtgctaggaaagaaatctagagctggacatttaatattcttgtgtgtcagagactacatttgtaatattaggggtgggaagtagttacttgctaaaatcccactttatactccgtttctgattctaggggtgtttttgtcatccatacaaagtcaaaaagaatgcaaaattataacccaataataatgtcattttttaaagaaaagtatagatgattcaagaccaagaaagaggcagttcataaaagatttaatgttgaaaaaccacaaacataaaaggaggctaaaattggaaaagacattataaaatctaaaactttaaaaatttgatatgataaaatatatgctggaaataatatgcaagaaagctgcatcaaagctttcttggtcaaaggaaaaagtgttaactattaagagattttttaccttaaaaaatacaaagaaacaacttagtttgcattatagactaaaataatcttttcaaaggatattgagaatagaggaccaaagagtgtttttatggaaggacaaaaggagaatgcagagtgagatttaaaagttgtgtgtgtgcatgcatataaccctcaaaagtataactccacaccaaaaacaaagaagtagctgtatctagggatgttctattccatcaaaactatgtctgtgaagctttaaagggaatcttcttgcagtctacttcctatatgaatactctctatgtataacagttcattctaagagaagagcaatagatttaaccacttgttagtatccttgttagcagtatatcaacagcaattgatcactaatgtgaaggtatcaggttttaggtaacttccaacaccattctccttgtgttcaagtgattttcctgcatcctctgaatagaaaccatcactgctaagaattgctccttagacagtacctgctggaggcttgcaaagatcttaggtaaaaagtcgtaagttgaagatattagttgataatggcataaggtcttgttcctcaagcaattgtgctaggaccgtctacattataatctcttaaagtggatatttagaaatgcaaattcttgagccctacccccagattactcaatagaatctttaaaggtacaacctaggcatgtgcagtttcagtaaactccttaggtgattctgatacagtttaaattttaagaattaaaatttaattatatctgtttgtattacatctcttcaacatacagcaaattttaataaaagctatcgaggtactaagaaatgaattgtaaatggtgaaatcacaggcaatggaaggaatatttaggtgttgcaggcaatttattatagcttgaaaatcataccatgctaactgtagctagctttaaagtaagttctgactaacagactgaacatattattgcttctgtgtgagtagaagaggttatttagaaatctttctacaaacatttgagtatctatgaaaatttacttttgcacactgagatataacaaaaaccacactttctgtcctcaggaaatttaatccaggaaaattagagctctgttttgaaagcagaggaagttaatttaaaaaacacagactggatgtatcttaacatcacctcctaagctcactaatgatacctgaaagcattcaccttcacctagttggagagatctctgctgcaaggaaaatgttaaccatcttgccagctaggcatcattcttcatactataataagcaaaaggcatttccaaagtgagactctctttgtaaatttgtttgtcattcttgtgaagaatcagatgctgtaattattaagctttttacagaacatttcaattttccaattgctctttaataattcccagcaagtaattggacattttaattatatgtagcttcttgtcactgttcatctaaaaaacatcacaacattaaactaagatgctcagcctgagtgttttcttgggttgtatgcatattttttgagttatttcaacaatgatcaaaagccagtgagttcatccttcaaactggaatcctcatttcttttccaaaagacaaaaactaataagcaacaaaaaaattaaaccatcacactaacaaaatgtattaaaagtcaatcgataatactggccatcacaccaacaacctctacctttattttattttcccataaagagccactaatccattttgtttttttctactagcttagcaagtccatatggactggaccctttcagtgtttctttcccagaatccctgcagaatcattgatctccttgatctactcatctctttgatcttttgaggatagtctacaaatagcctgtgctcccctacgtgggtggcaatagcagccctggagccttcaaaccagcttatggggttatagtcccagctctgccagttacaaacatgcgactaagtcaggccaattaaagtgaccgggctgcaacgttgccctacctgcaaaatggggcaaaaatcttccatatttaatttacaggcttgtgcagatttcatatgaaataaaaagagaagccactgtgtaaaccttgaaatctctacaaatgtgaaaatgaaaatgaaccaaacatctccccaatattagcatgacatctatcaggctcctatagaaatcagtaatgaaggaggatgtgtgcccacccagccatgccatggtacaaatggggcctctggtgtgtcagaaaagcaactggaaaatggaaaagagatggttcccatctttcctgtgtctgttctaggacactgcgagtcctcccgaaggtgtctgaaagaacacaaggcaggcatgttaagtgtgaaagacagcagaatggatttgacggcctctattaggcctgaggtcttttggcagagagtgagagaatgtcctattccaagcagaaggcacctgataagcacttgattgattggtctctgcattcttggcactcagtgaaacactgatttgccagcagagtgtgtaaacacccacattttggtaataacctaaatatctgcatattgtgaatgaggaggctgactgaatgaaattgtgtaaaaacagaaagtcaactccctgcaagtcttgccttcaccattctctttgcagatgcaggacttttaacagtgaggatattaggacatccacaagtgaaggatggagccctgccctgctctttgggagctttttgcctgtgtgtgtgtgtctggccctcattcaaggatatgctcctctctggcaactcccagccaatgtctagagagcacagcactgtgttttccaacttaactaagaattaggtctctttgctactgcctttccttaagaccaggaccaaatatatatatatatatatatgtatgtagatattgtttaacgggcctcacgtctaggcaaaatacacacacatacatacacacacgtacatacaaagtcattcattcaatagtaagctgcatttgtctggaattactaacaaaaattgaattagcaattattgcactgttgttttcttttaaaagcacaagttaaagtagtgttttctgctcatgcttaataagattgcctttctctctatttaccacatacccatctttcagagcttctctaaaagcctatgtctttcttgaagcttttactgattcccttgctggaaaatgtatctctgatttctaaatacctacactgccctagcacagattgctaagtcatgttctttggaggtcctatttcccaaatggcaggcactccatcacaagggtctccaaaattctccaaaacactagggaatgtatgaatatgtgaggtgggaccgatattcatattggctccagaggagccaggcaatgctttctccagggatacttttcactattatctgttatctagaaaatcgccttcattttaagatatttagaagaaaatccaagttatgtggtttcatagattaaacttattgctggcacttacataccactaaaagttaaccttggaggaggggcgatacagactataactttaatcatatcagcttcttgtcttaaccacatcttgctttgactgaactactctgatcctaaggactcctgactgttgatatcacagcttaaaggctttcttcagactccgggagagaaagtggtgggacactctgtaaagtgattcagttccaaagtatatatatcatcccaggtgatcatagagcttaaataaagttgcttcaaactagcatgaaattttgtctaatacacagtccccaaaagaacctctttagaaagaggatgaaaacatttaaacatggatgttaagttcctattaaaacactcatttattttaagaaattcgctagttatgttttaaaaattgataattaaattacagttgctgagcattttcctttgacttggtattttgaaatgcttgtgttctgtctaaatgctagattcttagcatttggctaaggtatacgcatcaaaatggccacagtaaaggaagtgacattagtaattctgggctaggaagcactgtttctcttaccgaaatctctcgcaactgtaatccagccaggtaaagatagctttgtgtttgctgacattttcagagttgattgggcaaaaaaggtgcaatcattttcctaagtttttcctcgtcatctttaccctctccccaccaccccctgccgttattttcaaaaggcttaatctaaattctaaaggaatgttctaagagagcgaggaaaaaaatattcaacactaaactgcagcaatagccttgacagttcagttctgctgcaggtgtcctggtttaactcccacatggacaaaggggatacaaattgttgggttactacacaatatcctcttgttaacatcgtgttgtcctcttttggaagaatcagacaccaggaaaggatctcaatttcaaccctttgtcttttacttaaagaatctaccaaatcagtctagaatgataagaatgaaatgtgttttaaaaagctcagaggagtctaccttatatctaacctcagtcctttctgttttttttttttttccagagcagaaaagacccactgttggagaggggttcatctgtcacttgaggggcagcagcaatttatcagttcctgtgccagatgtttacataatatcaagtcttcacaacagtcctacagaggccctatttcactccaggcaaaaccaaggctcagaggcttaggaactgcccaaggtcagatagttagtagacgcaatgagaattataagagtaatcctttatgtcacaagggaattccagaattcctgtaatgttattttaagtggaatgtgtgaaatgccagtaaataaacaacaacaattctggtgttaaattgaagaaacaaaagaatctttaagaacaatgtagttaagagactcaaactagaaagaatttaccatcctttctgaatgttgctccaacttatagtctaatataaaaactcataagaaatgagtagtagagatgcttaaattctctatctagtctacaataccatgcatctagaaacgacacaatttgatttttaaaatcttcaaggcttcataattaagagaccataattaaaattagaatactcaaataagtttattaattgtcagtcttttctctatatcctgccttcagaattatacgattttatttaaccatttgcaggattcctttcatctcaggagagtataatcatataatcagactcatcaccactgttcccttttaattgtaaatcatgactgcgcttgcaaattagtctattatcacagcagattatcaatttggtagggaaagtatttgccatctagaatgaaagtagttaataaacattaataaacatcttaaatcaatcactcctttactcttggtgtgccgacagatgtcatttgagattaataaatcagtcagaacaaataaagtgatgaggaagcgaagcacaaggaagcctctcgatgccctgtgtacttaagaatcacaatgcctaaaaactaattggaagataaagataaggcattaaaccttcagagaaatgacttgttggaaattagacaaagtaaatccagatagccattctctgtgggtctgttatgaaccactggcaataaaagctagaggagaaacaaaatgctcagtcagaataaattatgtttattgacagcataatgtagaggttaaaagcatggactttcttttttctttttctttttttttttttttttgagacggagtttagctcttgttgcccaggctggagtgtgcaatggcttgatctcggctcactgcaacctctgcctcccaggttcaagcgattcttctgcctgaccctcctgagtagctgggattacaggcaaaggccaccatgcccagctaattttgtatttttagtacggatggggtttctctatgttggtcaggctggtctcgaactcccgacctcaaatgatctgctcgcctcagcctcccaaagtgctgggactacaggcgtgagccaccgcacctggccaaaagcatggactttctaattggcctgcttgggtttgaatccagggcccacaacttccgtttcagtgacttaactatttcttaattttgctgtgcctcaatatccttatgggtaaaatgggagagtaaagtacctatctcataaagttgttgtaaggattaaatgaatcaatattttgttaagagtttaaaacagcacctggcatataacaagcactgagtgattgttcaataactaaatgatataattggccatttactaccattttatgtgctctagttctttctctgcacaggcttttatgagggagaattggggttgtgaagtaatcccacaatattttaatcacttcctcactataagccaagagttgaattaattcattttgtaaaaataattaaaatttaattaattctattaaaaagaaaaaaacacaaatttttcatttaaaaataagattactgaggcaaaatgttaacagtacaaatagactgttgttgtatagtccagtcattaattaaaggcatccagatatcaataccttgtgtattaacacaagacttttgtataaagatgtttaccagaagcccatcaggagtgttccacttttagttatggcacaaaacgttatccactagcatcatcaacaactcctctatatctcacctaggactagtcccaagaaaaagaatgagtagggaaaccaaatacattatttgcatatttaacagcatgtccaattagccactttgctgacagagactaatttattattcatcttattccagcatatgttactactttgacatccacgtgacaaatgactgatacagcacattgtgattttgaaaatgttaactgtggacttcaagaaaatgtagcttagactattgaggaaagtttctctgcttcaccttcagaaatatggaatctagaaaatgatcaatttttctactatgtaggcacaaatggtccaatatgacataattttcagaaatgagtatgaaataaaaggaaataagctatcaaatggtgccctgaaaaccaaatagaaggttcaatctctacgtacatcctctaggcaaaaattctcagaggtatttaaattagacatgttccagtattatttctctatactagattgtaatatattttataattgaaaaggataactatacataaaatgatatagatgcatagataggaactaaatcattcattcaattaacaaagacagaatcttgaaaaatttgaaagccaagttcctcagaaaaaccacatacttctttcaaatgtgcttggatagttttatattagaaagagaaaaaaaaaaaaaagataaaacaatgtgttgctgcatgccccttcaaaatgtgctcatcggttactgtgagagtactgtgtcacggggctaccacacttttcctgaatgtattttttagaacagcatcacagtcaactcctagtgaagtactttatgctctgtaactatccacactttagatttttcagtcttaacataaaattaaaaatttcagaatctaaaattatctgttttaagtagcattaaaaataccacttctctttaagcagctctgaaacctgaagtcatctagaaaaatatgccatgatgaccaaatggtaactaattgccaagacagactaaaccacataaataattacatgtaccatcgttagtccaatggcaacccagataatcaaaaaaaccatgattatcatggcatcatggcagaagtgttgtccaaataagtaaatttcactgccttgtattttaccacatattaaaaagcactcttttacaatctgttaattttttttctttctttatagttgctgattttcagagatatatcataatgcttttaccaattttaattatttgacaaacaagtcaccaaatatatacaggaacatttaaaagttcacaaccttggtttaaaaaatgtaggtcacattatgcaatacatttaaactggggatctcagagcccaaagggttctatattctgaatttcacaacaaaaatgactacaagattcaaagaaagttcatagaaaacaacatatacataaccacataccttgaaaatacactggagaaacacctttctatactgcctcagttaaaattcacaaatctcaccgatattaagttcccacaattaatgcagcaggttcttcttatctacttgtatatttagtgattaaaaggaagtctgtacaggaatcatcatcttctagtgttaaagctttttagtatagtggttactatttaataaataacattccttatcactacctgagcataacccttcaagtcaaatttgagaacagtcctcatttattaatccatctccatcttcctacttactgactaagtaccacaaggtaatattagataaaattccttccactgaaatgcagacataaatttcacatctatattgacttgaaattcttaataactatgagttagctactcttttgtggctaattttattgttaatgaagaacattttttgagacatgaattggaaagtaccaatgctgggacaaatttcaggtcttctaatttaaatccagtgggttttgtttgttagtcttttccaaaaccctgccttttatattgtcatggaaaagcaaatgtacagtggctatatattaattaggtgaacctgacataatcatcacctctttaaatttgtttccttgtcagcaaaatgatgatcataagccctgccgtggttgtgatgatgattaaatgagacactttatatgaaggcactgtggaaatatatacttaaaagatagctgttttcactcagttctgtcaaaagcttgagggaatgcattgttatgtgatcaacactgaacaatcttgtattttgtgagagaatggaatattttaaaaggccattacaagcttctatgtggagagatattctacaccctacatagaccagaaagggctgggcaaaaagaccaaatgaaagaagcgggtgcttttctaagaggaaatccttgagacctcagttgcgagacaagtactaggccaaatgcaccttgagcctgaccaccacgccatggctcctgtgcacctaagtaagccactcccagaataatcatgaggacaattagatggcttaagggacctgaatataatctttgcaaaaatatctccagttacaatatgtttagaatcaatacgtccctgggaaaagacaacaagaccatgaggattttaagaaatccttatgatcaaaggaaacttagaattggaaatgatcttagaggtctgctagtccaatttaaaaaaaagagagagagaaacagagaaaaacgaaacaagaatatgaatgacaaaacagtataaaaagtcatgctcattattattgagattgttaacatctcaaaacataaattgtgtttttttctttaaaagaggcacacactgtagcataaatgagtcatcgagggctgactgtggtgatggtcaacagtaaaggaaagctggttttctctgtatgaaccaagtttggttgctctattctcttctcaaagaccaagcctctaatcccagttaattgtctaaaaaggactgcttttggtcatacagtatacaggtgagagtgtagatgaattagtgcaggctttcccttctattggagtacaggctttatggaagagtattccataggaggaggaagatgagttagaagatatgggtcctgcctccatctctgctgctgatttgctgtgaccctatgagtgtagttcacttaaattatttagatctctgttgtcacatctgtaaaatgaaaggaatatactcctcaaactttagaactgaaagaaatgatgttcaaagtggtaactgaattccataagtcactgagttaataactggctgaactgggacaggaactcaggtcttctgattttaaggtctagatttcccctacatgtgctctaaagtctcttttaagtatttcttaaaaaaaaaaaaaaatcattgggaacctactatagtctgggcacttttcaaattcatggtctcatttattcttcacttattgtattttcattttataaatggagaaaacattcttagtaaagataagcagcttcgtacatttacacagtgctagtaaatggcaatggccaaatttttacacagatatgtttctgagaagtatttagtcagaccagtctgcattaattattcattattagtgtaaatttaaatcactgaattcctatcttaactacatttacaaaacaagacttatatctgttcgaaaagtagaaattgttatgttttgttagaaaaaatatatgcagcaacttggtggaaaacaactgtataaagagctctttctagaacattaataatgaagggcaatagaaagtggtgtagataaaatttactattttgatgtttttatcagatcatttcatggtgagtcccagatgattgctacatatacataaactttatgttttttgcatttatgcttggaaactatgtatttttaaggaaaaaattgaatttgcctctttaaggattaactctttccaacaatagcttggatttttagaactaagttgtaaacttcttgatggttctgcctccgatatcttgcctcctccaacctcaactctactctcatccttattattctctggtcctccatggtacctggtacacaaatacaaacacatgctcatagtaggaatttatgatatatttagtgaataaatgaatgcatgaatgaacaatctaagaaataaatctattaaagttttgggcaaccaaaaaattattctaaagtgccagggttacttggatcatcattgattcaaagattcttccaaaaatagtagctggccatcttgttgaaaacagcatttaagtgatataacattttgtccaagaatccaaagtaaggaaaaggtgtggaacaccagtgtctgtttcagcagaacagtcatagccaaaaacattctgggtcacacatatgaattcattaccagctaattaatattaaacattaaagctaaatatttccccaatgtagagaatattgtcaaaggttttgctagctctcttggttgccacacaaaagagtaaagggattactctatgaaacattaacctcctgcctcctggaaaaacagagaaacaaaaacctcctcagcagaatcaatgaagtaatctgcaggactccagtgaggtaccaacagctttctaacagtgtgcattattgttaaaacatgcttgaagcaaaacgctggaccatgtatcttgtaattatttcttaagagatcaaccattaaacggcatagaggaccctcttagtttaagtttaagtttaaaaacctctgagctcatagaattgctctgggctatgggccataggccttgattctaattcctctttgactctgatcagacatctggctccgtcttttggcccatttatggtatgcctcagtatccctacaggaaaatcacattcaaactcactctgaaacctacctatcctcttagaagtttggtatgtgtactgaaagtgtctcagaaacagaaacattataaattcaagatataattattatccttatataacaccattaagcaacttcaattacaaaccacacttttaaaatctgttaacacttccttctgggaaagcccttttgccctttaatagtgtaagctaatcatggcaatataatttccagagctcatatttgtgggaggagaaaggatggcactggtggctttctccttcctttatctcctgaaattattgagagactctaagctaattttctaaagtatgcagaggcacttaggaaagccgggagctgagatgggaacctaagcatttcactgacatcattccatgctccccacatatggcacatcacataagcagtactggctgagcacactggtctattctggactcttgttggcgttaagtagcattcttaattacaagcaggcttgctttttgtcatttacagtcacacagttctccctctatttaactagaaaaaaaaaacacaatttttctatggaggtagtttcaccatttatgtttttgagccaatgcaaaatataaaaggaccctgcagtgttctcaaaacctgcttctcacaggcccttaaaaaaaatcctcatcataatctctgcaactgggtcagcttgcacaaagatactcgggtagccatgagcgctctctgcgccctgcaaaccttgtaagtgacacctcataatagtgcaaatgaagcatggcaagatgagaaaatgaagaagaatgaacctggatagtcagcccagcagctttcaaaacataggggactcaattttattccttaaactataccataaatgaatttttattttacacattcaagcatatacatgcattctctattatgaaagaaaatgtcttacgattcacagaaattctaatacaaccaaacagcctagttcatttgttcatctagccaaataaatttgcaatagtctcagattttgaactaaacctcattttcacttgtcttgactttcagctatgaatttatcatattgtcattaacgtttgtgctttcctttcaccctcatctattaggctcaagggttctttacttgtgggtcctttgtcccaacaactagcgaaatattcagagagctattgacccaacaaattcaacatcacctctttcttattaggtttctctttaagccatcaccctgcctgccgtgttctcagtccctctgcactcacacctcaccccatttctccatcccccaccctgagaggcttattttttatcctaatgttccttgattgttctctataaagttaatattattttcaaaagagagaaaggatgaagtatgagaaattcacacctggcttttatttggcaggggttggttactgacatgtaagtttgcgcctctgattgaaaaaaacaaagaatcagaagaggagcagcctcttccaaaagagtaagcatgaaggagagtgggcagaaatccaaaaatacacaaacacgaccatacaacagaaccttcgaaggaaacagaaagttctttgacccaaaagaataataccaaccactatacacacaacaattttctctactatcctattctttctctttttcgatgacagacacctctgatttttcattcacatgcagagacaatcactgtattctggagggaaagaaatgtttgtaaaggccagcagacggcgcctgactggggcagaagcttgcagcggagaggaaaaaggagtgccccactctgcggcagggccccttggtcttctcctctcccacgtccccagcagccttatccctctggagagaggccgagacacagaaaaggagaagttgcatatgagattattagccaagtgcttcccactggcacaattaggtgttccacctgctccatacacccatctgcctcaccacacccacctacccacactctgcccttcctgcaccctggcttgcctccgtccctcaggactcacacaattctgcacaaaggcagggcagtggttgagaactgcacccaggtaaagggaacaacaagctcctagaatactgtgggcttgtggtgagatcaccagaaactccttattctttcagagagatctaatctctgttacttataaaaataatccctagcttgggacatcactctcgtctccatactagacactcttaactggagagaatttctgggagagaactaggagaaggagaaaggaacaaattcctagaacccacagggatgtgttttttctagtatgctcccaaagagggcttgctaggggacttggtctctcttcagttagattatgctatagtttttcatatctaaccagaattgtccccaggtgggaaacccccaccccaccctgcatccatggaataaagggccatcctggtagcaccagcagctgctcagggcagagcaaactcataaggagtggggcaaaggattctgagctgaaacaagtctgaaaggtgacgggtcctgcaagaaagaggtggaaaatggatataaaaaaagtgcccacaactttcactctgctttctaaacaagtgcattttacaccggggtagaataaaaattgggagtggggaacgactcacaaaaacagattgatgttttaatttttggcaattcggggaatctggaatagatatttatctgaaaattagaggaatctggcctcacagtgctggtcactctggaggagaaagctgccaaccaaggcttttctctacactctgctgttttcaaagggacagggcattaggagaatagtttcccttagctctaacttcttctccaggcagacctccgggcttagcccagccagcattgactgacttgcccttcctggaaagcattaatcactgaaggaggaagtaagacctccctggttccaatagccttcacacgtgatcctccgggagatgggtatgtgtagtcaagcctctctctgttccatttagaaaagaactcagcctaattaccaagaaaaagacatatatttatgtgcagagtggatggaaggggaatggtgtccagaggtcccctccatgcctgcgaagggctggcccgcattaaaggggatgactcggttgccctcctagcttttctaattaagggaaggcgtgggggcaaaagtaattggcctcctgttgagtgagtcccaggactgcttcgctgtcactgcagtctgggcgcactttggaggaatgtgcgggctggaatctctccctccccgccccccggggccagggaagatgggcaggaggtggggcagcatatacagcacagacaaaaggttctgcagagccctcttctctctggtgctcaggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgcaaggatgccggtgacctgtagattgcaataggcactgaatgatgcttgctgctgccatggaaatggtggatgtggtgcgctcccaaactggatgccccccacgccactcctaggaggccgctgagggtgagcgggactatccaaagcagggccaggcgcccccctgcgccgccgccgccgccgccgccgccgccgcccccgggcgagcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggacacgtgtaaggcgaaacgggaacacctaaaaagcaactctccctccaccaggtgatccctccatctgaactacaatggcaaatggcacccttcccctacccaatggtttagatgtaaccagtgtctttagagatcttaaaagggagagaattcgggtctttttattggaccaaacttgttctaccaggtgtttaaactcaatctgctaaatatggcttgataccttgtactcaagcatcagtcgcgatgatctgttaatcacatatgttactcataacaaggattcttcttcccattaccatattatatctcatataaggcagtggaagttcaggggaccaaaactcacaaggagggaaaaggatgcattaatttggcagctgcagaagaggcagaaagtggaagaatgggaagagaggaagagaagggtcaggagagaaacaggaagaaagcagaaaagaaagaaatggcatgaataaaattgcttgtatttcagtcaatattttaggaatatttaagatcttccaagatctctatagaagccccgctgtgatgatctttgctaacagtggaactcctcctttctctcatcctgtcttataaagaaaatagcatcaggaaatgaaaattcctaaatctagtgcccccaagggaaataggacatttatatgcttttgatgaaatacagcatctttaactgaaagctgtgtgtcctagatgaaagaccagcaaagccagcataaatttaagagtagaaatctagcaatgcaagtgaacttggctaggaggaccacaggcactggatgctggtgattaagacttgggactatgatttaaacatttccctgatttccaaaagatgataaaaaactatgacatgtccagtggctggacttttttttttttgtctttatttctatttaaagccaaaagaaagcaacattgaacaggaatgatttctcactagcttctcaccatctacataattgttatcaacaaatataaagtccagtattttttaaaaaatgtaattctgggaagatttgattcaaatcagctactaacccaagtggccatttagacttgtatattgcttcctagtccaaagattcaaccatgggactctgatgcccactatataaatagtgtccagtggcccccaaatcacacctgtagcaatcacacatgtcacattcctgtcaaaagtttattttatgatactaaaagataattcttcagtagtatattgattgaaacagttcagccttgctaaacatgatgcttttatctatttaaatatgccgtgtctcccaaccttccacagctgctcgaaggccagcagacgcaaaatctatcattttccactgtgaactgtttctgcccttgcccccagtcatttcttactcattttgttattttgcaacatatgtattttaattcactaacaagagtcgtgattattcgttttaaaaatatcaagtagagcttcaaaaagaaaaggaaaatcatccacacagtatgttttcaggactgcaggtccatattctgaatttgacatttcatagtgttagcatggaaagagcactggattaggagttaggaaatccgtactgcatttttgatgccaccatttactggttacatcacattagttactgagtctttccctgaggcactgtggcttcctttataaaatactcatgtttctatctttcctaacaatcccacagggtagaaaggatatcatgcaatatttaatgttggtgttctttaaaatatgtcaactgctccctgacatgaaggcgttatgtctcttctctcatacaggtctaacatattcaagctgatcaccatgcacaatacattcagttgccttccatctaaaagatacgtagaacattgcattgttttccaataccctcatatattgtgttaatctatcctttcctccccaaataaatggtagatgcctgaaggggacaagagtcaagtcttcattcctacttcctctagtgtccagcatatgtgaaacatatctagtctcttagtacttacagtcagttctcattattcacagtagctgtggcaaataaagtccctgtgaacactgaattagcaaatactgaaccattgctcccatggggaaatacagggctatgttcctgcaaacctctgatcacattttcatcactgaatcaatccattgccttgttttatgtgtttctgaatgataatgacaccttccttaatacataatgttgattcatcaacattgaactcatgaccagcagcactctaactcatgcctaaaagaaacatatctaatatgtattttctccataaggcacatcacatctttcttgcatttaggaacattagacagccctttagtattatgcttgagggccattttaaacagcaaagtcaccaacgtaaaacacaaaaacgtggtgctaaaaagacctaaaatagcgcacttgtttacagtgtgagagctgaaacaagaaggaagccaatagtcttgttcaacttcagccaggaacatgtgcattgggaacacaaacgtttgccattctctgcgtgtttgctaaggatcatcaaagtgccagggctacaaataaataacaaggatcaactgtatttgttattctcttgattgctaggaatggataaggctgggactttggagagcgatttgtataaggaaaagccatagaaatagaataagcgtagaagattgtgaataaccttcccaagagcattcaattaggaagatgcttcccctcctccctcactcccctgcctgtcttatattgtctggggccttgggagataaaggcagggttagagaaaggatgggccagaaatcttagttttacaggagtctcaagagctaaagagaaaatatttatggctgcctcaaaagaagaaattgtagctgtagtcttccaggcagatgtctagggcacctttgcaatacttaggaggttctagggtgtatgctgtgatacggatacagcaatatttgttataaatgattgtaattttgtggaacaaggagcaattctctgtctagatagtgtagaaaaagtattgtgggcaaaaacatgagtaatctggatgaagcaaataaagcttgtgtgtacccattaatttgtgtctcttcagctactcagtctttgggcttgcaattttgttatctaagggaaactgaggcagaatctcacaaattgttctcaggtgattgaagaactggttggaggaaacatggtttttggctaactgtaatgtattctaaaaaaattcagcacagacagtgcgatgtaagtgtttcttaacgctgtctgtaccccaagagtgtcagtgcctttatcaggaatttatgccccaacacctcagtcagaattacagcagacagaggtggcttctagaagccttgtgctactatcatctctaattatgatgtggctgtgctcattagttataatatctgttgaaaataagttatcactgatgaaattaagggcttgttaattggtccaacgaaagttaggaggaagttaatcctttgtgaaattattaataggcaagatgcgtgaattaactaaattttacctgaacacgcctcacttctacataaacagagtatgtgactctaagaggcttttcaccctttattatgaggaatggttccataataatagtaataataaaaactaacacttatttctagcacactactctgagtgatttaaatgaattaattcatataatcattacaaaatgatatgaggtaggtactattgttgatccctaacagttcttagtcacttaattctgagagatggtgaggtgggtgctgtcgttgaaatactgtcatatttgcttcaggaaaaccatttttggaagacatttttttcaggtacttaaaagaatgaagagctggaacttcaccaagcttctagaataggctacaaaattttgtgcctactcattaataaatgtctagatctgtagcagaagttggtcttggtgttgaattcattatgagctgtacttgtgtgaactcttggaaacggggttcacactcagttgccgccaacaaccatggctactgagatctacctaaaagaacctaaggactgtatgtgctaagctgtcctaagcccactcacgcctgatgatttatcatgaacaagaatacagggagcctacgttgaacaacagttaagaaatgagacatggatttgaaagttgagaggaaaacacaaaagaaatagaaagagatggaagaggagagtgagtggaagagggagattctggagaaatgggaaaggacaggccatttcaagttatttcttcatattacaaaaatcaacctttttgtctcaaaaaacaggatggttgtcaggcagacactttcattcttttcatattttccttaagcttaattggaaacccttaaagctcagtattaagctttttaaatagaaaagtagacactaaaatcagcagaggggaaatatattaaaacccacaggcagcactaatattttaaaaattaaaaatgagaagagtgtcggtcttgcattttgcatttctaccagtatccccataaagtaaagataagcagaccccacatatccatctacctacttttctgagtttgaactgagcgtcagtaaaaagggacagactcagaagagggtttgttctggagagctgtaaagctaaacccctgatcctgttacccctctggattattgcaggtccctaagagtaagatcagaaaatgagagtaagagcattgataataataataataataataatattataataataataataataataataataatgccaggctaaaagcatctctggagatttactgcaatctttttattattcagatgataaacttgtgttacagaaaagtcaggtttatttatgaagtgtttatttatcttgaggaacactttcacctccaaccaccgatagtccagtcatagatatagattggtgaattcagtcaacttagctattacctagcacctccccaatgatataacaaatcagagggagtgctggggatcaagatgagccaatgcggtactcaagtcactcaaattgaattaaagcctagatgtgcagtttgacttggaaacgtgactagatttattcaagtcaagattggttgtgtttagctctgaaatattctgtaatctctatcttgtctttcattcgatttaataaaaatttcatgtttggtggcttgcatacaacttggtgcttaagtaccaagtcagggtcatagagatttcactataactgcaagttcaagtgttgcaggcatcacaggagcaccaaccaataatatgccatcttttaatcactgtcagcttatatagtttgtagaattgtttcaaccgatttctgttggtgacaaacacttcctaggctcatgctctttcagtttcaatgtgttcataatgtagcgtgacaacatgagactggagtgcctgactgtgagtatgaatccaagcttcattgtttttattcatgtgacattgagtttaagggccccttgtcccagtttcctcatctggaaaatgattataacgctaaatgtaatgaaattggaaccatttctaaaatctattaaacacacaataaatatgttattattctttattcatgtgtacttagtttagcttatttattctttattcataggtactttatgccaaagacataaagataatgagctgcgatgtggtttttaatttggccatattctaaagtcttcccactcagtctatagtcaagctcagccacttcttaatttattaccatagcctctgtttctctaaatctgtgttgctcaaactttagtgtgcatagaacatacactagaggggctagaagggctgttaaatcacagattgctttgcttttgatttccttaatctttggaggaccctgataatttgcatttctaacaagctcccaggtgatgctgaagctgctagtccaggggaatgccaaggtccttatttcaggttttattaactaacacatggagagctttctcattaagctccttaccaatgatctcacctcccgttagttgatccaatataactacaggcagatcagtgttccctaagcatagatcatagtgctgttcccagttctcttctttaaagcattctttaaaaacttcaagatgtctattatataaacctatttgttctcatctcacaccatgtaactataaattctctttactacagttagaaaaaaatattctattttccttctcatcttttgtatttgagctcttttatttgttgccttaccagtggctatgagcaggaactcagacactacactagggttcaattcttgcttctacaaacttgctagctatgtggccttgggcaggttatttaagctcagttttcccatctgtaaaaaaggttaattgtagggttgttgtgaggattaaatgagtcgacaaatttaaagcatttaaaatacaatagtgcctagagtatatgtgtgtgtatctatatatacactaccttagcgtctagagtgcatacatatatatatatatatatatatatatatatatacacacacacactagctttttgctgttgttttctgaaatgggttttttttccccttgttttatggtagggagaaaataaatcagaatttatgataatattgttacatataattcctaatactggtcatccaaatagtcaccataacaaaactaaactaaacaagaacaaaaattaaaaagtcccttccaggtctgggcatattaggcctccagtccaaccagcatcagctagagaaaagatcaatgccatgaactggcaacctgggatctgtgtgcctgaattccaagacactgtctgtcatacacatctaccactgcagaaagaagcatgagattgttgagaacaactagaagtggaaggacaactctaaggcaatttagggtaatattaagactaaagcataatttccaaattctttggtaaacacagatactcaaaccaggaaccagaaatcatgtaccatatgtttaatttcctgaatgtccaaggactcagagcataaaacaatttgatttatctttgtgaatatatgttgtagagcatatactacaatttgaatgcactgagaggaacttaatcatgcgattcaaattgagtctctatctgggatctataatctaatccccacccaattcagaaattcaggatatataaattatatatatatacatatatatacacatatatacaatatttatatatacatatatatatatttgttaggttacacattttgtcagagatattctgatgtcaatactatagataagttggtatgactattctactatcaagacctttttaccaggtaaaattaaaattctgtagcatgttatattaagccctttaaaatgtgcctccatgcctcttgttttacctccatttcaacttctgccactttccccacaaacaccccaggctccagccacatgaatttctcactcttccataaaacacactgcacactttttgttgttgttgtttttactttgacatatcccatgctattctctctgtaaaactatcttttctacttccttcgtctcttagtattgcattaattgttctatcaaatgttaatatatatttccccattggaaaaatttctgaactctgtcatttttttgctaccttctcaagtgtagaatattacaaatacctaaaaaaagagtgaggatatgtaacagtgtattcacattactattgtgcagaataaatgatgatcaaagcaactggttaagtctatcaccatgtttagtggttaaaatcaccaaagccaacagagaaatgaaacaaatcctcttcaacttacccttataggtttattggtgagttatttttattatctaaaatatataagaagtttaggcttaattttaatttgaatgctaagtaagctggttataaagaatgatggaattcattgtcatattttcctactcatgttataaacagatgtctttcttttccatacttcaaaaaaaaaaagaaagtactgccaagctaagatgcttgctgccaagttgaattacagaacaaacatttatagccaacttataaattcttaactgtagggttttataatggaaatactgtcaccattttcactataaccattcaaataatattactatagcaaaacttatcatctaatatttttttctgggatggatgagggaagactagctataagagttggaaaaacttctagtagctcaattcaaattgcacaattattccaatagttcaagtctcttagaatattgattttaaagtaagaagtatatgctccaaaacatttattcttaaaagataggaaattttttgatacctgtataagaaatatatgacctctgaggcattttgaaaaattattaatcaatgttgcttttctaaaactgtcttattttccttttgtaaaagaattactttccctcacattttctctgttctattgctgagatgattcccccggagaactgtgtgtttatcttgacaggtgttagtagatccaaagacctctgtggaattgttcctggttgcgttcaagtacagtagaaaacattatgcctgcaaagcaatgaacttaccttattgccttctaaataaaataaaccacacagcaagtggaattaatctactaatgtcttcctaatgaagctttcattagacatatggtgtggtcttcaatatttaacacgacaggtattaaaacaaagcatatctgatgatttttttaaagcatacttgatgactgcctcttacgttatttttaaatgaactagtttaccttcagattgctttaggcacctaatcaaagagatacaagaaaatatctagacttaagatttttttttaatcaaatagaagaaacaaatgcctcactaccaatgcccttaaatgatgaaaactgggccaggtgctcaggcctgaaatcttagcactttggaaggcgaagacagaaggatcactggagactaccagtttgagaccagcttgagcaacataaggagaccccatctctacaaaaaatttaaaaaaattttgtagaggcatggtggtatatatctgtggtgctagctaacataggaggatcactttaacccagttcaaggcagcagtgagtaatgataaggccactgtgctccagcctgggtgacagagagatcccatctctacataaacaaataaataatacatttatttatttatttatttttttttttatttattattttgagacaaagtttcactcttgttgcccaggatggagtgcaatggggcaatctcagctcaccacaacctctgcctcctgggttcagacgattctcctgcctcagcctcctgagtagctgggattacaagcatgtgccaccatgcccggctaattttgtatttttagtagagatggggtttctccatgttagtcaggctgatctcgaactcccaacctcaggtgatccactcacctcggcctcccaaagtgctgggattacaggcatgagctaccgcgcccaggcatatttttatttatttatgtgctattctcatattgaagggagaggcaaatttccgattttctgtgcagtgtaaaatttcatgcattaataaaatttataaggcaaatattaagaatgaaattgttttagcccaattcacagtggtttgcttcagaagtagcaaacactggattcccaggcaagatggccaaataggaacagctctggtctgcagctcctagcaagaccaattcagaaggcaggtgatttctgcattttcaactaaggtacctggttcatctcactgggactggttagacagtgggtgcagcccacggagagcgagccaaagcagggtggggcgtcacatgacccaggaagcacaaggagatggggaactccctctcctagccaagggaagccggtgagggactgtgccatgagggatggtgctatccagcccacgcactaggcttttcccatggtcttcaccaccgacagaccaggagattccctctggtgcctacaccacaagggacctgggtttcaagcacaaaactaggtggctgcttgggcagacaccaagctagctgcaggagtttttctttctaccccagtagtgcctcgaacgtcagcgagacagaaccattcactcccctggaaagggggatgaagccaggaagccaagtggtcttgctcagcgaatcccacccccctggagtccagcaagctaagatccactggcttgaaattcttgctgccagcacagcagcctgaagtcgacctgggatgctcaagcttggtgtggggagggacgtccaccattactgaggcttgagtaggtggttttcccctcacaatgtaaacaaagctcgtgggaagtttggactgggcagagcccaccacagcaccacaaagccgctatagccagactgcctctctagattcctgccctctgggcaggacatctctgaaaaaaagacagcagccccagtcaggaacttatagataaaactcccatctccctgggatagaacacatgggggaaggagcggctgttggcacagcttcagccaacttacccactcctgcctgctggctctgaaaagagcagcagatcttgcagcacatcgctggagctctgctaagggacagactgccttctcaagtgggtccctgatccccatgtctcctgatggggagacacctcccagcatgggttaacagacaactcatacaggagagctccagctggcatctggcaggtgtcccactgggacgaagcttccagaggtggaagcaagcagcaacctttactgttccacagcctccactggtgatacccaggcaaacagggtctggagcggaccccccagcaaactccagcagaactgcagaagactgttagaaggaaaagtaacagaaaggaaaacaaacagcaggaaaactaacaaacagaaagcaatagcatcaacatcaacagaaagaacgaccacgcaaaaactccatctgaagtttaccaacagcaaagaccaaaggtagacaaatccacaaagatgaagaaaaaccagtgcaaagaggctgagaatttcaaaaaccagaattcctcttctccttcaaaggaccacagccccctgcaagcaagggaacaaaactggacggcgaatgagtttgacgaattgacagaagtaggcttcagaaggtgggtaataacagactcctctgagctaaaggagcatgttctaacccaatgcaaggaagctaagaaccttgaaaaaaaggtagacaaattgctaattagaataaccagtttagagaagaacataaatgacctgatggagctgaaacacagagcacgagaacttcgtgaagcacacacaagtatcaatagccgaactatcaagcagaagaagggatatcagagattgacaatcaacttaacaaaataaagcatggagacaagattagagaaaaaagaatgaaaaggaacgaacaaagcctccaagatatatgggattatatgaaaagaccaaacctacatttgattggtctacctgaaagtgaaggggataatggaaccaagttggaaaacacacttcaggatattatccaggagaacttgcccaacccgcaagacaggcccacattcagattcaggaaatacagagaacaccacaaagatactcctcaagaagagcaaccccaaaacacataatcatcagattcaccaaggttgaaatgaaggaaaaaatgtcaagggcacgcagagagaaaggttgggctacccacaaatggaagcccatcacactaacagcagctctctctgcagaaaccctccaagccagaagagagtggggatcaatattcaacattcttaaagaaaagaattttcaacccagaatttcatattcagccaaaataagcttcataagtgaaggagaaataaaatcctttacagacaagcaaatgctgagggattttgtcaccaccaggcctgccttacaagagctcctgaaggaagcactaaatatggaaaggaaaaaccagttaccagtcactgtaatgtgaaagaccaatgtgtgtaaagaccattggcactatgaagaaactgcatcaactaatgggcaaagtaaccaactagcatcataatgacaggatcatttcaaacataacaatattaaccttaaatgtaaatgggccaaatgcccaaatcgaaaggcaagactggcaaattggatagagtcaagaccaatcggtgtgctgtattcaggagacccatctcatatacacagacacatataggctcaaaataaaatgatggaggaagatttaccaagcaaatggaaagcaagaaagcaagggttgcaatcttagtctctgataaaacagactttacaccaacaccaacaaacatcagaaaagagaaagaggggcattacgtaatggtaaaggaatcaatgcaacaagaacagctaactatcctaaatatatatgcacccaatacaagagcacccagatttataaagcaagttcttagagacctacaaagagacttagactcccacacaataataatgggagactttaacaccacactgtcaatattatacagatcaatgagacagaaaattaacaaggatattcaggacttgaactcagctctggaacaagcagacctaatcgacatctccagaactctccaccccaaatcaacagaatatacattcttctcagcaccacattgcccttattctaaaatttaccacataattggaagtaaaacactcctcggcaaatgcaaaagaacagaaatcataacaaacagtctctcagaccaccgtacaatcaaattagaactcagcattaagaaactcactcaaaaccgcacaactacacggaaactgaacaacctgctcctgaatgactactgagtaaataacgaaacgaaggcagaaataaagatgttctttgaaaccagtgagaacaaagacacagcgtaccagcatctctaggacacagctaaagcagtgtttacagggaaatttatagcacataatgcccacaggagaaagcaggaaagatctaaaatcaacaccctaacatcacaattaaaagaactaaagaagcaaggtcaaacaaattcaaaagctagcagaagacaagaaataactaagatcagagcagaactgaaggagatagagacacaaaaaaaccttcaaaaaatcaatgaaaacaggaggtgttttttgaaaagatcaacaaaatagatagaccactagccagactatatataagaaaagagagaagaatcaaatagacacaataaaaaaatgataaaggggatatcaccactgatcccacagatatacaaactaccatcaaagaacactataaacacctctatgcaaataaactagaaaatctagaagaaatggatacattcctggatatatacaccctccgaagactaaatcaggaagaagtcgaatccttgaagagaccaataacaagttctgaaattgaggcagtaatttaaaaaaagcccaggaccagatggattcacagcctaattctaccagaggtacaaagaggagctggtaccattccttctgaaactaatcctaacaatagaaaaagaggcactcctccctaactcattttatgaggccagcatcatcctcatatcaaaacctggcagagacacaacagaaaaagaaaatttcaggccaatatccctgatgaacatcgatgcgaaaatcctcaataaaatactggcaaactgaatccagcagcacatcaaaaagcttatccaccacgatcaagtcagcttcatccctgggatgccaggctgattcagcatacacaaatcaataaatttaatccatcacataaacagaaccaaagacaaaaaacacatgattatctcaatagatgcagaaaaggccttcaataaaattcaacagcccttcatgctaaaagcaatcaataaactaggtattggtggaacatatttcaagataataagagctatttatgacaaacccacaacaaatatcatactgaaggggcaaaagctggaagcattccctttgaaaaccggcacaagacaaggatgccctctatcaccactcctattcaacatattattggaagttctggccagaaaaatcaggcaagagaaagaaataaagggtattcaaataggaaataggaagtcaaattggctgtttgcagatgacatgattgtatatttagaaaatcccattgtctcagaccaaaaactccttcaactgatgagcaaattcaacaaaatctcaggatacaaaatcaatgtgcaaaaatcacaagctttcctatataccagtaatagagagccaaatcatgagcaaactcccactcactcacaattgctgcaaagagaataaagtacctatgaatacaacttacaagggatacgaaggacctcttcaaggagaactacaaaccaatgctcaaggaaataagagaggacacaaacaaatggaaaaacattccatgctcatggatagagagaatcaatatcgtgaaaatggccatactgcccaaagtaatttatgcatttaatgtttttcccatcaagctaccattgacttcctttaccaaattagaaaaaagtactttaaatttcatatggaataaaaaagtaccccgtacagccaagacaatcctaagcaaaaagaataaagctagaggcatcacgctacctgacttcaaactatacaaggtcacagtaaccaaaacagcatggtactggtaccaaaacagatatatagaccaatggaatagaatagaggcctcagaaataacaccacacatctacaaccatcttttctttaacaaacctgatgaaaacaagcaatggggaaaggatcccctatttaataaatggtgttgggggaactggctagccatattcagaaaactgaaactggactccttccttatgccttatacaaaaattaacttgatatggattaaagatttaaacgtaagacctaaaaccataaaaaccttagaagaaaacctaggcaataacattcaaaacataggcatggacaaagactgcatgactaaaacaccaaaagcaatggcaacaaaagccaaaattgacaaatgggttctgattaaactaaggagcttctgcacagcaaaagaaactatcatcaaagtgaacagggaacctaaagaatgggaggaaatttttgcaatctatccatctggcaaagggctaatctctagaatccacaaggaacttaaacaaatttacaagaaaaaaacaaacaaccccatcaaaaggcgggcaaaggatatgaacagacacttttcaaaagaagacatttatgcagccaataaacacatgtaaaaaagctcatcatcactggtcattagagaaaggcaattaaaatcacaatgagataccatctcacgccagttagaatggtgatcattaaaaagtcaggaaacaacagatgctggagaggatgtggagaaaaaggaaaacttttacactgttggtgggagtataaattagttcaaccattgtggaagacagtgtggcgattcctcatagatctagaactaggaataccatttgattcagcaatcccattactgggtatatacccaaaggattataaatcattctactataaagacatatgcacatttatgtttattgcaacactattcacaatagcaaagacttgcaaccaacccaaatgcccgtcaatattagactggataaagaaaatgtgcacatatacaccatggaatactatgcagccataaaaaagaatgagttcatgttctttgcagggacagggatgtagctggaaaccatcattcttagcaaactaacacaggaacagaaaactaaacactgcatgttctcactcataagtgggagttgaacaatgagaacacatggacacagggaggggaacatcacccactggggcctgttgggggttggggagcaaggggagggatagcattaggagaaatacctaatgtagatgacaggttgatgggtgcagcaaaccaccatggcacatgtttacccatgtaacaaacctgcatgttctgcacacgtatcccagaacttaaagtataattttaaaaaattagcaaacaccagcttaaattgcagttaaaactacatagtttaatggccaggggaaaatcaactgtaaacaaacaaaatcagtatcttttcataggcagcattttgatttagcatttgttgaaaataaaattcaaagcctctcacagaaaacctgcctccttcagaaaaatcaccagttttggagcatgtgtgatcccattccagctaatatttacagtagcatataaaacagctacaaataagtcacatcttcattgctacattatgccaaatgcttaatttcccattttatgttcccttgtcaattctctcctgcttctctcctgtataatcacagttgtccaattgagacctgatgatcttatcagtcatgcacttttactattattatttaaatttgctcctttcaactattatttattgccaagctttgcagagggaagaaaacagacatggtaaaagaagagtaaaggtgggtcttttctcttttggcagtagcaaccagaaacagtatgaaagcaatggatcatgaagaaaagcaatttcctacttgagggattagatagtaccctcttttgtactgttaaatcaaagttttagttattttttccaagtaatactgattttttcaatttacataaacagtctctagggaaactgcaagagacccccaaacacataccctctcagccaatcaacagaaaagataaggaaaatgaaaaaaagaaaagaaaaaccaaacttcctttatgttgtactgctttgagcaaggctttacacagcatggcaaaaattaaactgctacacaagcaaaagataattagcttaacagggaagaatttgaactgatacatgaagctttttttttctttttttcagtaaaagtataggtgatttttattttgaagcagttcacttttgctagcattagaaaattgaaaactatgtaaatttcagcaaatgtttgctttaatgtttaggttcacattgatattaaccacagctatcagttggtaataaattcagatttgagaaaatttgtagcagaaaactactctgaaatgtcatgtgaaaatcctaatcaattttaaatgcatttacattcatggaggaataaaacctactcttaaataataaaggaaaataatagtacatgtataaaatgtgaggaaggaaaatcatgagtctattttcacagttcatttgtaaaggtttatcacttatatgacgtatgtttaagaaagttacaaattttctatagtgaattacttttatgccatataattaacaacaaaaagtcttcatagctaaataataggtttttgataaaaccttataatttatttcagcttattcctgagttgcccagtttttaatgtcttaaaatccatcacactgttgacagatacttgaggtaacattaggtgattagctgacaaagttctagctactattttaattgcctttttcccgctttgtcaaaattctgatgctattaagtcattgttgaactcatcctatatagacagtaagaacaaacaaataagtaaattaacatagcagacatttcttgctttacatataactggagtaatgttttctaaatctggtggaacaatctattgaatacactacaaattctttgcaaaaatgaaatagaataaggaactatgcagggaagccaaattagacgactgcaggtctgtagccaagtggaatataatttgtccattacaataaaataaccttagaagtaggttgaagtcatttagtatggctgaaatttggagggatgaatgttactttcacccaacataaattccttaatccaatagcagataataagaataggttagttgggtaaataaagtttgaatccactgggttttctcggctggacactttttttttttttttttacatccagagttggatttgctgacaggttagagaatgcaacgtatgttgagatttcccagattaaaaaatatataaaaatgaaataatttgtaataagactcagatccaggactaaataattcaatagtctcctatgaattactaggtagtatctatatagaaacaccaagattcatcttaaaaatcagtgactgttcagtcgtaatatttttggagtagccctgtccttggctcactagatggggctatcaacttagacaggctgttgtgacagagtaattctagtttagtattcaatatccattctgccttcttcctggcaagtagaaccatttgaaaggatgagggggaagtgcacagagtagcaatatgtcccactaaaaatacttgctttccaaaacatccttagagtgagagtgcccttgtgacccagttaatcttgaaaaaatgtaaattgaatttacataattaggacaatattttcttaaaggtaggttttggtagactgtctcccccaccccactattttttgccataaaaccttattcctgttgctctcaatgcagagtgaatgcccacgacaataccaattctgagatcatgaggtcaaaaatcacacactaaggatggagaagaaagaagacagaaggagcttaaatgtttgaggtctccctgcaggagttataccagccctgtgtcacctacctttggacttcttattcaatttgaaaactaaattatcagtttaatcctatataagtcaggtcttcaggttttggaagctaaatacacgcctaatggatataactattttcttgaaaggatgattacttagatgggtgagtacgccagctgaggcctccaggcgtctgggagagacatttatccttaaggaaagtagggaacatattatttgctttgggtttctccagatgcattttaggaaagttaaggtactttctttaatacaggagcccattagaaataataactcaaggagaataaggctatcctcgtctcttgaacagaagaaaatgtcgttgagtaaataatactatggaactaaagaaatgcacctatagtccccttcttaaacatgccataaaaaaggaaaagatatccatttcctgtagaagagaattagagcttaatgaagacacactttcaaccaggaggtatctgatgtgggcttattagtaagaaacacatcttcccaggtaatacaactacatgtgagtaagtgcagcctgccatacattctttcatccacttaattatcaatatatcaaattatttatttatctagcaaatatttattgagcacttactctgcaacaggatctgtaccaagccctggactcattcagaaataaatgattggggggtttggttctaaattgaggaaacaagtctttgggcttactgcctcctcatcctgagctgggcagatccccatcctctcttgaagtccatgaaagcatatctaccttctgacatgcagaaatggccctgcaaatggaatctaactggagctgaatgagtattcttgcctcagttaatgtattttcatacttagccagttccaaagcaacaatgtgcacaacttagacatgcttattggccaggtgcttaccacctatttggcaaatgctgtttatgaagtttttaagaaacaaatattgatccaaaatttcccttgcgtttaatattctgtcattctgcaaggccagtattaagtttgatgtacacatacaattacctgtctatctaaacagtttcaactgccctaattcttgggcaccacaccgtgattaaatgtatacaagcaacaagttcttgatttgggcagctagaaaaccactgtggcataagatcaatagttacaccacttagcaaagactgtctttgtcattgcttcctagagtcctcaaaggtcctgataaatacttaaatctagcttgttctttcttttgtgcacatgttgttcatgcaaatgaaatcaaaatttacctaggaagattccagaggacccatacaggacagaagattgtttaaattatggtagagctcatgaaacacattttcaactggtgggatatcctccttatgagactcccaaattctttagagcaagaaacattaacaagcataaatgaaaaaaaaatcctgtatgaagaattgagaaaatagcataagcacagtatgaggaagacctaattctatagttgttattacaaaaaacctggggatttttactaaacaaaaatgtaacaggcaaatttgatggaccttttagcagaaatgtttgtatgaattgaattctagtatccagatcatgagagtaataatcatttttctgaactttgcataagacacacacatgaggtatgttggacatgccatgtgctcattttaaaagatactttgaaaaacaggtgagtgaccagatggttataagagccatattcagtctaaagtaacagagagtaaaggagatagaatagacatgctcaaatctttaaggattttcatatagaagagaagtaggctaattttttattggccttgaaactataggaaaggccaacaggtagaaataggttaataaggaagcacatattgatgatactcaacatacatgaagtggagtttccagaaagcaaacgagtgggggtttggaactaacctacattcccacagggagtttttggtttttcccctgcctaagatcttgcctctgaacatttctttagataaagaaattatagcatttgtaataaataacaagatggctttaggtttaattgtcagccaagaaaacagagtaaattcacatgtaagagtggaagggaaggagcaaaacatcgacattgtgatacatttgggtgtaccctgactaggcaaataactcatcgccaagtaccttcccagggagtcaggtaaccactaataagaaaatagacttatggctataatcctatatattttcattcatatgtctagctcagagaaagaggtgagtggtgagaaaaatcacagcaactgcagacaagggtctataaaaggacatttaaaataaaccaaaaaacccgaatgaatacatttacttaatgtgtattatatatagcctatatattttttattaaacacttccacacttaacactgtatctaccaaactatcagtttcagattaagcttattaagtgtactctgtttgatcataagtataaagagttttctcagcaataattcttattcttccatgccaaatcacatggattgatcttacaggaagttaacaaatcctatatttccaaataaataggcccaaataatttataatgtgatggtgttacttgtcttctatattctggtagaatcgatggacagctaccttatgtgctttcaatctggaaaagtagccagtttgtgatgttctttttgatttctgactataatttccctccataatattccctgttgtctgaaacacctacatatctgaagctaacgggcatctttatagtaagtgatgctgaaataacttctgacctacagctccaggaagagtggctaatcgaagtaatgatcagtgtctcttctacccatttctgtgaactctgatgctttctgaatgtacggagactggtcaagatgttaatctcccagtgtagggctggaggacagtggtagagaaccactacatcaccattgggaggagactgtagtgtgaactaagcaaattagagaatgtagaagaaaggccaaaaggaaaatataaaatgaataatggccatggctaatcgcaaaggtaaatgtatctcttcataaaagaaatttactctatttattgaaagctgacctcaatttctacctcttttcattgagactccattatctactcctatactctcttcagttgttttctctgcaattttgttggcatgattttagttcccatgtattgttattctatctctgcatgtacattgtccctccaactatattgcaaatacattagggcagggtacatgtttgatgttgttttgagtctccattttgtcagcaggtgtttttcttcttcccaaaatgcagcctgccagccacttacaacattttcccataaagccatggtttaatattgtacatcaccctggacttagtgaatttgtaggatgtgcttaggaatctgcattcttaacaagaaactaagcaacaccgatgctcacaaatgtttgctagcctaaggcctaccacagaacaggtgctcgtaaatgtctggtgctgctgttagaatgatgctttctggcatgtctgtatgtatctataaaaaaaacaaagagatgttgatttgctcaaggtgtcctctctctgccactagctagtaaataccttgagggttcatgtcctttgcagacagttctctgtatctccttctaaatttttttctatagcactaagtacttcctagaatgtaccataaataattgtttatgttaaggagtagaaagggaaaggtggtggaagaggaacagaaaaagaagatgaatttatggttgggaggcatacaagggaggtgttattcagaaaactcctttgctttagcgaacacgaattcaaaagtgctaatgaagtctcttcctaatcctttctacttaattcctttgctctgctcttgctaagactgaaaattaccctcctatgatatttttgagattactaaagacagtcttgtgtgaactgaagacaggtcacaaatgactggcatacaacaaatatgtccttagtatctgagatactaaggaactgccggtacctatttttcctcctcaaattcaatcaaaggaaatcatttccatgtcaacatgcacatgcatgattgtatatatatatgtaagtataattacttcaagtggataaacttagcaatgatctttgtcgattgagggcagtgttaatgagctgtaaaatggactcaccctggtgcccaattgtcttttattacaaagggcattctttaacttccactgaggtctaactcccacacaaaccttctgtgctttcatttgattattaccaatagccaaaagtcaaaggtggaaattgagacttaagaacatgttgcttacacccaaagcaacagggaaatgaggctttattgcctctcttctttaggcttcaatactatcaatgttgagaaaacccttgctctccatttccatttgattatcctgagaatatgccttgtactcaagaatttctaacaaaaaatcaaatattttatttttaggaacagaaagacctatatacattaaagattgtctaatcactacaccttaattatggggattatgtggtcagttgagttaagtgatttattcagagttgcaaggttaattaaattatagaccagatttttatcctgggatctacgaataagtttcaagggaaggatgaaccttcaaaattttatgcaaattgtgtgtgcacagctgtgcatttttttcatctgtgcatttttatggaaagtggatccacaattttatcagaccctcaaaatgtccctcaacatagctgggacagttactgttgcaatttataagatatttttatatttataaaatatagtaaaatattaaaggtcatgtaatccaagcttacagccaataaatggattccttaaataataactctgatggatagcatgcaaactctaccttgtatcttaagataattgataaccaaccacctctcatgttatcatggttcaaagcttgaattaaaaaggtattcatatagctgaatcatattatttctttcctataccttctcacattggtctaagtactaccctttgcagccatgagaaacaaaatcactgttgcttactccaatgtctttcatacatttgaagtaaattcctgttacatttcttcttcggtcataagagccaagatccctcagtattctagtcaccactctagactcaaacttagagctggaagaaacacatttcagtttgtcagtattctctaaaatccatataacaaaaaacttaaaaacaatgttctacttgtgatctgacttgttgatgactatctccttctggtggatgtgttctctctttttgctggggaaatcatggtattttacggtctaactgggaagatcagagcctaatgatttttatataggttttccacctgaaatgcaacaaagtaaataatatgcagctggccattcagacccaactctagataatcacatttcaaactttaatagtcatgaggttcacctaaataaacactggcaatttccaaaagagaaacattaagcacttttatttagatgaataatccagtactttgcccagaggttgagtcagaaacaaagaacaaaaaacctcagatttataaaatgagtacagcaaagatgacttagagtataaagtttttctatttcaaatgtcagaaaaatgctcaccagatttacttgattacaaagttccaaaaaaccttttattttgcaatactcactcatatcgcaaactttagtgatgtagcaacaattatgcaaataatttaaacaaagtaaatggactacatgaaaaattcaatcctcatttctatattgattatttataccagcactccccaaagactgttagaagcaacattgatcctaccaaatgctcagaaaagataaaaggccaacaactgaatacacttcaaaaacacaccttaccatacctgcttcttgggactcccactgcaaatgacatattttagtctccaagaacccctctttttaatgacatccattagcactccacaacaccattgttccttataaaagacattgagcattgctataccatgttgatctaattaaccaattttctgcaaatctctactttactctgtgttttaacatctcaacaagtatgagtgtagactcttgggtaatatgatctcattctcctctatgagagcctcctctgcctggttccctgtgagccaaaccacaccccaaggaggagttaatataattacttagattagggcattgactgttttacctaaagaccaggatgtccatatcagatttattttattttattttttattattattattattattattattattattattattttgcctcagattgaggtagaagactctgagactgtgagatcaggataaaaattgttgttgatattcctcttccactcccggcagctggatctctaattgaactcttctgctccctagctcccatactctcacttgcaggaagatataagaacaagagtgacaaaaattcaaatttgcaaagaaatctctcttaaatttcaaggtcatattgggtgatttaattcaatttttatagagagccctgaatttggaaagaaagaaagagagagagaaagaaagagagagagagaaagaaaagaaagaaagaaagaaagaaagaaagaaagaaagaaagaaagaaagaaagaaaagaaagaaggaaagaaagaaagaaagaaagagaaagaaagacagacagactagtcacatattctgtattgttttctgagaatcctggggagtaggggttactgaggatggtattaaaatcatttgcaggtcttggctttaatatcatcaaattagccccaaagttatttgtgattattatttgcttttgagttcttgtattttaaacgttatcattaaaatatttgcaggtagataaggaaaagctccagatttgcttcaaaatgatgcagttggaaggtagagattgaaagggttagggttacacataaaatggtagttagaattgcacgatggaggctgggtgtgggctcacacttgtaatctcagcattttgggaggccgaggtggggaggatcacttcatctcaggactagcctgggcaatatagcaagacctcgtctctatttcaaaaagaagaaaaaaaaatagccggctgtagtgggggcacacctgtagtcccagctactccggaggctgaggcaggatgattgcttgagtccagaagttcaaggctgtagtgagcatgctattgtgctccagcatggaggacagagtgagactctgtctcaagaaaataaataaataaataaataaataaataaataaataaataaataaaattgggtgatgatttcatttggcttccttttacttgcctgttctcttacttgtgtgtgactgataaaatctgagattataattaaataataaagcaccaaaatctcacacagaactatcaaccatcataaataaactcatagacataagtggaagagttggaaagtttttgccaagtggtcaagatgttcactgctgtaactaagagcttccactgaagttactattatcaaccacagcactcataaacacatagcactcctgggcacattttctatttatttaagtgacttaccttatttgatcaaaaagaaaatattaaaatcaccataaaactatgtaattagtgattgcatggtgatctttatgtgatgaaatttttaacagttaatatctaatatagaattaagaatcctacacaatattttaaagttatattttcaaatccatattttgtggatttcaaataattccagtttgaatgcttgcaactgcaacaggtttctgtaaaagcttttgagtttcacagccttccttttgacagatttcttaagttatggaatgcagccatcagcagtctgtagaaaaatgaaatgctgcaagtctatttttatgcagctgggatcaagttactaaatggatcaaaagaaataatttctttgaagaggtggctgttgacaccagtgccctaaaaataagtgcaattttgtgggcataaaaatttgtttatatcttagtgaaagtaactatagatatattttctatatatacacttgcattcatgatatattggatgccattctaaacatcttttaatataccttagtttaacattgcttttaagaggaaagttgcatgctttctcttgaataattgatgtagctaaagacaattattcataccaggcttagcttactgggtttataataaaaacaatgatagtaatttacctaactcttactttgtgccaaataccagccaaatacttcccaacattatttcatttgattttagaattacattttattttaataactagctattattttcacaattgtatagatgaagaagctgattcttagagagtgtaacttgccaaagattacacggctagcatgcctctgagttaaaatttgaaagctagtctgtttaattctgaagctcttaatcactaaattttatactacctctttaggttggatggcatatcaactgatttgaaactatagaaaaaaattaggaaacagaataatcttttaaaatatctttgtatgtgaaagtaagcttgcttatagaaaatgtagtaaattgaaagactattactattgcaatagcaatagtcaaactgaagcctatagaactcaaatgcatgtaagtgtcaaaatagccaagtaataatgcgatatgatataattttttatcataataaaaagtcagaaaacaaaattcataaagagggctctatgatacaagaggaaaggttgatctaagggtacaaactaaaacattttaaataaagtttttggaaaaaacaattttaggctccgaaataagaaataaatacaaccccttcacagataataataaagaaataagccaataagcccttaaaatagaacgatatagtcttagctctggaggacaaaatattctctacttggaccctgactcatttagaactcctgcacataaatacatatatatatacacacacacacacacacacacatattgactatattgctgaaggggagagtaaaggaaatggtgaaaggatcatcatttttattatttcattaattcctgaagaaaacacatacacaaattgcaattgaagcttctaaaaaacctagaaaacagtataaaggacttagacacagtacaagtatttcctaccatgtaagtctgaaagagagaaaatcaatttttatgaaaacataaaacagtgatttgggttgtgaacaaaattatttgtctccatttgtgttctattggcttactgctctgccaaattttgaagcaaaatgaaaaaaaaaaaaaagagagggaaattatagcaaacctcccaaaacatatcccttaaactccgcaatgtatttaaactacccaggttctgttcatggatatactcaaacattgagaaattgtgggtgtactgggttttgatgctgtactttttgtaacaacttgatattggagtcaaaacatgtttttctatcttgtgttgctcagaaaggtatgagcaaatatatttttcccacaaatttcaattaattaagaatgattaaaatgtggatacttgcaagggaaacattaataaaaacatgaagtgtagacatagagataattttctctgtggcggatgactgatcatgtcattaggcagagctttgttcccttaggctctgtagagtcagagctaggataaagaatcacagatttagagttgaagaaactcttaacaataacttaacaaccattccaatccccttgatttatagataaggcaggttagtcttagaaagaggaaccggttctttgtgtgagactcaacaagtcacatcaccgctctgcgcttctgttcccaaattctttttctttctttctttttcttttcttttctttttttttttaaatgagtaagggatttcctttattattagtgagattgaacatcttttcacgtcattattgaccatttttatttttctctacaaactgattatccaaatctttctcccatttttttcttttaaaaaattaatttaagatccaagatacatgtgaaggatgtgcaggtttgttatgaaggcaaacatgtgcgatggtggtttgctgcacctatcaacccatcacctaggtattaagcctcccacacattagctatttatcgtgatgctctccctccttccaatccccctaacaggccccagtgtgtgttattctcctccctgtggccatgtgttctcattgtttagctcccacttataagtgagaacatgcagtgtttggttttctgttcctgtgttactgtgctgaggataatggcttccagctccatccatgtctctgcaaagggcatgatctcatcattcctttttatggctgcatagtattccatgatgtatatgtgccacatgttctttatttaatctatcattgatgggcattttgattgattccatgtcttttttattatgttctcacattcttaaaattaaagttgggactagttgatctccaaagtgcccacatactaaacgctgaatggtttcaaaagaaaagtgagttaatggcagacaataacctcagatctcagttcctaccttgttctcaccagtccagtttgtgttctgccatttgctcatatatttcactgtcactacgtacttatgaaatttgtaagtcaataaatggtgaagaaaagaaaaacaagaaaagtcatccacattttagaagggcaaaattgtgagtaaggagctgagtggttgaatccgaatattttcattaattccaaacaaaggcaatggaaagtgggaaggaggggaattgcagttctataagctatagttgctccataggagaaagggaagagccagcagtaatcaggactttttaaaagaactgtccaagttcaatgacaatatcatctagctctctgactctaggcatctgccaagaatcatggaatcttcatctcagtaaactaaaaccaggctagacaaagcaggcacaaagaagaagagaatcacattcaataggttagtcagtatatggtaagctagatcagccatggaaatatgcattagtcaataagtttgatacctaaatcaatggagacatggtctaataactgacctttcattttttggggtgattttcataggcatacatgtttacatagcaactccatgagaatttacaataagtagatgctgatattcattgactattcagatagtcttcaacttaagatggggttatctcctgataaactcatcgtaagttgaaaataagcagaaaatgcattcaatgcacttgatctatggaacacaatagcttagcctagcttcaaatgtgctcagtgatatgagcttacagttgggcaaaatcatctagcagcacagtactctgtagaatttcggttgcttaccctcgtgattaggtggtttactgggagctgtagctaccagctgctgtccagcatcttgagagcctatgaactgctttctacccacagttgcaccaccgtaaagttgaaaaatcctaagttgaactgtattaaattgggggctttttgtaatcatttaggagtattaataatatgtaaacagtaagagggagaaatatacagcaataaatgcagatggctcattcctaatttgagaaacaagataatgcagtttattctgaaaagtgattataaatttgaaatttatggaaggaattcaacatcaaacaggtaactttaagagggaaactcttcctgacccttagctagactaagttatgttcagataaagcaatctgacttcacacacatatgggttgccggacttttctctcacttacataattttgaaataatttgtggaatcatttgtttaatgtaaacattcttagattttccagagagattatggaccttgccttggtcatgggtgtagtcccagcccttagaagagtatctgtcatgcagcaggcattcaaaaaacatttgtttaatgaagaaatgtccatgctacaatatgtttgaacagaggagagggatagaaagaaaaaaaaagactggaaaagaaagagagagaaaggcattattcagaggaagaagataaaagagatgaacagagactggactatccccatgacattcaaaactgaccaactgactctttgtttcacacattgagtgacccaggtcaaagccctatcagtcagtatactcactttgtatccctgacacacatatattttcctaagaatggttgcagagaaaggctggaaaaaaaggggatggaaatgaacattaaagagactgacagggaataataacagtgaaacagacaaactctattgtgtacaactccacagtcgaacattttctacctccctgagaatcagtctcgcttgcaggtagagtattgactgctaggcagagcaccatggctataaaacagaccactgagctaggcaataaaagagagagagggagagagagagaataagaggtctaatgtcttgtttatgtcccctttatagcatctttgagaggctctgcagtcccacagctggctttagttcatatgcttttctgattaaggcaatacgtaccaaagcaatctaatattaacgtgcaatttagaaaaaaatagaagggtgtaaaaaaggaggaaatctccacaaacagtgtaactaaacaataaacagaatacaagacttgcttaattctttattaaatacatgctttattttaagtccctaaaacatttgtatctcattttaaacacccagttctaccatattgtgtttagtgacactaatccttctttatagcctaaccctttgagaaataagattatgttcccagtaaatagtagtaacaagttttattataacaatcctgatcacagatttataaaaaccttaaagaaaaaacatggaaatagaaatggctaggataatatccaatatgagaaagatctttatttaacatgaagtataaagcttggctgatgaaatgtctctaagaatatttccaagaatatatattttttacttttcattaagaacttgactactctttttaatcttagacattggttttatgctttataaccttaccattgtgaaactcagcgagcctagagaagtttgggtactgtgtgcaaatctactcaagtgtttagcttaccacattgctgagaaatgaccacatatgtgtgtgtgtgtgtgtgtgcgtgtgtgtgtgtattttttttcccaagagaatctatcttaactctgctgattatactatataacatatcatgactatcttaactgtcaaaatggtcctaaggttttgacgcaactgtttcaaataaacagttgttttcaattcttttttatatatttgtatctgatcttgagatttagattgataataatagtagagtggttaagtgaagaaatttaagagtcagagaggttataattctggctcagccacttactatctgactgagcctctgttttctcatccataaagtgggaaaaatacctagccactagggattgtgtgaggattgaataatgtgccttgtgcaaagaagacagcacgtgcccaatacataatgtgcactcaataaatgatagcaatttataactacaataagtgattgttagtattaataataaaagccacccgttatagtgcagtactgttaccataacaaagcctgatgtctatctcaattctaagaaaggctattttctacctcctgtcttctctgaatttctacttatgccatattatcatcaccaataaatatttcttgtaagcctaataagcataaggtattacattaggccctctaaagaatacagccagaatcaatcattctctcatgtgggccactaccagatctgtacttcctctatcatagcagcaatattctatatagtgatgatttatttgtctctatttaacccactggatagtgtgctttcatagataagtcttactctatattcccagcacccagcataatatcagggacataataaatgcctatccaatgcagaatgaatgaatggaacatggataagcccaaagagttcaggttgaagagagacattatggacattcaaaagcctagagaacaagacaaagtttcatatacttatgaggaaaaaaaaattgccttctctgtgtcagtgaaatgctattgttaattcataaatgaagtagtagtctcatcacgacagtcttctgggtggtttcatcttatattgtgaacaaaggaatgggtggcagaagagggaggaagaaactcttaaaggatgaattaccaaagagtacctggggaaacaatgtgattttttactgggcttacggcatgccaatcttgttagttttgcgaataaactgacaagtagaaattggaatttagtgagaagtctaaaggggactcaggcttttaaacacacacacacacacacacacacacacacacacacacacacacacacacaatctgcttttggctatgaaaaggagctagagtgatatagaatggcatccaagagagtaatgcacatcagaagaaactagctccagatactattaggttggtggaaaagtaattgtggtttttgccattactttcaatggcaaaaactgcaactgcttttgcaccatcctaatagttttaaatgcaaggtgcttaaactaattgtagaaccagccttcttggccttatcaatcaactagcaaatatgcttcagtgtaagtcaactgatcagagggacttttgccaggagtagtttcagagattctaagatctggggccatagatgcatacagtaggaatgatttaagatgggtctttagtgtagaatcctatgaattccagagaagactgttacaggacagagaagttatttagtctgaccaaccaggactgggcttgaggtagtttctgaagagggattctgcaaggcccagagtagagcagagagagttgctcaatctccgaccagaactaggagaactagtttaaaaggaagttgtaagaaagacctattactctatttatgaatgaagtaaaggaatgaagaccttacaagaaagatcagaaatccttatcactagcatacaatgtctactatacagtaggcaccaaatatcatcttgttaaattaatttgttgttgctctgatacttccccattgtattgatttatctttaaatgcttatcatgattttaatttggaaataagaatagtcttctcataatattggagtgtcaagtgagaaataacaaattgtggttagacattgacaatctctgataatctgtcaagacttttacagactttacttagtttaattatcatgggacgtcagagggaatatttacaccagtggatactagaaaaatgaaaaatactggtttcttcaaaagtatagggaaacaaagaggaaacctttctcctgggcatcatcacttatttttctttgatatttattaagtgcacacagcattccaggtctgaaatagcctatggccaggaagcttctcctcctggactggcattatttctccctagatagagagttatgaaactccaaagcggaaggaaaagttcagctgtatacgtatcatctgaagttccccatgggcagaccagttctgattcaagtcaggacgagaagagattagcgagtgggaagacagacatacggtgaatgtcagttgtctctgaatcttgattctaatgaaaagtcacagcttttactggtaatgccctgaagaccaggctaactcagagataacctttgcttaggaagacttcttgagccgcctcaggttcaccatactttttctcttgctctgaatcctcctggtacttatcctcacagtatctacctcactcatttgcattatcttgcctttttttattttagaattgttcccatcatcatatatgttcttggtcacaagcaacttgatcgtaaataatattaattttccttatgatctgattctttcagggccaatcaggttgtgcagaatgaattaatgtgaattgaaattttcctaaaactttgaatcccaacttaggtcttcctggtatactattgtgaggatttcagcagagtacaactaggacagaatatggtctggtctgatcattcagtattgaattgacctaggaaatactctagaagatacttggaacccaggtatcacgcggcctgttttccattcagattcaccatcatcagttagcgtaggagaaaaagggcagaaggaagaacaagaaagtaaacagctgctaccattaagaggaaatctccatacagtctgagatctcccaggctcaaaacacatgagatttaaaacaaaaaaaaattcttttaaagttttatttttagttaatacacaataattgtacatatttatggggcacaatgtgatgtttcagtacatgtatacattatacagtgatcaaaatatattttaaggattcccttcaattgtgcattggccacaccccctactatggctttattttcttctcagaaagaataaacctgacaaaagaaaactaggttaagagtgggaagaaaaatgggtcctggtactccctgaaaataatatacatttgacaaatcttttacattgcttctctccataactgtaaaattaaaattcttgagcggaatgatcccttacagattttttttcagccctaatagtttatgctgctatgattctagctaatcaaatctactcctgacagtttctcaccactgtggaaagtactacaaaaagaccagttgggaactggcagctaatcttccatccttctgatagctttgctgaaaagccagttcaacttaccccgtttatacatgttgaacttgcctagatgcctgacctttgtcagattttgaagagaagaaagtaaaggaaaggagaaaccttctctccatccaacttttactacacatgaagtggtaggtcagcattaaatgactttttatctgtttctgccttgtgtatcagaatatggattttcctaagtgacatcaagcttaaaaaagaaattagctagtaaatgttttcctatctattgacacaaagtaaaattatgatggctttaaacaatgcattctcagccgggtgcggtggctcatgcctgtaatcccagcactttgggaggctgaggcaggcggatcacgaggtcaggagattgagactatcctggccaacacggtgaaaccccatctctactaaaaatacaaaaagttagccaagtgtggttgtatgcgcctgtagtcccagctacttgggaggctaaggcaggcgaattgcttgaactcaagaggtggaggttgcagtgagccaggatcatgccactgcacttcagcctgaatgacagagcaagactccatctcaaaaaaaaaaaaaaaaaaaaaaaaaaaaaatgcatcctctacataaggtattgtttagggcccagtttcagttgctgattgtccccttctctactaaattcttcaggtctgtaggtagtactctttcccatgcacaaatacccaactaatcttcagacttggaaactccacttaatgggttgtcccaacattttctttaaatccatgaatttcacacttacttccttttttgttcaatacttcaaaaaaattattattacttttagagccacatacaaccctgtcttgcatctcttgtatttttctccacctacacatgggcctgttttctttgattctcccaggtctatcccagctgctccttagaatcattcacccactcaactcttggcaacttctacattgctgtcccttaatcttggaacagccttccaatcaatgtgttttgagccacctcctaacttcagaaagaaaattcctcaaactccatctgtttagagaccatctagtttcaatgatcagtctcctcaccattttgagaactcttctaacatgttgaaatgtaaatactaattgttttcacataaaaattagcaagcactttagcgtttaatccaaacacccccaagctacactttgaatgaaaatcttcaatttcccccaactttcccattttaaaaatgggattgttttatgctgaagttaagaaatgaatctccattgcagtctgtgcatcaatgcatgagtgaaggaatgtttgcattgctttgggcactgtagagcctagacactgttcatgtacacatggttaacaatttacttctctctgcagtattaaatcttctcatgtcagagactaatagatcacagcatagttaacttactcaaatgacttccttaattcagtactgccagaaagcatttgaaagcagcaaatcccagaagtcttagtgacttctacattaagctaatgaaacgcatgtattcatgctacccgggaatgttggtggcatgtggcttacacctcaaaccaacactctcagtgggtaaaccaggagtggcagcgtgccattttcgtatttcttttcctgagctgcacactaccaccactttgatttctatcacagctgattccctttctaggaaactttccaagcttgttctcacacagcctaagagctgccttttttcaaccttcatcacttagaataccaacaatcaacatcctcatgtatttcccatactggtcaacaattttatcaatggctttgataaaagtaacagaaggcatgcctcttatatttatgaatgacctcaaaataaaaaacgtcaaccttaaggtaagtaaagttcagaaatttcctaagaaaaaaataaaattatttattattaaatgtatgtaaataaaactttcttaaaatatgcactacgaaaaggtggaataaaatatatcaaactaaaatagtgatatattttatcactaaaataaataactaaatatacatgcatatatatttatagatgtataaatatctatgatatacaaatgtctacatagatctctacataaagtttttctatactttccaatttctgtttaatcatgctatagtactttgataagaaaaatatattttaacaagtcattcattattgaaatgcattttgttaaatattaaagacatcaatcatacagaactgatggttgtaagcaaaatatcattttgctatatttgacagagataaagttaaaaatttctgcacttaaggtttaaaagataaaatctgtaagtgcaaaatattggagatttgtcttaatagtaatataattgaaaattatcttagatttttttttcaaattaagagtgatctcaacacaagccaatcatgagatttggctgccaaaaaagtaatggttcataggaggtaatttcaactaatgagtcttacagaagtaggaattgagcggttgtctttttttcagcaaacccagaatgaaagagcaaagtcataataagattatagactaataagatgaatataagcaagtatgcccaacaagcaatagaacccccaaattgagaccttcaagcaaattgtgggggcaaattgacagggagctactgatggcatcttatgcccccttgcaacttcaatgattcaggataccaagttgcaatggaaatgggaatgacagttattgcatcctgtggagacaaacatatacttcccaagaatgaagtgtgatctgtgtagtgagaatactgggctacgcaggagaaatactgaattggtggccttgagcaaggcacttagcttgcagttccttaatctgcttgtatttagtgttatgctgcccaggggctggacaaggaactggatggtttataaacacaattatacctatgccttatacaatactccatgagagctaatactattttcaatttatagttgacagaacaagctgagtgatctagtgcatagtatccgaagtttttttctaaagttagcattccttgcttcattgcaaaaagaaaaattagagccacctcaagtttcaaatctgatcatatagggtctgattcacccaatggttcctcacatttttcatgtgttgtaacttttatccatgaatatacaatttgtctggtattgtaataaaacaatagactttcaggaggaatgaaaaggaggtggtgaaggaatggaaaaaagtttcctttaagtaaagctagagtaatctgcttggcattcctcacaaagtttaaaatatatcccatttataacaattataatggacttcagggtgggtggggtaaattgatgagagataagaaaacacctgaaaaggtaaaatccatttctagttaattgttatcaattaagttgtttttctctcactgggacactgttctcagtgccctcaggccccaactacttacagtgaacagaactaatagcagtcagtttcattatgtctccttaacaacacgggaacctgttgtcctttaaaaatatataactgttttaacctttacattttttatttactcatacctaaatagagaacttctgctaaggtaggagaagtgaataccaagttcagctcaattcagttagttgtgctaaaggctaaaattacaggaacagtatgaagaaataattgacagctgaagtgcatggtcctatgaagcttctcttcggggaatctgtgattgctcttaatggcattttcaaaaaaaacaggtcctgttaattttcaagatatttttaaacactcgattacttttaaaataatcagcaccattatgaactcccaggaggctgtgaattaagaaatgaatacctttattttataacattttacaaaacactcactgtggacaataaatatcaaatccactaggggcttgggtaatgaaacacacgtcttgaaaaagtaaaactgaaagatgattagataattaatcacaattaaatttctcaactgattttgaaggagctaaacacaagagagcagtccacagcttcatcttttacttgaaactttttgatgcctcaaccccttacagatttaaggtacatgctgagtaaaccattttggagaagaaccaactataccaggtagaaaaactacattttgggcaatctggggtggggagtacaggcatgattctgaattatgccattcataatacagtgaagtaaaatagactgattatgaatataccatgtacttgaattgtccttgcagtggcacagggctgatatcaaccaacacaaacaataaatataatgtacctacatttctaattgtttataatgaccatcaaatatgattctagttctaatctctttgacgatcttctagaggtcataattctgtggaggacttgccttagctcgggcaacactgagaatccagtacatgtgtactggcactttcatagccacttggaacacatacaaatgctgtatttatctttattgccctgtatacaaaccagggtttggctttcctgtatcctgacagtcaaaacatcttccggaaatgcttctcagcaggaagttggcagtaactctaaaattgggtttctgacagggcattctctaaggagtatcgttgctttggaattataattttatgctccttagattccattcaattatattgaaattcaggatatttgttgaaaccaatcctgatactctgggaatgatagggcattcttttcttatcatatttcagagataactatcaatcattcttttagtcttccatttctttgacacccttttattgaacatctcccactaaataaaggttctctgattgattttatgcaacagcaaagtaaaaaaaaaaatattgttactttgagatgtttatagtctggttaattatgtggtcactacattaaacaaaagaaaacacatcttgtggcgttagcagtatgctgacagcctgggcaacgtggtgaaacctgaagtctacaaaaaatcccaaaaatcagccaggtgtggtggtgtgcacctgtagtcccagcttcttgggaggctgaggtgggaagacagcttgagcctgggaggcagaagctgcagtgagctgagactgtaccactgtacttgctagacacagagcgaggccctgtctcaagacaacaacaacaaaacaccaaaaataaaaagtaaatatgtgtgcaagcacaacatcagaccaaaatggtgataaacagacagattcaggcatatgaataagttgacatgtccaatgtatctagtatcagtcttctttattcctaaaatatggaataaaatatgaacaccatttagtccaatgataattcttacatagagaaagaaagttagacaataagttctgagacaatgtccaccagcatacaagctatttaaccaataaacttagatttattggttaataataataactggtatcaataatatatgaacatgtcattgatacaagtaaatctcttgattagacccaaatgtatgaaattctaatactgattctttgtcttttctctcttctcttatctatgtccaattagtttttcaaggcctctcagaggttatttctttcagttcccaaactacattaggttctcctataatcttttcttggtttgaagcatcttcgataattttaagttaataaattgctattttttatcaatgtccatcttccacttttaaacttaatttcatttagctgacttgtctgcctttgccaatatacctatgaccataggagagtaactggaatgtagtggatatacatatcgttaaaaaagctgttgaaataacccaaaccccagggaaggcctcatattcaaatggaactttaaatacaccattgctggttatacttggtgatgttatggtatctaatttcttttcgtgaaaaggttaaattaacaaattaaaatttcagactggcatgtcaaactcagaattatttataccaagttaggcaatgaaatgcctacatcttatacttgattttatatactttcttcgtcttaaatagtagtattagactgtattgagtatcaaaccataagtatgcattctttctgtaaaaatggtcaaataaagacaggtaaaaagcatggattttcctgtatgtttttatagaaatttcatgtaagctaataagttataggtttgcctatttaaacaggctttcacctggaggacaatggggtgttacaggaaataggagaaattctcataaggatgattaagttttcctaacttctcctcctgccctttttttaattccatgaatcaaaagggaagtcccctttgtacattcttcttttaacttataaaatctatttgaaaacttataatttaagagaagatctttttgtgaatttaggaacttattcctgagagcaactaatttacacaggctagtgtggctcacgcaatgacttaatttttaaaatatcaatgctgtgtaactgtactattgctacaaaagttggtgacaggagaccttggtaagtgttatggtttgactgtgttccccaaagttcatgtgttagaaacttaatctcccatgcagcaatattgagaggtgaaaactctaagaggtgattaggccatatggatctttcctcataaatggattaatgtcattagtataggagtgggtttgttacaaaagaaagtttggccccctcttgctctcttgtgctcccttgacccccacctcccctcaacacacacattttaccatgggatgatgctgcaagaaggccctctccagatgctagccccttgcttttggacttcgcagccaccagaactgtaaggaataaatatctgttctttataaattatacaatctgtggtactctcttatagcaacacaaacagattaagaaaataaatcatattagtatttcacaacctagaagagcaggaattttaagaataaacccctgaagcacagagttgatgtcatttattctaatatgctctggactgattttcccagactttggaaatgttttacctttaacttccagaataactttcaagaattttggcctccctagtagagctcagagagctaaaacagcagaattaaaaggtcttgggagtgaggcagggcagatgaaaatgagaatgttgtctcagatatgttagagagtttcacaagtttgcagaaagaaaaaaaagcaagaaaagacaactgaaagatacaagtaaataagactgagataaaatgctggaataaaagagaagatccctgagttgactgtgcattaatatggaatgggaaggggaattgaaaaaaaaataaagcctatagagcaaaattttattagaatagcaatatcataagttaatgagtttggttataactaaacctaattatagtgctttaaaaataatcttcttgggaagagaatccatgtgtttcaaatttacattacatttgaaatacaataaaagcaaccctcttaaaatatagttattagggattttatcacttattttgaaaatctaatacatgatattgaagcgttgggaacactgggacaatgttggtttttgtcacaatgcagctttatggcaaggattcctattcttgtttatttaagttccaatgtactaataagataggctggcttttagcaaatggatcaatgagtcttaatcccagatctgagactctctgttggttacaaagcttctaatttacacagaagaataagaattaaaatggtcaggctgcaacaaatggcttagggatgaatgagaaacaattgaaagtaatttcctcaattatgtctcttctctttttacatgcagtttctgtacaattcagagaggtacatacagagggaccacttcatttagtaatctatgtttccgacaataaaagaaatcttatgaacaattgacttattttcatttgtaaacatctctgcagattaatttttgctgctacttaatgaggcagattatgaaacttacttattaatttatcaaagttgccatctatgataatcattgaggtgtccctctcttgaactactatctgttcatcaccaatacagccaatcatgcaattctaaaatgatgtgatcacaaggcttacatgataactagcgatgaattcatcaaaccaaacttatttaataataccagaactagcaaaaatacactaaaggagaaattaaactgcaaataccttctcaggtaggctttttatatgattgtcttactgcctttctaattcccatagcgacctcctttgttattatcctgctacataaagagttgactgagttgaaattacttacagattatcactacaggatgcattttactatactagcgttttgatagccctgactgtaaaacattgccagatgataggatcatagaagaggaatagaaatgtcaatgcatttaagtcatgagaaggtgccttagactgcaataggtaaggtgaaaaagagatgtcttttacaaagatatgcaaatattaaatatcataaatcagttctaaattttgagctaaactctcagaccagaataatttcaactttaggggaaaaggtgaattgatatacagtaatagaggacaaagagaaagctcatagtggaagtaatattctttgtaattggtcatagttggtgcttgataaatacatgtttcatacatgaataaacatgcgaaaacaaagacgtagtagagaaaagttttcaaatgggtatcctgaaagctatatcaggactgctaactagatggtttggccaaggtagtgtattaaaagcaaaatgagcttggtacagtggtgtgcacctgcagttctagctaccagggagggtaaggcaggaagattgcctgagcccaggagtccaagaccagcaaaatgtacagtgtttaaaaatcaacagattttactttaaatcttcatttctttaaaatttggatgacatggaaacattcccgggaaagaagaaaaaggggagaactataatggataaattgcaggcaacaaacccaagacattttcaaatcaacaggtgccatctcaagagagaagccattctattgtccagatgttatcaatttctaggtattgtaatttaagggccctctccataccaaaaaaaaaaataataataaaacatatgtatactggatgttttccttctttgaaacaatttatttctttaacatccaaagcgctaaacattacgtctgtttttcttatcatactgccatttattctcagaactcaatcgcctctttagacaaagtgcatttctcacggtacctggtttctttggtcatttaatttatctgcttgctgaaatttgagtcttgtgaccctccaagtagaagttcaatgaaatatttcagggagaaggattacaggatagtgtgctgttttcaaaatacacaaaacaggaaactgttaatttaagaagtaaagatattttggctgtggaaaacagaaagaacttaagaaaaatgagaaagataggtaaaattaggctgttccaaagtctggattttttgaaaacttgagatagaatgtatattgttcctcacttttatcataacaacttcatttttactagtatttttattctctgaagtttgttacatcgaagtgttcctttagcaggaatagatagatttgaaaaataggcttaatctactatttcttcaggactttctccctacatgagaatctggcaaaattactgctcacttgctgctgacacatacaattcccaggaaaaaagaaaataagaggaagaattatgcgagaaaaatcacaggcagcaaataaacccaagacattttcaaatcaacaggtgtcatctccagagagaagccactttgttgtctccatgttgccattttctaggttttgtaattgaagaatgtttctctacactataaataaaacatctgacacggtagattattctcttttttgaaacactttattttttcagctttcaggatgtcacacgctagttctatttttcttagcttgctgaccatttattctcagtattctctgctagattctgttattttgtgacctccaaatatgagaaggctcagttttcatatctcttccccatctaaactccctttctgggtaatttcatcttgtcctgcgactacaatctatctatatgtgatgatgcttatgcttgcatctccagccacaactctccctgaaaattctgactcatgtatccatctacctacttggatgtccactaggtatatcaaaaccaaagtctaaaaacaacaacaaaacatccacttttccactccaacctcccccaaaggataaaagtcttgattttccattcgcaacaagtcttccgctaataacaccactattctcacaattaagtgggtcagaattaaagaatatatttaaattccgctttcttccactccacacctctaatctgtcggcaagtgcagtctgctctgtctctaaaatgcatgtgggattttaccacttattggcttgaacctcacaaccacctaaatctaagccaccactgtctcttttgtggacgcctgctacagcatcctaatacggttttttttcctccctcttctctgcaatctattgtccacactgcagccagagttatctttttttaaaaaataaaagtcatcctcatgatcaaatgttcccagtggctttctaacacacttagggtaaaattcagatccttttcaataacctgaatgatatgagaaggcatctggcctccttcctgctcttcctggcctcctactctttttccttcctgctcatgctcctccagttacccaggtcttcttattcttcaaacatctgcatttgctatttccatgccttgtgatcctcttcaccaagacagtcacatgactacttttcttatttcattctagggtataataaaaggtcccctttcaaagaagcctctcataatttttcctaatataatctcctattactttctagctcactttttcccatttccctgctatgcttttcttcataggtattatattatactcacatcatattatttcttttttctttgttattgatattctccaatagaaattatgttctaggaggataagaattctattttgtttacacttgcccataaagcctgacatatagttgacactcaacaaatggttgccaaataaatgaataaattaaagactacgagattgaaataccagaaaatgatcataacacttgtcctaattctttacctcacatcaaaaagtgctaaaatgtgctgtttaggaacccaacaaagatcacttaaaatattttattaaacatactcttctacaagcagaagacattataaaaaagaatttttttctacacattatttatcttgctcacatttactctgatataaaaatggattctaacgtatatatcagctctaggaaaaatcaaagcaggtcctttatatgcttgctagttttaaaatacagtctgatttcatccacttcaattgaatacgcaactaccatttccttgtactctgctgaaacttgtgaaagataacaaaatgaatcacaataactattgtttatagaacaacttaacttatgccagggaatgtgctaaaagctttacaagcactatatcatataagttcctgtgacaactccatgaggtataaggttccctatttcagagaagacaaaactaagtgagtcagacaacttgtcctacaccagacagctgttaagtggaggtgaaatttgcatccttgcctttctgatggctacattggtcatttttagtgtagaactcactgccactagcaggactcaagaacactcctggtgaccctgatgactcagttcatccaaatatgtaaatcctctgctctgtcgttagggactaaggttgttgaaggccatttacctatgtctagagtatccttaccagtagattattgaaaagttattgaattactaaaatttagttttcataaactaaaattagtacttaatagagtttactgagaattctaattcaatatcctaatgagaaagctggctgctacccaacacctgagagcaatgcaaatcgcaccctctgcaagagcacatgcaaacaggcagaactgccaaaatcttcagcacagataaaagtgtaagtggttttcaagtgccatttaaagtaacattattcctactctaaataacaaattcctgtttatttagacttcattattgtcaatttaacatgtgaaagtttctttgcttaacagtatcacatgtaatggtacttatttgaatcagaactatttgtgatctaaaattgtattatggatatatttttagatagctacacatagcaaacaatatgaatcatccacattcctgctacaaagcaaatatatacatatatcacaccctgcttgaattttactaggtagtgaattttttgttatcaagagtttgagagttttttgttttgtttttggaatgggttatgaggaattgtggtcaaaaaacgagaacttctttttggtgttaacagggctatgtctgctttgctctagtgattcctaacctactgtgcgaaggaggcatagcaaggcaagactgtttaagtataaccataaagggactcacgcactctcaggtgaagtgcaaaaatactgatcacggtgctcaaacattctggaggagtaagcattcaaattcagaaatgtaagatgatttctcaaagaaaagaggaaaaacctatcattaattttttaaaatatatcttccagagcaggtttctcaacaattttacatagaagacgagtatttttgtctccttaagatttggacttaaggtcaaagttgttgaaggttgatcggctattgtaagcttcaggtgaaacctagagaggagaagggaagaagataaatctactatcctagattctttttaagaagcagcacgttccactcctgactctcccgaagatggtctcaggtcttcaggtgaccctatgcaaggaccctactgtgcactctgctgagtgttctggctctctggtatcaggtcactgggcctactctacttttggtgtcattctggccctgtgaagaaactatgaggagaatctggtcgatgcattttgtagttaacaccgcaaaggacatgagaaacttagccagagagctattagagtggcgatcagtgacgctgctgctctacccagtctgtcttgtgtgctttaagatggaagacacctaatgctgacttagccttccctaaagtgaacagaccactcttctaaggtttctgcttgttgtcaggaagtataagcaaagaatgacaagcagaacaatggacatttgttaagtgattggcttgcatacgttggctccttcaatgctaacagcaacgagtaggtgccattattacagccatgttacagatgaacggtgggtactattattaagtccatgttacaggtgagggcgtgaagcttatcaaggagttcattggtcatttcttgaccaggacacaagctcctaatgtttctctcttttttaaatctgagttttccaacactttttgatttaagaattgatctggaaagcccttcattcacagttgttttctggctactgtcagtaaaaaggataggctcaaaggaaatctgttgtgtttagaatggtggaggtatgagagatttcttttttatctttaaaagcttcattacttgttttactggtgttagttattgactctttttcctttatagtaacagaattatttctgtatgaaaggttatttaaaaagtcacattctaatggcaatcaattaattgaccaacaaatacagtaaaattgcaaaacaaaaccttgcaatgttcttaaatacatttggacactcaaaacaagataaaatcttacagataatgtgaatacattattagttatttcacattagaaaggaagaatgttggaaaaaaacatcatatttggtttaaacattgctttccacacacacgtttcagaggctgtgacattttcaggatcatagattctttggctgtttttccccttttaagtggggatgatttattggctaagtttccacagtaactcccagcacttgtagaactgtttagcaaatctgcattattttgcatttccactaaggtcacggttttcatagattcaaacagcaaggaattttaaaatttctccctctactaaagtttactggctattgtactcattatcttagcattcttattagtttcttttgagaaagtacacctggtaaagtcgagtaactaaaaagggtatactattcaaacgcaatgttattcaagcattggaatcctactcaaataataaaagaaaagaaaactgaaaatagagtgaacaaggttattatgttaggcagagaaaaaaaacagtattgtggaaaacataagtatgtgtaggatacacatgagacctcaaacagatgcatctttgtggaaatgtaaataatttattatagcagataaaactgggaaggagcttctgctaattaacatacacagtcattttccctgtgtagagaagtccaaaaactgtttccatttgcaggcatgtggtcattagactaatgggcactgcctttggacaggatttacttataccccagctggctcaaaaaagtaatcattctctaattaagaggcttcctcatgtgttttctattgtcatttctagagttccactatatctagcttggtagtacaaaagtggtatgctatttaattatcagccagtagtggggctgagagataccctgagtttcatcatgcagtcatttgtttctattgatggtagaggataggagggtaggtatacaagcatatacatgaaagaaactttcttttcccactcagttggaataaattataacatgtctggacaaatatgtgcgtgactattttcaggactgattggaggtcataatggattttcgaaagtaaaactcaaatagagaataagcttgattattctactaaccctctgtttttatgtttttcacttagattttaaagggttgagtttttaaagggctttagtaattttttaagagacgaattcaagaacaggggaaatggccactcctaaatattgcataaaacctggttgacaccacatgaggtctggaaggatatatttcccattattaaacctagctgtccctcatataagaatgggttacttgcattattttttacttttccattcttgatcaatattttcaaatgtttctggaaatgttttccagcactgttagagggtaacacattttctctactcctgagttcatgaggaaggattttatttttcttctcggtttttccctatgcctttgattaccacagttgggaaaaataattttaggcatgttctgttcagttccatgcttcttcctattgggagagcttttataaggaagcacagggccctttgctctttcaagggctctaattcatgggtgccccttgcccagggcccatcacttgtgtgcatggagttaggcttgcctaacccaggggtccagtaagcaggttcgtgtggctctcaccactaagtcatgttgtccaaattggtctttgtgcattcaggtgtttttgaaaaaccttgttcagtattctgcaaaaacttacactattccaaatctacccagctctgtaacgagagaactggtaaaaaaaaaaaaaaaaaaaaaaaaaaaaaaaaaaaaaaaaaaaaaaaaaaaaaaaaaaaaaaattctcagaaaaatattatcattgaaaggcatttaatttttaataaataaatataataagaacaggtctttagttaaaaattaaaaggataatgttgcttgatagatgggagtccaggaaagaattgtggttaggagacatgagtaaaatgcacaaatgtcaggtagacgagtacaattaacacttgccaaacagagcttgtggcataatgcaccccaagaaagaatagtctgaacaaactgtacttggttcctctacagattgttcccttcacctatttgtatactttgcatgaaactactgttacttgctgatataaaacattaatatgctaggaaaaaaaatcacaaatgaaggaagcgatgtcgagtttcctttatactgacatatttcccatattccaatatgtgtaagattttccacattactgaaatggaaaacatagcagaacagacaaaatcaaggatgataattgtttattcatctacactttccatcttttttaaatattcaaattgtttagaactccataaggagtgctattggggggtaggggtcttcagaaacgccgttgctcatataaacataataaagtgggaacatgattaaaatacttagatttctgattgtaatgaatataataaagaaaaactagcttaaataaataatgccagagggtatcaatggctggacaagataagagtttcattagcaaaaccacaaggcactagaccagaaagtttccaggtgaaaggacattaaaaaggttccattggactaatgaaattggaatacactaacaaacatgtcagtgtggacaagtaaggttctgctcaaaatctgtaaacttatcaagaaagtatctgctagaattctgaatgctgaaactgaaaaaaagtgtgctttgggcaaacaaagaggaatgttttgcattcaagaagtgtatgttttatttttataagatttggtagaaactgaagatatgaatatgtttaagaaatatacagttgattatcaaagggcatgttgtgatgatatttcacacacctgggttgatgctccgcaagatatatctattcatgtcatagtgctgtgtgatcaccttaatgcaaaatcccagagcagaggctcttgtgaactgcactgagaagtgcccactctaataatgaaatattgtggaccttttctgatactcagaaaagtgggttaaccaatgtaacatttcaaatttaaattttcttccatgattttctcggatatttttggccctgttatcaaaatatgttcatattagataccaagcgctttgtttaggccttcaggttcctcattcacactcaatgtgggaagatgcttacattaatttttgtttctaaaatggaaatattttaaaatctataccttaagatgggaaggcctgctagtaaaattactcttaatgtatatgtgtgaatcaaataccaatatcactaatggtttgaaaaatcactgcccaggagtagcagtaactgcaggacagtcaggagatgttccagtctctccctgaaagcagacatgtgtcctttggcaaatggtttgataactggggacttggcttcttcactggtgagagcggggagggagagggcttaagtggcccataaaactaaaatttctaagattccttctagatttgattcccttccaaagtatgactaggggtaccctaagggaagacaggacactttactagatgaattcagctgggatcctacgtgagacgtctttaattggttatattaatagctaatggcaaacaaaaggcaaggcagagaaaaggatggagcaattattgcatgctgagaccattttggggtaggcaagttgccacaagagcctatggttggaattttattttattttattttttacaaacaaaacaattcatttaaaagcaacttaaaacacaaccagggtgattttcctaacagctctttctggtatttcaatatcttgctatattcaaagctggagataatcatgcaaaccagccagccttttcacttcctggaagccctagttcagattattttactcttagggaagtgacctctcttcccctattgacctgggaaggggcagaaaaatcccagtagagtgaactgaaggtttgatacaagaagttgctcaacctggacttgcctagaacagcagccttttattctgattgaatctgtggaaaataagacccagaggaactcagactagtatagcttgtcttcttttatctattactgtttggaaaataaaattaatctgtagcagaagaaaaataaaggtgacaaacatttgctctaggtacctagggatcaaagtaactgagccttcatgtctttttttccactaatttaatacatccattaattttataagtatggatacaagagaaatcatttttttgttggtttttttaaatggtagacttatttgctacatcagctataattttttccacaccccttttttaacatcaaaaaaatgtaaaaacctttgcttcaatgtaaagtatgttgaactgtttccaatgatgaatatcatctgccaatctaataaatgtgagtaaggtgaaaacggaataaatagaatgtgggggcgggaaacaacccttgaaacggtaatcagcaagtaaagctgaattcctatgccatagtgtcccctgctggtcgattacggaagtagtagctttcggagagcaagtcaaacctcttggttaggccatatcatgttttgaacaaaaaaggcacaaaaacgaaaggaatgtgtgcatattgttttttgtctatttctttttacatagtcatcattggcagtgggacgaatgggggaaggattgttttatgcgtgaagaatcccagagcccattagaactaggcttagctcagccacttctccagtgatacgtgatctggcactcacagatctttctttaagcctcaactcctccctgtaaattgcaattagtaataataataaatgatagatttactgcagagagctgttacaaaaacataagaagagaaggaggaggaggcggaaattacacacagtaaagtgtacttaaaatgatatagcgctttccaaaacaaatattaatgtaagggtgcggattgggggagacacttccattaacaattaaactaacttcccttataatcatcaaaaggtaatccaggctgggcaccccaggcatggttgctgagctatcagactttcaaattcctacaacatcacctggtttccaaggacttacttgggtacctttgaacaatgtatgttgctcagataatttatattacacagaatttactatatacttagagaggtctctactggttggtaaacagaggtgatggggtaaaggagattaaggtgctccttgtttgcttgataatcattaatgattgagtctccatcctgttgctagttgtctgaccagcagcatctgcatcacctgggagcttattagaaataaggaatcttagatttcatcccaaacctactaaatcagaatctgcatttaaaaattatcccaggtaattcttacatatgttcaggtttaagaaactccactctttcacatttgggctataagctttctctggcaatacatcagttgttatctagtacatatgtacagaatagtatttttgacttgaccttattttaaaactacttggagaaattaaattagaaggaaaaactatggctaaggataattaatttttatgagcctcaaaagagacgataataagatgactttcctaaatgtaacttagtattatgctactttaaaatttttacagctttgtaatactaattttaaggtaatctcatgtatttgtattaatatacacattttatatttgcccttagtatctgtgttgataagaattttaaaatgcagattatttcattagaagagattttagaaaatagactcaagtctaagcagacgtttgaaaaatctaagagggccgtagcttccattaaaaataccatttacccaatcttttgtcagttaatgccctctgaacataagacaatgttctgagttgttggaagtggactgctatactagcaacacctatgatcacagtttctctatagatacaattttaaaataaaccaaacttggaaaatgagtggatgggtattagaaagaaaattcattctttttcacttactccctaccccctaccacttaccctaagctccacctcacaccctctgttgtgtcttcttcctttaggaatattttgtttagtttttttttgtttgttttgttttgttgttgttgttgttgttgttgtttttggtcatagctatgctctatttaataggtgaaaagactttaatgccagtgcttcacccaggatagtttctttctaactggtccttgctataaaagtatccattctcctcctattatttagtgtcctggctataggtgaaggaagtcatctgattcaaccagtgcacactgaggtgtgtgaactctgaacattcttctttaacctccctagtggaaacccactgagtttttaggaaagacactcacacaactcagtgaaaagcttcttagcagaacttcatacaatttaagacacaaagagttttagggttgaagtgggagatatttcaggacccaggtacctttctgggtccattaagcccctccaatcttctttagcctattttctacctaaactataggctctagctagctacacaggtaatatccttgtagaagggtaacaattgtgagaaaatatggatttcagagtttgtctgatttcctttactgaacactcctttgaaagtattgaaaagtcatatgtttccaatcactaaagttggacattaaggatcaggaaaaaggcctggagggggatctttgcagtataagagttttgactccctgctctagtggtgagagacctttcagtcagagagaaaggatcttgacttgagagagtaacagggtttccaatctgttcctttcattgaacagagttcaaaagaggctcaagggtgcacctctcttaggctctttatattgacacactcttctcttgccaaaagcttggtttgcagaacaaatcaaaaacacacccttgacaaacgttctggtctagaataatcacctcttccccaacttactatgccaaagaggggagcttaaaaatgacaaggtgtgtgtgatattgtctatctctgcattcttcataaatcttcaaagtcaatatatctggactgaactaaggatatatgatgtttctcatgctttcatttaaagtaagatcttgaggatctttccacttgcagattgatatgcatcacagaaaagtttccttgttgatgttcaatgaagtcgcaggctcaacacatgagcctaccaaacacggcaaataaaaatttgttcaagattggaattaagggcaaaatatcaaataaaatgctattgcaaacaatggtgtctcttcaaatgctaggtttggcatagaaaccaacaatctccaagaggtggaaagaaaatgaagatctcttaagggcaatgcaaacttccagagacattaggatttgcttagcatatagaaaacaatgaaaataaagaaaataaaacaaaacttctttctattgtgtcacagtaatccacctgttggtagcacccaatttggggactgaaataatggtgattttcaacagagaaaattgtacatttcctttatgcatcctttcttcactatgtttctgactttttcttctacctcaacatggtacagtgggaagcaaacaaaattgggaatcagaagacttattttgctcccaggtttattactcactcacgtgactcaaacacagtgctttaatttcctgaggaattaattatatttgtatgaaagaagtattgcactctatataaataataattacaggaaaaataataatagctaattcttaatgagtatttcttattctccagtcatttttgaaggtgatttacaattgttaattcattgaaattctcacaaaactctgcaacgctagataatattattatcattgttttatagatgaggaaattcagccacagattggtaaatcatttgtccaagatcatgcagctgataaatagtgaaatcaagattaagtttaggtagttgagctccagagcttacagtttttcatgttaattctcctcctctgatacattttcaatcccctattttgatgccatatcatgcttttccaatgttttctgctttctataaaatgttgatacctctaggaataagtctttaaataatggtttcacacctattgggagaagacatgatgggaaaaccaccataaaacaagatggaacttttaagaggagacacagtcataaatctgttctaataaataaaggggaaaaaaaagaataaaaagttaaccccttaaagaaaaacatacttttaaagtctgtctggatcttttgtgaagagcaaaggaaatgctgaataaaaaaggattttgattgtcctttccaaaatattgtcccttacctcttggacattggtgacaccacccacactccacccacctttaatgacctctactttctagtaaaaaactttatctttgcataaactttgttgttttgactctgcaatcaggaagatacttcatagctatatctagccaggtgtaggtaggatctgagtggaaagacagaaaaggaagttatattcattataaattaatgacatgccaggtattaggcatgtccacatccataattaataacattgggttaagcatttccatttaatacagagagagacagacagagtttgcacagtatctttcctttggttcttatctaatgactgactctcttccatgtacctttaaaaccactaaaataaatggtctacttgggaggttgatatactagccaagctataggtctaaacttcaaatgcaatttaatctatgcagcattcctttttcatagtgaatctttaaagctcaattttttgcattgattgatcatcctgggaaacagaaaaacctcaactcacagcttcaagaacttgaaaagccctaatccagtgcctatatccatcacctctgaggacaacaggaaaattgaaaaggaagaaatttcctacagactcatgataaacttattgatagtagtaatgatatacattttttaaaaaattatcaaattgtgtattttttaaattattaaactcccatggcctcaatattctactctgccaaatgatgggaaaatttaaattgtttctacaatttcccacatctctataacattaaaagatcaacttcttaaaacatatgtaacattttctttccttgccccaagatgcttttaaaggttttataaactacccttctttggacatttttgtcatcaatttgctacttttctgttcaaaatgaataacagcttcccataggcaatgatactattatcctctctgcatatgtaaactacctcgccttcaggacacaaaattcagtcccaaatcactgtcttcagcctcattgatattgtccctctcctaaagactcctatggcttgaatatgtgtcccctccaaaactcacgttgaaattttatccccaatatggcaatattgagtagtggggcttttaagaggtgattgggtcatgagggctgtcccctcatggatgtgttaatccatctgtggattaatgggtcatcatgggagtgggggtggtagctgtataaaaagaggaagagagacctgagctagcacacccagccctctcatcatgtgatgccctgcaccacctcacctcaggactctgtagagagacctccgcagcaaaaaggccctcaccagatatggttccttgaccttggaattctcagcctccacaacggtaagaaatatattccatttctttataaattacccagtttcaagtattctgttataagtaacagaaaaaggaatatgggaaagaccacagcctttattctctgtacatggcttgggcttcatcgtcttctcactcatactattttaacatctgttgtatgtttgtttttcctatccaattaaactaaatgttaaataatgacaatgcactcaataaatacttgttgtccttccaatatttattcagtaaatgttttcagtgtatagtatctatatgcccatcttggaaatctaagaataaataagatataagcccagccctccaagatcttaccatctggaatggtaaggtctcacaagaatggcaatgtaaattcagtgaaatatttccaagggctactgtgaagaatgcaaatctgagtctacaatagattaacatgagaatttccaagtagtaatgagagtctggttaagtttattgcctggcacaagatcacactaataaagaatatttattgagcacttaccatgtccacatttagttctcactacaactctaggcagtgtttctatcttcattttgccagtgagggaattttggctttggagaccagtgttttcccaaggctgcatgatgtagctgagatagccagggcttggtggaacagtctggctttcagtcagctgtaaccactctgcactacttcctcttgcttacttggtgcttttaaaatatttgttgaaagaatgacatgatgtagcatgcatcaacagtgaaaaatatgctctgcaatagactccaaatttcgaggtccccctaatttggctgtaacattgattgtgtgtatgtgtgtgtgtatgtctgtgtgtgcgtctgtgtctgttttagaaatgaatttacattctacacctgacttccatttgcccctctgcattccctattgccacagctgaagagtagaaatgctttatggctctaactgggagcagaaatcactgcaagtcaagagttgggtgaatcaatctcaatctctctctctctctctctctctctctctctctctctcatatttatatgctctaaatctgactgcaccttttcagaacatcatgcatagtatgaggggactaaattaaaacatctgacacaaacattgagagcaggaaaaaaaattgacatgtggtaactttttggagtggcattctggttgatcctttttcaaggggaggggagggttgtttacagatgagcccaagcttgatgcatgctgcagccaagaggcagctctcccctttgatttttcctctatataatctccatgtggtccccaaatgcttaaccctctctgccaaatgctgtaaaatctgtcttttgatttcacagatggaaaagacttattagctcatgaagctcacctccttaggagacaaggaactcatcaaataccatttaccccacccttcgagtttgaagtctttatcagtttcctggccaaaactgttcaacctcctttactcatatgacatcctaagtataaagaaaacaaaacaaaacaaaaatccatctttttgtttggcttctagtggtcttgggactttcttccaaagtgtttctcttgctgtgtttttaggcagtgccctaggcaaagagaaaatgaccatttgcatctcttggttataagtaggcttgtcattctcaaaacaacaacaataaagagacatacttaagcaccctcttttgcattgggacagcatcacctggaccagtttaaacctttcaaacagtacataattatactcaagatgaggattttaaagaacactcgacttggaaaacctactttttgagttaagccctgttaccaccaaatcatttggttttccaaagtttagtttcccagatgatgaaatttcaagttcactacaatagttacatgtataagaatgtaaggtgctgtgtcaacataaacacatgatttgattatctattagaatttagtgcaacctgatagatatgattaggcaattctttataagtggacacatcttttgtaactgattttattatactcttcagttaaaaaataatcatcgttccttcattagttacaggacagagttcaaagctctcggtattattttcaagccttccctaaatctggctttaaatgtctctctgatctcatgttgacattccctacgtgaaccctttactcctgccacattgacctttttgtcctgtgtccttcccatcagtgcctgatctgacatgccccttctttctatccctcctgctcccctacatacaagcaaggatgtagaaactcgacaatcctattctccaatataaccagcaatttttaagcccttcaccaggatagagtgaagaaaaaaaaagagtacctctaaatttgtctcttttttgccaacacttaatacaatttcaaggtctggctggaatttacttcttctctaaagcttgcactgctatcagacctgtgatgctctcctctcctgaattcctattgtttttgttttctaaaacacacatgtgatacttaacatatcctaccacctatgatgagctacttttgtacctatctgcctctcagaagtatgcaggatgtcaactgcacatgtgcaatgcatgttctcatatgtgtacactcttgttgtatgttgtatattcttaactaagctcctggagcaaagaactattcacacactcattctcccaaagaccagccccatggatagtgtgtaatcagtaaaatgaatgaatgaatgaatgaacgaaagtaaactaagatgaaattttaactgctgacctttgctaacactcccatgctaactcacaaatatttcagaaaaaaaaagtataaaaaagacataatgatgagaaaagcattctaggcaggcctattgatcttgccaaaaggagatgcagagtatagatggcacagactatgaagctgctgagatgtgcctcacccactttgaagagagaccagggagcacagtacttgcattatcattccactgttggtctctgaatcaaaagagaaggaggcaagttcctagcttaaataaattatttagaatattgatttaactgcctgaactgtgttaagttatatctgaactaaaagacaaacatttgcgtgtttcctttaatggaatctgtgaattcaaacatatatttgggtttttaaaaataatctccctctccctctccccctccccgtccctctccctctcctctttgcatggtctccctctgatgccgagcggaggctggactgtactgcaacctccctgcctgattctcctgcctcagcctgcccagtgcctgggattgcaggcgcgcgcctccacgcctgactggttttcatattttttggtggagacggggtttcgccgtgttggccgggctggtctccagctcctgatggcgagtgatctgccagccttggcctcccgaggtgccgggattgcagacagagtctcgctcactcagtgctcaatgttgcccaggctggagtgcagtggcgtgatctcggctcgctacaacctccacctcccagccgcctgccttggcctcccaaagtgccgagattgcagcctctgcccggccaccaccccgtctaggaagtgaggagcgtctctgcccggccgcccatcgtctgggatgtggggagtgcctctgccccaccgccctgtctgagatgtgaagagcgcctctgcccggctgcgaccccgtctgggaactgaggagtgtctctgccccaccgccaccccttctgggaggtgaggagcgtctctgaccggccgccccgtctgagaagtgaggagcccctccgcccggcagccgccctgtctgggaggtgggggggcagcccccgcccagccgccaccctgtctgggaggtggggggcgcctctgcccggccgccccatctgggaagtgaggagcccctctgcccggctgccaccccgtcccggaggtgtacccaacagctcattgagaacgggccatgatgacgatggtggttttgtcagatagaaaagggggaaatgtggggaaaagaaagagagatcagattgttactgtgtctgtgtagaaagaagtagacataggagactccattttgttctgtactaagaaaaattcttctgccttgggatgctgttgatctataaccttacccccaaccccctgctctctgaaacatgtgctgtgtccactcagggttaaatggatgaagggcggtgcaagatgtgctttgttaaacagatgcttgaaggcagcatactcattaagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaataaataaaaaataaaaaaaataataaataataaaaataatcttaaagagacataattctctcccttttaaaatacatattcataagtatgtatatttataaagggttatataccagggcaaaagttactgataatgattctgcaagaactcttagtttattgccttcatttttaatttataaatgaaataatctagttcttaggttggctaatacaataatgttttgcttttttttcactctttataaaattcattttacttattttagatacatgtcataaaatcctcacttgcatttgcttatttttgtggtaagctaagaatttaatcttactgaaataattataaaaaattaaagcaatcatacaatataataaaagaacatagtctgatttttgtaaaataacactcagggtatgcagatatatgacagacataccttttttccacacatctacaatgatacaatgatcttattttcaacaaaggcaccaaaaacatatcctggggaaaagacaatctcttcaagaaatggtgctgggaatacaggatccatatgcagaagaacgaagctagaccccaatctttctccatatgtgaaaatcaaaccaaaatggattaaagtcttaaatctaagacctcaaactatgaaattactacaagaaaacactggggaaaatctccaggacatttttttgggcaaaactttcatgaggaatacactacaagcacagacaaccaaagcaaaaatgggcaaatggaatcacatcacgttaaaaagcttctgcacagaaaaggaaacaatcaacaaagtgaagagaccacccacagaatgggagaaactatttgcaaaccctctatctaacaaggaattcataacaagaatacataaggagatataacaactttacagaaaataatctaatgatccaatcaaaaaatgggcaaaagacttgaatagacatttctcaaaagaagacatacaaatggcaaacaggcatatgaaaaagtgttcaatatcacagatcatcggagaaatgcctgaatagacatttctcaaaagaagacatacaaatggcaaacaggtatatgaaaaagtgctcaatatcacagatcatcggagaaatgggagaaatgccaatcaaaactacaatgagatatcatctcactccatttaaaatggcttataaccaaaagacaggcaataacaaatgcctgtgaggatgtggagaaaagggaacccttgtacacagttggtgggaatgtaaattagtacaaccactatagagaacagtttggaggttcctcaaaaactaaagattgagctaccataagatctagcaatcccaatactgagtatataccccaaagaaaggaaatcagtatatcaaagagacatctgcactcctatgtttgttgcagcactctttacaataactaagatttgggagccacctaagttttcattaacagattaatgcataaaggaaatgtgttacatatacataatggactactgttcagacataaaaaaatgagattcagtcatttgcaacaacacagatggaactgggcattattatgttaagtgaaatagccatgcacagaaagacaaatatcacatgttctcacttatttgtgggatctgaaaatcaaaacaattgaactcatggacatagagagtagaagaatggttaccagaggctgggaagggtagtggggtggggggtgggaagaccgtgtgcaggggaggtaaggatgattaatgggtactaaaaatagaaagaatgaataagaactactgtttgatatcacaacagggttactatattcaataatagctgcattgtacattttaaaataacttaaaagagtgtaactggattgtttgtagctcaaaggataaatgctaggggggatggataccccattctttgtgatgtgtgtatttcacattgcatatctttacgccataaatatatacacctgctatgtagtccataaataccccataaatatatacctactatatactgacaaaaaaattataaaaacataccttttttgggggaatatttttcgaaatataccccataaatatactccataaatatatatacctactatatacacacaaaaatttgtataaacatacctttttttcttttgggaatattttttgaaagatgtttttttaataaaaaacaaacaagatataaaatacatgaaaatctttgagtattgtctatctttctttgggtaaaagtcttaaggttttggacactactatccttcttaattcatactaaaaatcataatcactcctaaagtgtagtaagtccctcggaaaattattaaatgataagcttaaaagaaaaatttaatgtatatactataaccatttaaaaaggagagtgttttgaggttgtataacctttaaaagtacattttgaatttctatattaattttaaagtgcatcaattttgtcatatgaacgttcgtaataccaaatatatcaataaactgtaaaaattgagaagggagactatgttgaacttaagaaaatttcatttgaaacctattaatttcagaaacaaaccatacatatataacagaaataatttacaattaaaatttttactgaagctctttcaatggacacccttcatctttcccattactctcttgtcacttcataactatgacatggatcaggcacattaaacatagttctacatgaaggagtaaagacaatgacaaaaactgtggaatggtacataggaaggacttcatagaagcagggagtaggcaatgagttttagtgcttttaaaattgaaaaaagaagataatcattactaactgaaggtctttctataaaataaaaataacaaggtagttcacattaaatacattaaattacagttaaagttatttttaactccacagattaatgcactttccctttcacagaactcattttctattaactttagcaaccagacaccagaggttgcagtgtaaggtgtatttttttatggctcaaatataatttaatcattgtattttctcttcactagattgacaaagtgcactatgaattggtggaaatgcgctgtctcatcatgtgatgatcagaagctgtgataaagatatcatttgctccaacatttctagcacacgctgcatagagtctgcaaatgttctgatgaagcatggataatgatttgaatttacacttcagatccacagcatattaggctatggtctcactggaggcatgtgaaatattagccatagagatgtcttaaccaccatttacatttgttttaacataaaatcagctagggtataaaaatgcacaagtctctctaactgtaaataaccacacatcatcataaatattgagtccaggaccaataccttatcactcgtagttacatctttttgcattaattcaagaagatcttgtgacatagtctctcacaatgtgatatgctaaattacattaaaaaaaaacagaaaaaaatagacaaactctgtagaggcttgtagtttcatcactgtgaatcactttcaaattctatattcctatttttatggccaactgttagtagttattcaacaacatacaaaaaaaaaaaaaaaaaagcttggactagtaccattgatttgttcattcaaaaagaatttgtttagtacctcctatatggtagccctatcctagccactgggaataccatggtgagcaatacagtcaacagttccttccctcaaagagcttatacttcagtggagacagatgggcaataaacagaataactaagctatataataagatcaattgtattctgtactatgggggaaaacagagcaataaagagagagaattggaagtggtggaagtgattgtaaatgttaatagggtaagaaaggcctcactgagcaaataaaatataccaagaaaggagacaggaggaaggcaggaaagtaaaaggttgggagaacaaaatgcgcaaagaaagctgagaaacactaatgtgactgctggcctctgtacctaccttaagctttgtgttccctctaccagtcccaggtgacctccccaaatatccctttggtcttatgctctatttcactcaccataaaattaataatttctatttccttctattttaggagacatatgaaaataatatattatacattttcactattgtattagtctgttctcacactcctataaagaaatgcccaagactgggtaatttataaaggaagaggtttaattgactcacagatctgcatggctgggaaggcctcaggaaatttataatcaggcagaaggggaagcaaacatgtccttcttcacatgatggcaggaaggagaagtcccaagcaaagagggaaaagccccttataaaaccatcagatcgtgtgagaactcactcactatcagtggcatgggggttaccacccccattattcaattacctcccaccaggtcccttccacgacccttgaggattacaagaactacaattaaagatgagatttcggtggggacacagccaaaccatgtaaactattgtttaggatatgtgtatacctttttcagaaagttatattttgcattagtgcagtaaatgaaactgcaatatttacacagattcattttgaaatcttaatcaaaaaacagtaacggtttcctttttacagttacataaaaaatgaagaagggacccacccattaaacctaccttgaatgaggaaagagattgagactgaatttcatttctgcctccagtcatgttttataaaagcggtcaaaccagttttccttacaagcagatgtccagttgtatctgtatctgcctgcctcctcaacccatcctccacaagattgagaaaaggaagacagtgtgctcttgatctggatacacatttcaagccaaagttttataaagaggaagttcaattcaatgtagaaatatctgaatgctgtgtactattttattgggtacagaataaaaggggcagcagagtaactttttgacttctcactgcatcttttgttttcctaaagcttctgcttcactacgaatgaagaagactaaaatttctctgaagagaaggaagccatccatgatttttgacaatgttaaaaccctgatattctgcttggtcctaggtattctgctgtatccctgacattctgcttggtagtagggatttgcactgtgcttggtccagaagacaaattccaagctcctacagagtctgatggctttacaaataacctagctatcacaattctaaataagtgtgaaaaccctgttaaagcacataggaaggggacataacttgtttggtggggagggagaaggcaaggctttcttgaggcagtaacatttgaattgaggcctggaaaaagagtaaaaattaaagaaacaaagaagaaatgtactgaaaaagcaacaaagtccaaaagaacgcacatccaagaaaccgaaaagtgcaggatcacaaagagaagtataaaatgtaaagaaggaataagggatagatggggctgcacagataagaaggctaaaatatcacatgtggattaagaaggaccatcctgaaggcaaggtggaggaacggagtactgagaagttttaagcagaaaaataaaatgaccaaatgtgcattttagaaagattactagttcttccagaggtctaaccgagaggtcaccatgatgatgacctgaaccagggtagaagctggaggaaaaataaaatcaaaaggattttatttcctttgtacttgagagttatttaggagatgaaacaagtgaccgatggaatgtagggaggggtttccttcttggttcactgagcacgtgcctcttcttatatctctaaagcaagcaggaatctccactgagtcctgaacaggctcaaaaagtttcaccaagaatgaatgtgcaactatcccaacaagtttcaccaagtataaatgtggttcagactcattcctcaacacatggtgtaccctccttgcagcctcccccaacacacacagctgttttattttagatgctgcaaatcataaatgtgtattacagatctaacaattgtaaaatctccaaataaagttatttctttgagtgactggaacggagaaagggagcggtgctttgtatttggcaggaacttagattagtgtcttttcagaaagcccagtacattttgattagctcaatcatcattcaacaattattctctctctgattttaaaattttcattaaaagcaaatttttaaaaaggcatacccttgtacaggagaactcccttggtattgagcaaattcatccagggatcaagggaaatacaaaatattttcacaccattatcaatgtttatgctgtagcagaggaatcagtctcaaacacaggcaaaatatgcatatatttttaaataccttagatgctatagtaataaaaatattaaaatatatatggcaaatccattaatctactctgagtatgtctattaacatgtttaaaggcataagtggtttatcatatttttatcatatttaagttacaaaaatcttttttattttaagctttttatcatttaaatcatatttttattgtagttaagttacaaaaatctttgactctcctttgaatattttcaaatcaattccataagtgaagacaaaatacacaattgaggaaggggccatgatttgccccaaaattgtcatcaaatgaatgaactcaatgacttctgaatcacacttttaaatcagatgttcccatttgatctgtcaatttctccaggtttgatacataggtgtaaaatcatcacactcttaaggcaatgaactgcaggcttaaataaatagtatatctgaaagagattaaggcaatcgtatctttcagaagaatcatatctttcagaagacatacttggtaatgagttttggactgcaagtatcagttcttagacacagcatgtgacagtttggttgcttggctaaagtttcacagcgaataattcatctctgcatcagctggaccctgacctgcaatctcattagattcattctagcccaatattaaaagtatttcttgctaataatgcaaatgccattatcatccaagtaataactagtgtctggtagtatactgatgaaattttgggtattcttttgcatttttgtccaattttcattatttctcagtgggaaagaaaaaagaaaggaagggaggcaataaggaagaaaatgagaaggaaggaaaaaagaaacggagataaagaaagtaggcaggtgggtgtatcttacaaatttgcatacatacaatagtttgagtaaattggaaatacttaaactttatcctttgtaatgtaaaaacattaaaacaaaaattctccaccatgaaaacagaaaatatatatttgtatctcctcccattatatgcttttatgagagatggttagtgaattttacacttaaatagacacacttctttttgaaacctcagttttacttggtaccaataacactgaaataatcctccactgtatcccagctaatgcttctgcatcccaccaaatacatctgaatgcatggctaaaacagaacacgtgatctggccagccttacacgtgtaatgaaaatctaaattaaagagaatgagacagcagagataaagaggatttggggaaggaataaaagagactaaacatagcactgagaattctcctctttttacaaaaatgacagacttaagagagggcatggaacagattaagagaattaacatggagaggagagcagaggtataaaaggtatccaagaaaagtaaaacatacaaaggcaattcaaatcaaagtgagcactgcctatatacagacagaaagcgagtcctctatgaaaccatacttggcagaaagtactcattattaatagaaagtgaaatcattttgatatctacaccagcagtcattaaataggcccacagactacccctggttttgcaaataaagttctattgtaatacacacatacatacatgtacacacacacacacacatacacacacacacacacggcaaaaaccaagcaaacaaaaatcatgagtgacatttattggcaactaaagttatcattgatttttgctgctattagtggagtgtttgcattgccctaacactggccaatggagaaacaaatgtggatgagccagctgtccctatgatacttaacatcatcaattttgtgtttaacatttgaccatatgaggtatttcacttaaaagtaccttaaggatgaggttctagcattgtgtgataaagtacagctcatgaaatccacataattttctggttgttcgtaatttccttgttcatagactgatgaatcaaagaaaaggactggtaagaattctcaaccatataaccttggtctgtgttttgctgtggtaatcctattagggtaatcataatttaccacccaggaaaggacacatgatagtggaaggtgttaatattaataattaataccagtacaacaagaatacatttggattcctctaagtaaacagatgcatctggtcctggtcaccctagtcaaaatagacctgtgtgtgtgtgtgtgtgtgtgtgtgtgtgtgtgtgtgtgtgtgtgtgtgtgtgtgtttcacattgttctatccctctggcctaccatattcttattcatatatcttgcaatggacccctgttatttgctaggtgggagaggagacattaataatgcagaaatttttttttccgggtatttttcatgtcaaaggacttttacactaacgttatgatatgctgcatttctacaaagttcaatattgtgcttgttttaagaaaaggaattatttgtggttttccactttgcatgccaaaacagcgattttcaatttcaaaactgttgtatgcatcggtaaggatataatttacatctattctcccttcccccttcactttctaaatggagcgacattaaaatataaattcatgcaatattaggtaagtgggaaagtaaggcctttcttttgactattaagcaaagaatacatcttaggaacaccataaatcatgcttgtcaggatattcaaaagaatcattctgtatagttaccattctattatttagaaagcacagacatgaaacaatataattcagctgggctgcatgtatctgatttgcatatggctgtatctttttaatctgtgttttcacaagatgaatataattagcaagatttaatttatctttaaaaccactgaactatgttgattacctgcaggatgacatcacccatatgcactagtagatttggactcctaaacagagcaattcaatgtattttgtagctaaacaaagtgcatactgcaagttaaaaagtgataaactagtcatccatgcaagatgcataattcatcatgaagagatcagaactgttgttttatcctgttttcctatttttttctcctaaagaaaccacaaatgatttgggatagtcaatttacaagtctgtgaccattgattaaaaaaatattaaataaacccttcagtggaactgcatggatatattctctgtacttctcccatctgagcccttcatccacctttccttcatatacgctttcaggttaagaatttttcacataatgaattatctctgacctaacattctcaaaggagcttatttgtgctaggatgtttgactttaaaggaacgataacaagaaatatcatgttaaacttgtcagctataaaataaaaagtataatttctaatacaatgcattatttagtcatatccaactttttaaaaaattgtacaaattcaaatctgtggttctgggatgttagaggctctaattgcacacaatgtaacatgataatcaacataatttcctctaaaacaccagtttgtgtccccatgaattctaactatagcctagagtaaaaacaaagaaaaacattttaataaggacaatgtattaccactgggctgattattttcccagagaaagacaaccatgaaaataaataaaaataaaattgtttgcattagaactggcattattagatatattttactcattatggaaagaaatatctggacatcgaagaggaaaactcaaaccacaaacctcataatgaactgcttctcaactgaagttgccatttagtctgactgacagtattttatttctagggttggctttatgttggtctaatctagattttgtattgaatacacacagacatagcagaatatttcacaactcctcatcaatctagatcaattacttatctaagtgcagatgaagatttgattcgtgatgtgctatttctcagagaattgtctgcttaaccgtagcaaccagaaccacaaatataactggtaacacaacaaaaattgagagttaggtcagctcatagaagaaatatacaaggcagttacgtggataaatctttagacatcaaacacatgcaaaattttcccaggcttcctgaccactctcagttttatatgaaagtgcactttaacttgttgactgatgtcatactgattttcctcaaatatcacttttaacccaccacattccatggaaaacgttttgctggccaaataaaacccaaagccttgaattcaaatctcatcacagtctggcataaactaacattttcagtctactagctcacaattttccacattgaatccttgacaagtgagaattatttcctcattccctggtgaaacatattcctttcctgtctatctttacttaagccttctctcacctggaattttgtcttcccttctatcatcaaacctgtggttctttcatctgatttatctaactctcatagctagaagtaagcccttaaaaacagggatatatctgtatgccccagcatgaaaaacctatttgtgattgattgattggatcccctcctatccaaactcatttttaggttttattgtacacaccctaccttgcctgacttttcccagcaataagtgctggtttgatctgccaggttacccttcaatgctgtttggctttgtgtcctcaatgggccatcttattctatctttagcaaacacaaagaagtcaccttaagaagaaaaacgactagaaaagaaaaacgagagagcatcataccagttccattgccctagaaaagagataaggaagcgagatattaatttttttcataattaattaataaaaatctttattgatcccctacatatctactaggagctgaagatacagcagtgaataaggcagataacccacccaccaagagcttccattcctgtgttggaggttataatggtgatggagagacacatgataaagcatcagatagtatcattattcactgttattcaggaaaagaaagaaagaaatttgaaaggattgccagatgtcaggaaagtgcttactatagagatgatgtttaagcaaagatctaaatatgagagggagccagccagaccagcagctgggtaatcgctggtatctgccataggcaacagcaggtccaacagccatgaggtgagatctcctttgcccacttccagaactgaaaatttacagtggagaaagaacagcatacagataggctggagccagatcctgtgaggctgtgggccacaataagaagttcattgaaatgggccacagtgggaggttctgagcaagagagcaccatgattctttaccttacatgagaaagaagaagaaggaggcggaggaggaggaggagggggggaggaggaaggggaggaggaggagggggaggaggaagagggggaggaggaggagggaagaggaggagaaggagaagaagaagaagaagaggaggaggaagaaagtgaggaagaggaggacaggggaaggggagggggaggaagaagaaggaggaggaggagggggaggaggaggaggaggagggggaggaggaggaggaaataaattttgggagagaaacaagatagggatttaagaggagaaatgtttgcaaatcagagagacggtacctggacctagaacctctgacatttatgaggactgggagacactctgcttgtctcttggtaggctggttgagtgcaccggcttagagagagtgtaaatgacagggagaatatgggtctacctaacactggctctctaacaataaatgacaaagacctaggtaagccagctctgaaaatctgtgatactaaaaatgttttcttcatatgtaacagtatcaagcacaacttaatttaattaattatatgacttctattagcactttataaataccctgttctaggctaagctttgtaaagaattcaggaattcagcacccatatctaatgagtatcagtcctggatacctatttgtactaaaaaccaaaggcttctccttctttgctctgattctaattttctgaccttgtatacactggttacttacagattaataccagtaatatcagttatttcgtattgcataatatttttctgttaaaaaataagaagcatccctttctaccaattcactgtagttcttcattctacatttagtaacaatgagaaactgctcattgaagtaaagcttctcaactatttaaaaacaagagactggacctcagaataagaaaaattgtgtgcagtgaaacaggttgtaatttataccaccacttcaggccatattgtgcattttgccagaaaaataaaaaataccaaacttgatggtgagcatgcaactgactcctgaactcttttgtgataaagtattctttcaagatcctaagatgcaacactaaaacataattgcttgtattaattgtcaatagtagctcataacaactaggaaactaagactttatactggaacaagctctgttttgttgcctttcaatcaatgtcttccctggaagtacaagcctttatttaacctacacgtctggatatctgagaagtttcaccttatgacttgtttcaattataaacatccattacaaccagcaagcttcctgtcttacaactactctccagctgctagatttgtaacctgcaagttattgtttgtgttaatggcatcctagtttttatttttatttctgaaaagctatggaggcaggtagaggcagagatggaagaggtggaacagcatttggtattaaaggccaacatgagcccataattatgtacatcttgatctttgtaaattaagatcaagtatataatgttgaaccctaaatgctttctattctaggatttgttcaggttcattttcctttgttaaatgctctggttggctccatgttatatatttaacacctctttcttcttgtgagtttgatctaagggtttccaaagaagcatgatgcctttgagatgaagaggcatgtcgtcataggttacccccgacagggcccctgttgctgcctgccacaccttctcaccttttcaagaagcttcattctttcctacgggaccttgaacgtcacttcaccggtattcttcaaaaacagaaaatacaggctactaaagaggaggcacactgggcatgccaaattgtggacatccttatcatatcccaacctctgtgtgcatctatcagtgatacttgttacagagacattttaacatcctttcaaaaggtaactacttgtacctacagcttttgtgatacctgaaatcaaatgatattatttgaaagatatgagtcatgtgcttcaaggtaaactgaccttgcctttttgatcttctaaactatcatgtggaaacttgaaatttcacttttcttagtagagaagcttaaaagaccaactctaggataaagctgcaagcgttaaagcttaaagaaccgtgaatgccaccaattgtgtttcttagttgctgtaactgtaagagattgtataggtgaatgatctaattctcccaacaaaatcagtctagatgacttttattaattaaaacaattcttatcctagtatacctcctcagaggaggacaatctttttaagcttcatttagttgagaaacattctcctaaatttgatgtattttataaatgaattttttaatagcatgcgtactgcacaaattctacagcaacacagtgtattgtattttgttttctacattcacacctcccagtacatggtgacatgtatttgagagtggagagaaacttcagaagcatatctgagttcttccaggacaatttccacatctaatgtaccaattctttagaggtcagtcttgtaaaatcatctatttcattttccctgagggatgcagttatttttgttgcattcggcccggaaaaatttcactgcaaattcagtccctgacccatgccaaagaacagaatatagctacccaaaccttaagatgtttctatggtataatacatttcaaatgaggtccctttgtcatgccaccatcataattgacaaaatatacattctctctgctccacacagtatttctttaaattcacagcctttctttcaatatttgaacatttagaattgtgttgtacactgacagcacttaatgtacctgtaaggggaatgaaagagatatttggatgtattttcaaaatttgaagacaatatatttactgccaaatttgctatgtcttagtgctgccactctttactgtcagaggaatattgacattccagtgatgtctcacaaactaaaagggtggattccaaattacaagctatcttgtttaagatactaaatcactgacatcatctaaatctatttttgtgacgataaaaatactttaattataatccattgctctcagaaagttataggacgatatccaaatgagaagccatcagcttgtaaatacataaagttgtgcaagaataagttaaattactggctatctctttaggacaaattgtcaacatgtataattatacagtagtttaactggtgaggggaaggtatgcaacatatattctgccaaaaaaaaaaaaaaagcccataacattctgacaactcatccatatctctcgcctttgctgccatatctggaaatggcagaaatgcttacatttttggttctgctcatatatcagagtatgtgtgacccattaggttggtttctctagcagatttccctaactggaagtgtcatgtaaggagacatccacaaagtgtgtggtattggtgatgtgactgctatcttcctctttctctaacaagttgtattaatgcagcaaaaatcaactggaagggcatactcttgtccagaaaatttagaatgataaaaatatctaacctaaatcaatttggcaaagttgaggtgctacctgcccttgcttcagtcagtaattgaactttcctttggttctgttgacacaataacaagacctaaaagtaacttcttcgaatacatttttaaaaatttcatgtcttatccattcccattttctttatattttgtcttctgccatgtcctgagaaaaatgcctgactttagagagaatccttagatttaccacttgaaacttaaaagatcaagtctgaaaaatggatacaaagacaagtagcctttttgttggcgaacagaagaattagaaataggtagtctaaggtcagactcactttcattttcctcttctttataggcaatcttctgatgcttgcttttcctgaaagaactcaggcccaaattctttagggggattgtcaatcaagagaagcgaggataagatgaaaaataaaggcaaggcgaggctctgtggctcacatctgtaatcccagcactttgggaggctgaggagagagaatcacttgagtccaggagttcaagaccacctgggcaacacagcaagacccccgtctctacgaaaaaataaaacatttagctgggcatagtggcacacacctgtggtctcagctactctggaggctgaggtgggaagatcacctaagcccagaaggtcgaaacagctgtgagccatgattgtaccactgcactccagcctgggcgacagagcgaaaccctgtctcacacacaaaaaaggtaaattgtaagaacaaaatatggtacacattttcattgagagacacatttagaacttggtttttaatttaagaacttttgtaaatacatttaaattgttctattctgtaaactgtcttcagtcataaggtagttagatattcgtttcattgtatctttccaagaagacataccttatgattagaggcgggacggggaagtgggagagcaaggaaagagattagctttgctaactgtctaatctggatttgtgtctctgaataacatttattagctctgggcctttagaaaaacaacagataacgatagaccttgctttagcacatatatccctatgctaagaggtttacattaattttctcatttaatgtgcacaaaaatccaatgagaaaggtactctcatgattaaatccatttgaatagaagaggaaaaataactttgccaatgtcacacagcttctaagtaccatatttatatatttaggtctgtgaacacagtatattgcttgtctgaacaatatgaaactatgtataagtaaaaaaagcatgcgggtattaaataaaacctaggtctacattctttgaccattgtttttactcatgtattttcccatgaaagaacaacatttttgccatacacattttttggaaataattttaaaattccttattttatattacatttagaattaaaagtagtcataataatgggaataataatgagagcatttcacagctctcatcgactcctaacctgagaggttgttaaaagtatatagagtgtctctaaaatatggaaatcatctctttttttaggaaaaaaaaatacttttttttcttttcttttgagacggagtcctactctgtcaccaaggctggagtgcagtggtgcgatcttggctcactacaacctccacctcccaggttcaagcaattcttgtgcctcagcctcccgagtagctgaaattacaggcacatgccatcacgcctggctaattttggtatttttagtagggagggggtttcattatgttggccaggctggtcttgcactcctgacctcaagtgatccacccacctttgcctcccaaagtggtgggattacaggcataagccagtgcgccagccaataatattctcaaaattttaattttgaagaaaataaaaatagatccaagagaaatagatcaagagtaactcacacaaaatctttctaggaaaaataatatctttttttacaaaaaaatcctactgaagaacaaattatccataattttgtatgtattacctaatatttgaggcaattgagcatcagccttcaaaaaggaaccaccccagtttctgagatcatgagttgtgccccatcaatagaacttctattgtgggcataatggaataagacgagagaagcacggtgatcagatgaagggctatagaactaaaaagtgatcaaaatacctgctgcatttgctatcacttaagcactttaattatatatctattatgaaaaattgcattgatttacatattaatattctacatttcagcatgtgccctttatattcacataaaacagaatacactctgtcacacacatttaacctacctgactcagccattaaactaaaatttgagagtgggagaaaaaagaaacagaatgaatacagtactcccattgttctattcaatgccttggattttaaatccttaactgtcactcaattgaactctatttttgtcattttgcctatcagtcatgacggggagtttaacctagggtgagccatcagtttgtctccaaaccattttttaaaatggtcttatgttcctggggtagggacctatgtgcaaattttttatatcagtctgtaatttcactttaatctcaatgactcctgggcaggtagaaaaaaacagcaagccaatttgtgcagtataccaacactatccaatagaactttctgtgatgatggaaatgcttcttgtctgaccagtcccacacaatagtcattcgccacatgtgactagtgagcacttaaaatgtggcaggtgcaactatctggtttttaattttaattaatttaaatttaaatagtcacatgaagccacagtgatgtcttggtatagtttatgtacttgcagctacattatttaataacaagcacagccctgtaccaggccccaaatttctaggtgactgtgaaagacaaaatgctggaatagtaactgtctttctctataggcttgtgtgtgaattaccagtcttagttaatgtgtttctgggtttgtttcaggaatactgctgagaacatttcaacatctgttaaattacaccaatgactacaagtcagggtatctaattcctaataggaatccttactaccatttggacaccttttgattcttctcatttgaaactcttgcattggccacagctgctgttctaaattgcctccacattcaacatttttgtcctactcttcaccttcaagctcagaaaatacactaatgcctcatccacaaaggagcccaagttcatatgatactagttctgtgaatgcatacatcactgccaccatgcctcaacctctctctactcttccatattatactcttcttgtcaacaaagatgcccatgctttttaaaatctcatcctcatacccgtgacatcttattaacccctttctacctgatctgatctcttcttcaaacattatctctgtcttctttttgtatgtccaatctttgtctacccactggcttctccacttaacataagccagcaatttttcccagttccctccactaatcacacttaacactatcataattaccatggcttacctattcgtttcccttgacatcctaggtttttcctaaatgacttctttgaccagtgacctgacaatcacctaatccaagatactttaaaaactcccttggttctttctgtagctctttaattgctcattcttatttggtatgctccatcattccattgcctgagattgggcatttttcaagataagagaaaatcaattttcagcctacaggttaagcctgctgaatttttgtatggcacaaaggctaagaacagatttgtttttgtttatttttatttttatttttttaaatttaaaagtatttcacattaaaaaaccaaaagaatattaacatttgacatcatgtaaaagtattataaaatgaaaacataattgtccaggaagtgttattataacacagccatagtactcttttacctattgtccacggctgctttcacactacaatcacagagttgaatagctgcaacagaggctgtatgatctgcaaagcttaaaatatgtattatccagtcctttacacaaaaagtttgttgacttttgcacaagatggttctcaacttttttttttctttttaaaccttctccctcacttatcattgctgttcccagcactttcatatagtaaggcaagaactaacaattgttgaatcctataagaagtcaggcactatgccaggtgcttcacaagcatcactgtatgtaatcctcaccactaaataaggcaggcaatgctactgtacagatataaaatcaggttaaataacttaaataacttgccaaaagtattgctcgatgttagctagcaatttgcggagaagacttcctagttcatttcagggagtgaatacctatgctccacacccaggctcattttctaatccctggagctccacatcattcactgcattccaacccggtcacttcctcccctagaagggcttcttttcctttgaatttccctcgccattagtttaggtcagaaaataactacctcttacctggattaggacctgttattctttaatgcctttattctcttctgccttccatttaccctgcattttcttatcaactaatccctccaaagaaatactgtctaacccatctcacgcacgtatttacatctctgcaaggatcttgtaaaatgcttctcaatttgtgatcttgccactcctctagttaaaagccctccacagatgctagttgcctaaagaataacttctatacttctttcctgttacttaagtatatttataatctggtacaccctacaacaaataaagccagtctggattgctcattgttcctcttctttctgccacttggaattcctgtcccttcatttacatctgattacttgagacaggagagtttttatccttctctccctgaaccactttcctttcatgtcatttttttctaactgcctggcaggagaattttcagtatgcatatctaatctccataactctactgtaatctcctcaaaggcatgtactcatcttattctctttgtacaaaattcctgatagcatccaatacaattcaaggtagatttttttagttgttaaccaacagctatactctcattttcctttttgccagcagaggctccatttttgtttatacagtgaaggcttcccatccccgatttccgattccccatctccagtggcttggtcataatggacctaaaccagttaaggcaaataaatggctcattgacatggaaatgagtccctcagagaaagaatttcctccttaataaaaaatgatacatagaaggaaacacccttcattgccagaaacaagcttcaactatcttaaaacagtgaggaaaagcatagttatcacactcaagctattctatggaaagatgtaaagctccttggtatttgatgacttgttttagccactgagttagtcaatcccactgcagtcttatttctagacttctcattaagaagtaatagaaattcattactgttgaagctacatttaattgtgtccattattatttgcagagtcttctgattcacatgtcaataaacatttcttgaaatttaaatatatgagtgcatgtttaaaaatacacaaacttatattgcatgtatgttctgtactcagctatgccatgtgttattattatttttcattattacataaaatactatttggtactgtttttggaagatcttcagtggaagaaacgtttcttctatatattttctcagtataaaacacattacagttgtctaacattgataggtagctagcaggaggtaataatttttttttttttttctgatttcttcccagggagttatgggcagcgaaaacgtagtagaagtatgtatcactcagattattcaaaaatgaaagagaaacataaaagagagaaaggaaagaagaagggagtgagaaagggaaggatggaaggagttggggagggagggaaggtggaagggagggaaggaggggaggagaaagggagaggggaaaggaaagaaaggaatattttgtatgcaaatgataaataggttgcagaggtcagtagcctgatactgagacaacttcagaaataaaagcagatggtagagcttttgctttttttctctcttggccacaaaactcctgctaattgaagtagcaactgaacaagctgctctttcactcccctgacaatatttatgtttcacttaggttctgactttcacattaaacactgccacacctcctgcttactccttgcttccggtatctaagccatttttttttttttttttttttttttttttttgagacggagtcttgctctgttgcccaggctggagtgcaatggctggcgcatctccgctcactgcaagctccgcctcccgggttcgcgccactctccttcctcagcctcccaagtagctgggactagaggcgcccgccaccatgcccggctaattttttgtattttttgttgttgttgttgcttttttttggtagagacagggtttcaccgtgttggccaggatggtctcgatctcctgacctcgtgatccgcctacctcggcctcccacagtgctgggattacaggcgtgagccacctcgcccggccatcttttgctttttctatgggtggattcctctcttcacatgacttcatcttgaagagaaacaaatgaataaactaccactacctctcaaagtatctcccaagactgaataaggtttcctgaaagaaggacaatgagctactgtgagtaagtgacatatcctgaatgagaaatggcagtttcctacaagctggacgccagacttgaaagaaacagcacgaaatgggaaggtcatctttaagagtctattcttatctgtgaaatatatttacagccaataaaaacaattttttaaaaaaaatttctttgttcactttttgaatcttgaaaccatggaatggaattaatgttaccagcagtaattttattgtctatcttggactgcactcttcagaactttctcactgctgctctcataagactattttttttttccctcctgcagatcagactttatttccagaaatggaaacaacatgaaaactgctgagaaatttgccaacccagcttgcccacatatttatatctgtgtcaggatacagtattgtatttaccaagattaaattatctgctgtcaaaactcaatgaaaatcatggtatacaccaaattgcactttagaaatataagcacctattttttttcaaaatgcaaataacatattgaactatgtatatttacggggttatactgtacaaaatagaaacaatataaaatacaatatataaaagcattttagagacagaaaaaagtacacggttgctaagtttagcagagagagttggatgctgaataactaagaagattctgcagaaatgggttcaagttccacatctgccactcaccatctgtgttcttatacaatcatttaagtagtcacctgcaaatcggggataattcctgccctccctgcttcatttataatgaataaatgtaaacatgtatgtgaatacattatgcaaactataaaatatatataattaaatgcaagaaactttgaaagatgacatatttgaattcccgaagtacttcaatttctgctccaaaactcaattcttctttctagaatcataagattttaaaaatgtaaagaaacttaaacattatgtagtctgcatagtattccatggtatatatgtaccacattttctttatctagtctacccttgatgggcatttaggtttattccacatctttgctattgtgaatagtgctgtgatgaatatacacaggcatgcgtctttatggtagaacaatttagattcccttgagtatatacccaataatgggattgctgggttgaatgataattctgctttgagttatttgaaaaatcaccagactgttctcactatcaagtgggagctaaacattgagaacacatggacacaaagaagggaacgacagacactggggccttcttgagggtggagggaaggaggagggtgagaattgaaaaactacctgttggttactatgcttattacctaggtggtaaaataatctgtacaccaaaaccccgtgacacacaatttacctatataggtaacctccacatgtacccctaaactaaaataaaagttataaaaatagaaaatatcatgtagtcaaactcctttattttacatataactaacataagcccagaaatttttaatcacttatccaagtttaaaaaagaaaaatctaaagaaaaagaaaattttgaaaaagaagtctagattacaatttaatctattgttcttcctggtaaccagctcccctactatttaatatagaagtgtttaacacaaggctgggcatggtagctcacgcctgtaatcccagcactttgagaggccgaggcaggcagatcaccagaggtcgggagttcgacaccagcctgaccaacatggaaaaaccgcgtctctactaaaaatacaaaattagccaggcgtggtggcacatgcctgtaatcccagctacttgggaagctgaggcagaagaatccctttgaacccatgggcagaggctgtggtgggccgagatagtgctattgcactccagcctgggcaacaagagtgaaactccgtctcaaggaaaaaaaaaaaaaatacaaagaagtgtttaacacaatttactgctttaaaaatgattttacattgatatgaaatgttttagttgtaagacatattttctaactaaaatcccattttatttttactaatcccagataggtttcagggcagatattactttcttttgaaagtgtgacttttcagaacaaggagatgagtagcagaaccagtcatggaatcaacattttgtacttcacctggtatattcttccatctttcagcaatgctcatcatattttggctagaagggattctgtttcttttaatagtgctgaatagcatatatttcaaaatgtaggacaaagtaaaattaattttgctgagggagtcttgcaataccctttgtgatgtctggagatactcaatggtatctcaaaactaggataaagaatgcttatactagattattccatctcccaaagtaatttgtctcctaataataatcataattaccttctacagtatccaaactgtagcctctttactaggcaaattatttactgcaggtaggaaacctctggtaaaaactgcttgacaatatgctgctagaaacagtctttcattttccaaatccattctgggaaaccacacaagcacacctactttcaagctcatacgtgaatataaaaggctattttatttttacaaaatgacttattacaggaaaacctagttaagtgaagtattccttgctaaagacataagtaagcagtataaatacacactagacctgctcaaatcaatatttaagcattcaacatatccacaaaatcccaagtaaaacttttgtgcccatttgtcctcttggcaccaagatttttctactctctacctacctctactgccaataaccttataggagcctttcccccatgttctcaatcagggaaggatctcgtgtcatttatatcttccaaataaatgttctaacgcaagtcccagtgttattttcacctaaagccgtatctgtttttgttagtcaagaaaagattttgctttctgtgaaaataatttcagtgtcagtgaataaattgtagcagtattacatgcttctgtgttcagtgtgtttgttgatatcatgtgttgagggggtgaggctgtggggagaagagaaggaaggaaaaggtggaggcaaactcttgtctctgatcttgaaattatgctagtcagttcctactaactacttcatgatacagggagttctggatgcatttgtgtgtgtgtgtgtgtgtgtgaaaagacaaaaagggaagattttctaaattactgacattttggttactaatacaacgctggtcaccaagaatccatggataatgtctgggtgaaatgctttgcatcctctgagccagaaactgctcaaacctattaaaattcatttgtgaatgtccattctataacaatcatcaaaacacaatttcttccaattaaacagcagaaaaatcttcctggggactgatagtgcaacaaggaaagaggatcctacaacctcagttatcacttcacagcagactcactgtggcatgttctaagttctacagccagaaacaccaaaaataaatttcctgttcttccacctggggctctattttcctactgccccaaaacctgacttctagtagaatcaaaaaaattttcccaggtcatggccaggagttaactgagtatagcacagccttctcctttctgacttccagtaggatcaaaaactcttctccaggcatggttagaagttaactgagtgtacaagaaccctgagtttttgtgtttcaatttgcctgatttgcatgtggatatacagccccagatggagaaaactaggagtgggatttatcttacatgattcactgtagacagccaaagcaaaatgtcaaccagtgaatctttgcttctagcctgtccaggaataggccctgggaaaaccttctgactgcactggaactggggggagtggacttgttctgagctgactcaaaaatgctaacagaaaatggcaggctactgcttaagcacagatgtcactttattgtgtcaacttggaaatgatcagtacaatctggcaagtgcaatttttctcacattatgagtgtgtttgagcaggtgctatgcttcactgaggtcatatattgtttccatgttttttaatttttgattcaaattataggatgaaaaagattctcaaatatagacctgtcctaagttttactggagaataaaaacgactaataaatgttttattaataatcagaaaagggtctaatgcttctccccaggggcatatttggtatatatgctttaaacttctactaaatgttgaagaaggaaaaataacagtaaggaaaaatatagaaaatattctccaaaatagatcttctggtggcttctcctatgaccacgatgcattctgttgtcattcacatattgtcttgtttggcaaaagacttgctatttctatagtcactatggaaagttgccacagctactcaaagtaagctgtcattggagggatatgcctttacataaaatagtacctcacagtcggcaggggccactgtgggttctaatggctagctttaaaaagccaaaattgtgtctgtaggatcggtggctctcttgtcctgccaaaagattgagatcagacatggtgactacaatacctccagcactaagagttgcagcttggaaacaagcaatgcaatgcagttgtagctaggttgctgggtagtatgtttagtagatgttttgtctttgaatctttctggttgcccctgaaaagttgtcacatacagtaagcataaggtagacaacagtgcactaagttttagaacatagagaaacataataaatagtcattgctttaagaaaacccttaaggaaaactacagtcaacaaaactgaatatacaaatatctgaacacaaaagtgaacattaaagacagtgttatacatgcagtagcagttctgacagacgcagagagcctgatatacaaagcaattggaaaaacagattcctagaaagttctaaaaaaggccgggcgcggtggctcacgcctgtaatcccagcaccctgggaggccgaggcgggtggatcacgaggtcaggagattgagaccatcctggctaacacggtgaaaacccatctctactaaaaaaaaaataaaaatacaaaaaattagtcgggcgtggtggcgggtacctgtagtcccagctactcgggaggctgaggcaggagaatggcgtgaacctgggaggcagagcttgcagtgaaccgaaattgtgccactgcactccagcctgggcaacagagtgagactctgtctcaaaaaaaaaaaaaagaaaagaaagattactgaaaggtcattatgtgctaggccttttccataatagatttatcttcatgttacagattaaaagaattactcaaaatatgcagactaaaaatctacattaggcactttataaaaggtatcagagctagtaaattagcagagcatggatttcaatctccacccaaagagtccaaagcccacactggatcatttatgactagaggaaaaagggaaagatttacggacacttcaactcatcctcaagagttgtcaggatttgttccgttggaagcaaggatagcaggatattccagtgaggatttcaatatgagcaatgacagcaaggcagggactagtatggcatacactgggcatgaggagataggctgattagaaagggggaaggaaaaaggagtaaagagagagtctggttccagatgacatagggtccagaatctccaaagagattcttagagctggacttaagtttggagatgggatgccgagagtatgtacaaccacttaatgtttcaaacctgacggatctagtttctgaaaccaaatctgactatagtctttattattattattattattatttagaagataaaatactataccaaactgattgtatctctgcccttatgaagtcaagatgaataataaataaatactaaaatagatggtttgatagatgtcaagtttaaatgagaaaataaggcaggaaaggaggacaaggaggataagataggaggtgtataattttatataaggtggcaagaaaaggtctcattgaagtagtaatgtttgaacaaagaactcctccttcctcagtttttttgttgcattgctgcctctctttcccccagtgtggtttaggattatcacaaacaataatcttatatttcctctaagagttattttttcctttgtgctcatatttttgatttatgaaaaggtgcacataactttcaagctatcatgatctttatgtttaagttcataccctgattttctatctgatcaaatgaaaattttcatttgtttttgatataagaagtttaaagtccatccattgtgacacaggtgaaatatgaatctttaatagatttatgtgattccacttcactctgagtcttcatcatagatactctctgtagctttttcgattaaagaaaagccagacacattaacacagattttaagcaattgaaatacagagaagattatcaaatttctagaacttctgattgttctgtatttgatgccttttcttctacagaatttttgaatttggtttttcatcagaacaccattgaagatatcacttaaggaatctagggaatttaagaaatgttaatccccgtgattcaaagtagatattttatcttaaatgtagccacttgtcttaggggtccccaaattataaattggctatataattacctatttcatggtaaatggattattagttcttttttacttctctgatttcacttcttcttcctctttttaaaattaatttatttaaaaagaaggatctgggtgtgaataagtagagatatatttcttgtatgtcttaaaatttaaaaaaattatacaactttccattgacacggaacatttaacaaggtttactttagtatgatattaaaattcaccctataattttaattgggataaatggcatttgttctttccagcagtaggtgggaaagttagaaaacagtatgtgtttcccaagagtctaataggaaaagaatggggttgtgcattttgtccaagactcctactccatagaaacaacaaatcgtctgtataacttgttctgggctttttattttgaaaatcaattattttaagtgtagtcataaatggaaggaacagggaagatgctgccatatagacataaaacagcttgatattattttggtcttaaaaatatcgaaaaaataaaaattttattgaaaatttctgaaaacttatgtaaaaaatggtcatccatcagcatctgatttggtggtttcctgcccataaggcagatacacctactattcaattctgtattgtcaaaaatcttggaaagaatcatgggatgatatgataaaccatcagctctttccaagcactgttatatgtttacagagttggatcagcatccactggtagttccttccagtgaagtctctctagtcagccttcagtacactgtcttaacatatgtccatcactgtggctatactgcatactttctatagtgaacataattgttatgaacaagtacccaagaatgagacttcatgggctcaaatctcagctctgctacttaatagctctatgatcctgggcaagtttcttgacctttgtgtgccttggatttatcatctgttaggataatactagtgcctgtaaaatattagcaccatgcctagcacatagtggtcctacatgttgcctatcattattatttctaaggtctatatatatgaaatattacaaaatccatactttaaacacttgaaataaaagaagaattagatgccacacatatccttaaatttcctttgttgtaactttttaattaagtgcacacctatacacctattgctgaagtttcaagttattcagattatccaaccagataaactgaggcaccattttctaaaaagggagaagatgaaggagggagaaatgtggagagtgaggagggaagtaccaggacttcaatttagaacacataaaggttgagatacctgtgagatatacaactgaaaatgttaagtacaattttgcatgcaaaaatctgaatatgacatgtctgggctaatgacagaaatatcagagttactggcataatgatagtatttaagggcatgagaatggatgagattagttggacgagggatattaagtgaggagacttctggaatcatgtcctgtgaaacatcaacatttaggagacaggtagagcagcagagttggtggacaccttggaagaagtcacagaggaaggaggacaaccatgtgtgtttagtgccttgttttgaaattgattaagtattgagtaggatgattagataatgagtaggatgatatctgaaaaatatttaatgaatttgacaatgtgaagatgattggtgttctttgcaataggagttttggctacatgctttcacgggagccagattggagtgggttgaatagtgaacgtgggtgactaattgacattaggttttattcataattgaaaactttcacagagcttggctgtgaaggaaaaccaagaaaaagcgcatgaggtagatgtttaaggttaggtcaagagaagcaatgtttggtttatttgtttgtaagattagtacaatccattaaataatattgacaattcaagggggggagagaaataacagaaagactaagtacttgaatagataagcaggataagacagtaagcacagttccaaaatacagtatatgaagaagaaagtggagatggtgtgaatataggagaattttcttcttattgcttttagctttgtcttcaagtacggccttggccttcagtcgtatagaaagtgtgaggccagaaatgggtcatttgtgagtttgtatgaggacagctagcagctcatgttcttattatctgtttgttagtctgaggggtggagcactggtaactaagtgatgtcatgttaccgagtagaaagggaacttcactgagaattagaattccagggtcctagtttgcaatgtgcctctaaatcagtatgtgatctgggcctaagcatttgaaaatctctgaacctcagcttttattttatagaaggagaggcttggggatcctttagaatgaccagtgaatgatccatgccactgtttggttcattacagaacttaaagaaggtcttcaaactgcagctattcacagtcaaaatagttccatatatacaatacttatttgtgttcatggactaaacatgtaaaaccttccagactttcaatatacactttataaaatctgtcctctgttgtctgtggggatttttttctgtcttatagattgccatttggaaatttaaaaataacttaaatatttgactgtttaattacaaaaatgtacctggggcataaaaggaagaattaaacataaaatttgatttgaattcttggtattatagatggactgcttttgaggagaaaactactgctaaccacaacctgttcatcaaggatttttcacttcctccttcactgcttttgtgactttaagtgtgctttataaatttccgtccaatgacagcacaatcaaggcatgcaatgattctttcattcttctctgataaaaatctttagtcttagatagctaaaagtgtagtcaaagacatttaattttagccttggggtatccattctctgtcacaggaaaaaataaatatacataaaagtaataagatttcatagaaaacagtgtgggacagagctgcctgactttaattttctgaaatgcaaggggatgcaattaactccctggttgtgattagcctcttggaagctgaataacctcagtaaattacagcacccacagaacccataatggcgtcatatactcaatattgtttacttgtctttggatttacagtcctgcagatgagtcataggatttatgcattaataatgaatcaagccaacttcaagaagcagcgctgcctctactcgaattacgtgtctgcctatcggacctttttaaagtaggtattggccaggactagtttgaggcactggctcaggggcaatatttaagaggacaccaaaaagtcagtgagtaagataaataacattttaaatcaataccttaaaaatcaaaattaatattttaaaaataaaaagttgttcatgatgaataacatatcaaaattttaaataaagacaagatcaataacagtggtatcctgagctgtactggagcctgaggcaaaagggaaattcaataatattgatgctgtctttatttaaatttttcacattttgttcatcatatatttttgcattattcagattgtttttttcaaatattgcagtaaaatataatttatcttgattactgagctttttggttcccccttaaatttaacactcaggcaagtgcctgaccctcatctcagcatttataatttaacaccaaaataactggcatgcaggaagcactgtgcccgtaacttgttcctgctgccataataaaagcagactttgcctctggaagcattccacattttaccccactaagttcttttccttttagtttccataaaagggtttattcatgtgctgtcctaaaagagtcctgctggatggcccgcaataccccacataaccaaaacaaccactgcatcaggagagataaagagtatcaggaaggaaaataaattccatatattttgctcaaaatcctggaacagttgtaaggaaggcagtcgcaaagaagtaaagtttttcaactagaggaagtacgtgaatctctcagtgcatatacctaacaaatgtagatagtcaatagcttttatccacataactcttggatcacaaagggaatgaatcattgcagtcaaagaaaaacaatttacaaggaggctgtgtccaatctcaaaaggcaactaaatgaaattctgagctctgaaaaatctgagatccgcctttattatcctcccaatttgtgaaccactcacctcagcaagactacaaactccatgaggggaagaacaaggacttcttgtttgcttatctttgtatccttagtgtattaggatacatgggaatttcacttatccctatactctgcacgaggaaataattgccacaatgtaggtggatgggtataattgtcaaccttaagcaatgacatatgaaaggactttcacagcaaatgagcaaacggtatgacagaaaaatagggtatgttagggcaaggacacctgtggcaatatttctacctagggattggaaagaggagattttctcaggagaaggcccctcaggactagggacatcccctactctttgtccattcctcctctccattgcttttctaaaagataggtcctgaaacatggtattgacattctcaatttctttatctttttaaatagacattaaaaaattcataaactgcaaggcctggtttaagttatccctcactcataaagcctaagatatttatactgtattgtatcatattattcttgattatacaccaactcatattgctcactaaagcacataaggtaactttgtgtgaactggaaaaaaaagaaaaaaaaaagaaaggtgtgccttcatcaagacacatagttgcagaaaaccgtatcaaaataatggtgcaactagttgaggtggatggtgccttttacatttttgtaatatataaattgtacaatcctatgcaatgacccttggtcactatgtctggcttttattttatatctacatagtaaagttaactccttacttccttccctccttcccccagtcccttcctccctccctcttttcactccttccttcctttcctatctccccctgcttgccccttccttccttccctccttcctttcctccttccttccttccatcctttcccctgttcctccctcccttcctgcctcccttccttccctccctccttccccgtcttcctccctccctcccttccttccttccctcccttccttccctccttctttccttccttccttctttcctccttccttccttcctccctccctccctctttttctttgttccttccttcctttactcttctttgttctcaatacttaacataatcctaaacccatagcaaatactgagtaatactttttggctgttgaattgaaatcctcctttaaaaggggagacacctaactgtgaaatcataggtgattttattttgtcttctacttgttctatattttaattgttatacaaatatgcattatttttataattagacaaaaatgatttaaacctgccaacaaatttagatgttaagtacttattcaatggccaagcccaagtaattgtgccttgtctgatttgagggaaagtgccctgcatatttacaaaaatgtattataataccatgcaattcaggtaatgcaatcctttatcttcttgttaaataaaattatctctttaccatattgctacattttagatctctctaataatgactgcaactgtcatgtagtgagtagaatggaaaatccctcaaatatcagattgcattctgatactttgaccccaaactaatcaaactaaatataaattttgacattttttctggcccttccacagatttaaaaagcaatgctgtctgggcatggtggctcatgcctgtaatctcagcactttgggaggccaaggtgggcagatcactggaggtcagaatttcgagatcagcctggccaacatggtgaaaccccatctgtactattaataaaaatacataaattagccaggtgtggtggcacacacctgtaattccagctacttgggaggctgaggcacaagaactgcttgaacctgggaggcagaggttgcagtgagctcagattgtgacactgctctccagcctgggtgacagagtgagactctgtctcaaaaaaaaaaaaaaaaaaaaaaaaaaggaattctgtcccagaaaaggtcgatctgaaatcaaattcatatatatatacatatatatatatttcaaaagatagctctgtttacatccaggattttctttgtttttatttttagaaataatcagaaatctcacttggtttctattaaaaatgcatttagctaatattcacctgtgtgagtgctgggagattcctagatttttaaaaatcacatagtaagcaggggaacgttatatatatatatatatatatatatatatatatatatatatacctaattccctaaatgtactatctatcctgcttatggcttcttcagttgaaataaaaatctcaccacaaatgaaatagagaacttcactaatttccattcaccaatgatggcagaagccccccatgggttattaagtctgagagatgtgtgaacaaacatgataataagcaagtaaagtgtatcgtaaaatatactgtgttcatttattgtgacaactggggtgtaattatactaggaaatgtactgcactttagtcagtgaaagtaataaaatttgaacaccaggagacctttctctactccgtgctattaagctacttttgaggggaaggtgaaaaatctaaaaatatagaatgaatgttcacttttatagattagcaaagcaggggttagtcagattctctggtcgtctaataaataaaaactctgttctttcctcattagctgtggatacaccaccaaagaacattttcctcaatttctgggtaattataatgcctaactttatgtggattgcttatgctattcatctcactttctccctccaattaaagaatagaacggcaaaaccaaacctgactccattgtattgtaactgcttctacaaagctacaagtagaaaagcaggaaaaaaacgtgcaaaaagataaggaaacaaaggggccctcggagatgataatgttgcacaatgaggagtaggtgtaatgattaaagcattagtggtggtcactaggaaacgtgaaaggaacatgtaatttcagattaggaaaccctgagcttcccagagtgaactgctatttgggaaagtgtagttaattgaattttatgacactttttactaaactaaaatgcatatcttttattaccctaatagtttcattgctactgtgatacttatgtgcagtgatacactaaaaagcatatgcaacaattcactaaagagcaccggagtggattattaccgtttccttttgtgctttggcagccgacaatccagatcataattacaggattggagccacctgccgactcactgaacagaagcacgtggctccacataaaatagagcaattctaacactaaaatatacaaaataaaataaaataaataaataaaagaaagaactatgttaaaccaaagagaccttcaggaacagcctatggaaagctggatatttattttttcatgaacgccaaatgactgactctcacattattactggcccagaacgaagcagagtttgccaagatcttcctggttaaactagatcatctaatgaaatatctgcatcccaaattgactggtgaattcagaccttttatggtcaaattcacaataaatctttgattttagagcatattatttctaatgcatagacgcaggaatgcaggaattgtcttcacttgtataaaactgttgccttggcatgcatttagcctgctaaaccagtggagattaccaaaaagtaaaagtaatgtaaaaatggtgaagtcaagaaagtgaatccatacagaatttttctaattggatattctcatttactaaacaagttaatccaaaagacgacattatttctttctgaatttttccaaatatcactttctaagagaagtcttccctcatttccttaagtcgacttagtcactccttcctctgccctttttacatgcttctattagagcagtgcttcttacacttccatgtgcatatgaatcatctgggatcttgttaaaagcatattcagagtcagtaggtgtgtgggggagggaaggtctgtgagtttgcatctttagtaagcttgcaggtgctgctgatgctcctggtcctctgaccacattaaatttcaacttttattttaaatatgggagtgcatgtgcaggtttgttacatgggtatatgtcactacattttgaaaagcaaggtattaaattacttcataaattgtcccataatgatctgtacatgtcaggcatttcctcttgtgtatgagctccttgaaagcaaaggcaaaggcagtatctcaatagctaccaattatataattcctactagttttggggtacagggaggatgttaccatacatcatctttaattctcaaatcaaccctgcaagatctgtaattgtgtttccattttacagatgaagaagctgactctcagatatgttaatcaacttgtctatggccacacagatgccatgtggcagtcagaatgcaattctggatctatttgtctccaaagtctgttttttctactgcacctgaagcctcatctgtttacttctgtaaatatagagtgtagcaaagtacctattgttatagaaggtgctcaagggatgtgtcttgctctgtgatcactttatatataaattcacctttgctcacagtatctcccttgtgtgaaatgctcttcctgcttctgtcttcccaattaaggtccatctcacttccaacgctcatttctacttagccagcacacaattgtgcctttcctctcttctgaatgcacacggcaatggtttgcagcacacaatgagcacttaaattgttagttatcttattaacagtatatttacttcattccataaatatatactgagtatatattaaacaccaggcatggttggaagcacttgtgataggtcatggagcaaaacagaaaaaaaaaaaaaatcccttctatcctgggtcttggaaataatttccccaactaaaatgaagacttctttgaggcagggacccaatcactccactttctgtatttctcattatgttttgcacatagtaactgctcaattaataatagtctcagtaaggtaatttaccatgtagatatgttcctaatatacagagtggaactacacacaaggcctttctcttttctcataagttatccttggaaagtgaaacgatgctttcacgctgtttctcactttcctccaactgcgttttaggccagaagcagaggtattaaagtcacacacagtgcaggtatcagccagagagacagaattcactaaaatttaatcatagcagcttttagcacaaaaaatatcttttcacaagtgtagaaattataggcaggagagataacctcatgaaaagttactttcactagcaaatatcttttttcctttacactccgaaacaattgactagaaacctgctaactaggagaagtcacatgcttaaaatttcacaatattttgttgtcgtttgagtcaaggtctccctctgttgagtgcagtggcatcatcactcactgcaacctccgcctctcggattcaagggatccttctacttcagcctcctaggtagctgggactacaggtgcatgccaccacacccagctaatatttttgcattttttgtagagacagggctttgccatgttgaccaggctggtctggaactcccaggctcaagcgatctgcccagtttggcctcctaaagtgctggtattacaggcgtgagtcaccacgcctggcctacttcacaatattttgttcaacaacattttgaatgtgcactatctgaaataaaaagtataaatgttttcctggttatttgaaatgctccattttctacttcacaaaaccatcatttttaaagtctgctcattcactgaacgaggtatacaaagctattctttttgaaggtatagctcttctaaagcttcattaggttgttagtcacatgtattaacatgtacaggaggcagacctgcagatgagcaatttagaagggaaaatagtactcaccttgctctgcatcggttcttcctcatttttgcaatttcttatgttaaataaatctacatatattaatctaccttgtatacattttaaaacatttgaaagagaagaatgcagataactcttctcaacttagctattttattcaatactgagatatttcataacacgatctgtggatggcagaaaatggaatttgaaatgagttctaattcttattaacatgagaacacaggcatacatcttaagtacagtttttgtaaaattgatgtcacaatttttattatgcaagaatgttatgagaagaaatatatttaacatatcaaatcctagtttattgctgatgtttagttagtagtagtattcctgcctatattaacacttacacatacacaattatattactgttttttaattatgaaaaagcatttatttacataccagtaataattacaccagcatttagctaagcaagtacacaggcatgatctctgcattcgcaaaatatttcaacttaaagttgatgtaagtagatatctgaaagaagttataaataaatagctacataaacatgaaagaaaaagaataggtgaagtctttgccctgtgtctcaggattaattcaaagtttccttgctgaaaagaggaagacatcccattaatcagatttctttttccaagttcttcctttttataggaattggcaggaaaggtctttggctaaaatacagcttaagattcgtgtactgtggctgagctgtaggctgcatcctagaagagccttaaacataagtaaaaataggtctgagggttgaggaaaaagaagagaaagaatatagtgacaatgaatcacggactcttagctctacagaccttaaagacaaggcaaaccaaatccctcattttataatgaggaaactggggcccacacagctgaagtgacttgctcaaggccacatactgggattacagccgaagaatctttgcatgtaaatcctatgtgatttaaaaagaaataaatatgaagatcttactagatatgggctgctaaccagatgggaaactgtgtttggaattgctggtaaactggaatcaatttgtttagcaagtggtaagaatatacaaacatggggaatgttttaggcaacgaaaaagaatgtcatgtgaagaatatgtacctaatataaatggcaattttgacagtggttctgttgattcaagttttttgtgggtttaaatctctttacagacaaggatgaaactttaattctcaatctatataaattatcaggctattatttcaaagaacacaaaagaatagtaatagagaaatgtacacttggatttggtcattctcctcacactggagggaaaattttgccttgaatagcatgaataatgagaacaggaacttttcaaacattttcaatattgccagccaatgggagaggctgataatcaaaatgaaattttgtattcttttcaaatcaccatatattaaatatccaagatagtattaaaaccctctcataaatgttgccatgatgttctatttacaaaatttctttgggaacaactttcattctattaaagtctttcattatctggaaagcaaagaactaaagaaaggactttaaagataatctaatagtctaatagtccttcaatgtaagggtatattagaatcatatggaggctcctaaaacatagatttcagagcactacctcccagagttcccggttcaggaggtctggggtgagatctaagaatatgtatttctgacagattcacaggcaatgttgacaatgctgatccaggtaccaccgtttgggaatgactaatctagtcaaactatctattattagtctaattaccttctttttgattcaggtagacaaattctagtattcttggaacttattatttaaactttttttctcaactcctccaacaaccaatttgttctgtttctgatgttgtcactatactcatcacctattaagctgatttcaggtatattctactaaaatattgaaccaaaacaatcacgcaaactaagtctcttgttcttggtacggttgcatatataaatgctatcttttgcataattaatacggaaagaaaaatcaccaagaacattttcaattccaactataccacatcaaatggacatttgggtctcctgtggcttctgcaaagggaacacatagagaattcttcagggacactggaggactaaagcagagcacagaagtgatatgctactactgtaagagaaatgggattattatctccagagagcttatgttattgctggaaaaatacttcaagagtgtcaaatcttaaagcttacataaaaaagatcaaataagtattgtagcatttcacaatgatctgatgattcccgtagtatcagctaatcagtgggaaaaaagtaaagtgaccaaaaaatagttatcttgaaatgacaaaatatcctagcagttgtcaaaattaatatgataatatacaggccaggtgaggtggctcacgcctgtaatcccagcactttgaggccgaggtgggcagatcacttgaggtcaggagttcaagaccagcctgggcaacatggtgaaaccccatctctcctaaaaatacaaaaagcagtggggcgtagtggcgcatgcctgtaatctcagctccttgggaggctgaggcacgagaatcgcttgaacctgggaggcagaggttgtggtgagccaaaatcatgccactgcactccagcaagggtgacagagtgagaatccatctcgaagtaaataaataaataaataaaaataattaatatgataatatacaaatcagggctgctgcaatggaatgtgaagaaaatagaaaatgtttgctaaatccatcatctcccatgatatgtatacgtgcccatgaacatatacacatacacactcacatacaaacttttcctagatacacacacagaacctttactcaaagcattttgttcctagttacggaataaagatattgaaaaatgcattttcattaatgtgataaagcataataaattactcctgccagatgtgatgtgacatgtacatattttcttaaaagagctgtagaaatgggcaaagatcacacacacacacacacacacacacacacacacacacacagttaattaacggatcctccaagacaccaatcttcaaatattactgagcatttaataagtgttatgagaaataataccaaaaacagaagaatgagataataaactacagatgagaaataaagacttatacacataaaaagacaactctagacagtaaatatttgggttcagaagcagaagaaccatcaagtaatcaaagactgcactactctggatgaacttgatgtgagctggatcatctccacaggctgaattttcttaggcagagcggaaggagggaaggaagaggacagcccaaatgagggcatcatttagcagggatgaaggcataaagaaaaggtattgactacaccagtgtgtctctatacttctctgaatcaaagagttgatgccagagcatgtgaagaacaaagcatgctgtagagttgtcgcataagattgtggaggaacttaaatgtggaaagaataaaagaatgccagaaaaactgcatgttaacaaaacctactgacaacattagaaaaggaaatattgagatagtggagagagaattttcctggagacctcaaaaccataaatgagagataatactgaagacctactccatttggctttacatggccatagctttcagggactcagataccgtaggcactgaatgtcaaaagagaggttgcatttagaactcaggcagcagcctctcatactgcactctatagatcaattttagtttaatgagatttaattttaaaatccttaggttttatctttagcacttcaacacactgaaaatgcttccaggttttgatttacagaattactgtcactgtcaataaaagaaatgtgcctgacacaccaaaatccagtttaattacttctgtaatgtctcctgcagctaagaggaaatggtatttctctgacacttttctgtttttaatttagcaaaatggagcactttcccttaataggacctgggacagcagattcagaattgatgtcatcaaagatggaccccacagtttcagcaacactgtcttactctgactgtgcaatgattgcatgaatctggatccttggtattggattccttgaagctgggcactcatcaaagatttgacacggaatcatggctgggatatttagacattatgtcatcacttggagaagctttgcaagcaaattcaacagcctgcttctacctagaactcttaacaatgtcagcattgccctgaactgctggaatccagatgaggccttgaaagcttccaaatagaactgccaaatatcaaaatatacactgtaccactggagtgaagaaaccaagaaaaaatgtgtactttatatcttctgctacatattccatctgcttctctccctaaagggtcatatgttatatatttataagaagtgttcacacctacgcgaacagtttccactgtctccttcaaatacagcctcctccttgttcaagacccatttttttaaattcttctatggtagctgaaccttttatgaaacttgttccattctgaaatcatttcaagttaagaaatgcccttgtaccttcctatctcaccaaatcctggggagattaagcctcacactctataggcctttttctgagagatgtgaatttagatcattagggtcattaaaatcacacaatctataatactcagagctaacatatcacctttgtgctttatgctgctatagaatgctacaagagagttaaaacacgtatagcatcacagaactgtagagaaggccataattcctccccataaaagaattctatactttttaactggcacagtaaatctcattaaagacacagaatgctttgttcagggaagcaaaagggatccctgggcaaggtgcgtttccttcacagtaatattttttttccttatgacttgaattattccttaatgcaagcacaatgttatttttatcttgaccttttttctggactctacatgtttccccaggctttttttcccttccctacaaaaatgaggggcccttggtcttcactattaatcttgtattaacttttaatacactgggcttcatgcatcctcttgtatttctctgtgtatctaccaaagaccttcataggccacactaataacctccgacttagtctttttttctttctgcctcaacaactgtataaagaataaactcaggtataattaacataataaatcatttggtgcacattcattggtcaacacaattctgaatcttaacagttaatttcccactatacagattgtgaatctgattcacataaaagtactttgggaagtattttgtctgatttcactatcaaatattagattattatttttgagaaactcagaaaggctgtcatggaaaaatcacagaaaattcccatctctctttcataatcagtacctttttaataacagagctggaagttaatgacagtatgcttttgacagctcactctgaaattttaactcatctgtagaagtgccaactgagcagttgaggggaaaagcataaggtttaaatttacatctaagaattaagagtgagaaaagcatggaaaaacattacacagtgttaaagtgcacttattactaatttctctagggaattttgcagctagggaatttcagttgcattattattgaatctatccccctttaacagagactgtgggtacagaaaagaatatggccttgaaggcagacgcattcaagttctgtttgtgccaactactaaccatttcagcccaaagaagttacttaaaatattcatacctcacaatcagcaaagggaagagacaatctaaagaactggagaaaatatttgcagactattaatccaaagaaaaagtaataaccagaatacataaagaactcaaacaattcaatcataaaataattataacaaataattgaatttttaaaatgggcaaaagaagacattcctcaaaagaagacatataaatggtcaacaggaatataaaaaaaatgcttgatatcactaatcatcagagaaatgcaaaaatcacattaagacatcaaaatcaaaatcacaatgagatagcatctcactccagttaatatggctattataaaaaagacataaaataacacatgctggcaaaaatttggaaaaagagaaatgcttgtacactgctggtggaaatgtgaattagtacaaccactatggagaatagcttggtggttcctcaaaaaatcaaacacataactaccgtatgatccagcaatctcactgctgagtatatatccaaaagaaaggaaatcagtatatcgaagagataattgcattcccatgtttactgcagcactattcacaataaccaagataagaaatcaacctaagaatctgtggataaacggataaagaaaaaaatggtatatatattccaatacgagttgaactggaggtcattatgttaagtgaaacaagccaggctcagaaagacaaatatcgcatgttctcactcatatgtgcgagctagtaaaattgacctcttggagacagtgaatagagtagaataggtggtaaccagaggccataaagggtagaaaggtggagaggatgaagaggggttggttgatgtatacaaagataaagataagtagaagaaataagagtagtgtttgataacacaatatggcaaatacagttaacaatattttattgcatatttcaaaatagctagaagagtggaattggaatgttcccaacaaaaataagtgataaatattttaaatgatggatacccaattacccagatttgatcattacacattgtgtgcttatattaaaataccacatgtaccccctaaatatgtacaactatcatgtattcataattttttttttttttgagatggagtttcacttttgttgcccaggctggagtgcaatggcacaatcttggctcactgcaacctcctcctctcgggttcaagtgattctgctacctcagcctcctgagtagctggaattacaggcatgtaccaccaggcccagctaatttttttgtatttttagtagagatggtgtttcaccatattggccaggatggtctcgaactcctaatcttgtgatccatctgcctcagcttcccaaagtgctgggattacaggcatgagtcactgtgcccggcataaaattttaaaaaatctatttatgcttcagtattcttctttttacatttaaagtaatcagatatttttggagaaaaggtaaagcttataaaatttaaatggcatgcatataatacatattaattatgatattagcactgaaatatgttgatgtaatctacataaattttttgtagttctttttatgcactagctaggcatatccacagcaacaaagtatagaaacaacctaggcctgatctaacacttctttccaaatccaatcataattatattattttaaaataaaagatttcataaattataaggtaattatgtgtaatcctatactttaaaaacactcctgataatttgatttcataaagtgggagaagtatttaaccgtttgctctcttcaaatatcttcctgattaataaaatgatactaagtatttttttacttttattttagatccagaggtacatgtgaaagtttgttacataggtaaacttgtgtcacatgggtttgttgtacagatcacttcatcacccaggtattaagcctagtagccaataattattttttctgctcctctccctcttcccactccaccctcaagtagactgtggtgtctgctgctcccttctttgcgttcatgagttcacgtagtttagctcccacttacaaatgggaacatgtggtatttggttttctgttcctgcattcatttgctaaggaaaatagcctccagctccatccattatcccacaaaagacattatctcatttctttttatgtttgcatggtattctatggtgtatatgtaccacattttctttattcaatctgtcatactaagccatttattatttgtacttatttggtattgtgcaaggttctgataattcactgtgatttatcttcagtttgttcacacgggcttttggtacatcatttttagagaagtaaaatctatataaaaagtaaaattaaacttaatggctccaagtgtcaacagttagcacctctgattaaggcagtatccccatcctgccttgattctgcacctgttgtgttgctacagatggaagtaacatgataaacacggatatataatgcattcgcatggaaaaaaaacattcagatgaggctatctatttgaatagcatttagtgataactaaaaccattgtctttccttgagaatagttagtcaaggtgactagcaaaacctcctctgaatgcagctctggttagctgggctctggtgagataggatagtgttaccacagtaagaccaacattgaaagccacctccatatttacctataagatcgatgatgaagagtgctaacatttgagccaaattaaggtctacacagacagagttttaatgaagccagaaaaattagagcatactagcaggaaaatccataggtgaagaaaacattctgactgggtttgcttcctttttgatttctaggggccaaggtggcagaattcacagactaaaaggctgctgagagttgaatcatcaagctgctcaacagtgcaagggactaacatagataattcaaatacagcattactctattcccttttttgttgtttttctccccacctaaattttctcatatagatacagactgaaactattattcagctgcccaacaataatataaaaagaccaatgcttccatttatgcatctacttttatgatgtcaattctaaaaagaagaacaaagataagtttacgtaaaatagtagcagatagcacttctatgacatattacatttctctgtcatacattatgctttattttctgtccttcattacattttcttacttagtaggaaaaatattttaatcctttatcattcacctgaggcaggtctgaccctgtttccccatagtttttttaaggtgttttcagtaaagattgcttatgaattgctttaaacagcttaagggcttccacttagaaaaaattcaaggttaataagattcatcatactcacaaagagtatctggttgtggacatagctacttgctaaattttattcagccctaagtgacaccagcagcaaatcagctcacagcttaatactactggcaactctaaatgggagagaagtaacattactcagatccaggtttttaaaaatatatgttatgattcacttccattagttcatatattgatgctcagacactggatattggattctctttcaaacaacaaaagaagctgagaaacaaagctgaagatatttttaaatgtcatggtaaaaagtcacagggaagtgtattttatcctcatttcagcgaatgtttctaactctcatatgaaagatacaataaattcctatcagaaagattttctcttggcaaagtttaggattctgaaaacagccttttaataaaacagcacccacaccctcctaagctgtagcaccaaaataacagcactatgttatattcttcccttatggtaacagacactgttgaagctgaactgtaatttggcatacaacatttctatactaatgtaatgtgacaatgttattatgttcgctattttgcatacggtcatagccatgttcatcttctccaacctgacattaagttagcttaatatggtaacattctattccggaccactgggtaaaaggagaaaaggattattgtgtagcacactggtgtgatgatggtggacgaatgtgtaagtattaataggtgatatataaaatttacaatgaatgtaaacttttagcacagaactggcacatagtaagtgctcagcaaatggttacatccaagagaaatttcataaacagctacaccatacaatgtagtccagcacactgtttcctacaatttcagaagagggaaaaataatgtcaagctcagaaaacaaaggaagtttccatgggacaaaagagttttagtagagattgaaaaggaaattatatttcttcaagcagacatagtgaaagaatgcattccaggtggaatgaatgcattttccaggtggggaaattagcataagcaatggtgaggaaattggaaagtgtaatgttgttcagaaagctgtaagtaaattggcagtaatatgccatatggacaaggttctgcaacagataagtatgaacatgaaggctggggtcagaccattgaggtccacgaattccacattgactaacttggagagtagtattggacactgaggatatatttgaaattcttctgcaagatgcatgtgtctagcacgctttgattttagtgagttattacaattacatgcagcatgctataaaaacactgggcttataaaccaagaaaacagagaagaatgttattcctagtagaagtatagagtcttatagggaggtaagactaaacataggtaactataaggaaaaagtgatggcaaattaaatagtataaacaaaattctataggaagccagaggagaaaaaaaatattgcctctggttaggagaattaggagagactgatgacatttaaactaggaagaatagaaagaaagaacaaaactggcagagaggcacagaatggatcagaggaaagaggaataagaaatgggagataactaagaaattacatgatataccagaaaaattatacagaggatctaaaatttggtattgatatggaagaaaacttgaagaggtgagtatatgacattaccctgtacacacacctgcatatccacatacacacatgcacaaaacaattgtttttgtcagtgagtaggtcacttagatggcaattttccggggaagaaagggtttaacaaacatttcattaaaaatagcctttggcatcattttgaatagcacttctttttgaaagattcctttcagttcaattaattagtatgatttatccaagattacatttacaagctacaaagtattcccatcttcccattgttaattatatctccaggctaatataaatacattttttctagttaccctaacccactctataaaccttatcagcgagatgacatttagaaattctattttgggggagggaaggtctcatttgtaatgtggcatgttcgtttccccattaaaaagttttgtttctattttcttttttgttttctatgtaattggaggctgcaatcacagaatttatgaaaaaataaactagagatgaaaatttcattaagaagtgaaatgccttaaatggctttattttaaaagaaaaatcagcttctatacagaaaaggagtttgttaaaaccccaggaatcacactaattctatttgtgcatcttagagaaaaacagtgagatgtacagacaagatttattttgatcaatttaaaaagtgaggaaagtgttgcatgctatttctattgcttattaattccacgtcttcaaagtaacaattgctactatatcttctaccaattataattgatacaaaataagatttgcttttgaatattgatttgtacctatgtattctcaccactgaaactccaacgtataagccaaggaaccatttcacattttcagaaaacccactaacaggtaatgatttaatcaaaatgcatgtattctgagagctctctaaagtaattttaatgctgatttgtgcaagaggcatatcaggagacacatttattgaatgacatttacctatttacaagaaaataacgaatagccttatcattgtcatcaccagtactatcacccaagagcagcattaaaatagttttctgtaaaaatcattcgaagacagcatgatacttatggttgtatcttggtgtttctttagggaaagtctaacaaatacatacacaaaattatattctttatatttaactggtatatgaggatacacagtctgccacaaccaaatggcaactgtatgtaaaacatggaaactacattaagcatagtttggcagaaaaagttctttagcaacatgaaaaatattttcacaccaaaaaaatccctctcaactaccacatgtagtcatacatctgtcaggattgtattcaggatgaaaaatttgcgataataaaatcttaacaagtattcagtcttctgattgtccttgaaaataaatttacgccattttctgtgaggcaggaacaaatgcaggaagtaatttacctatacacacatatacatatccttatgaaaagcacatgtaaggctgctatatgtatatatatttattaagactttatgtaaagttgtttatataactcaaaatggcgttattgtgttttaagtgtgatttggcttgcagagtgttcgcaaatgtatgatagtttgaatacatgtttattgcttcaggtttactgtaattctatgggagaggaaactagtaaaatgaagaacaaatatttctccatctacagtggcatggttgttaaaggcctcttccacatatgttttaactctgtattggttgtgcgtttttccaatagtcaatattttggaaaggaaacctaaagacagcaggtaaattgtactttattgctaggctgcaacaactcagttcagaggattactgtagctttaccccatcttctacattgcgatgcacatatctgttgacatgaatacagtctcaaatagacaaaggtcaaaatgaacaagctctactctttctttaaatccacattcaaattcagcctctgctacaaaatctaaaccttcaaccgttgcatcttctattccatcatcctggaggtttagcttaagtgttgtagcactgacaacatatagcacgtattctattttacaaccaggtcaatttgtcaggaatattctcttaatatagcagaatgcaatgttttgtatgaaattcttttatcattttgatgatgtgctgtaaatcaggacctattagaacattaagacacagaacttcatcttatagatcagttaattccatcttcaaaccctcactgctgtgatataaattaggcactagcagatatgccatgatataatgtgaatcatgtgttttattttcatgcttatattgtaatacttagttaaaggattttaaggggaaaaacataagttgctaagatacaagggagaatggctgaagggacaatgtttgaacatatttttttaaaagtaaaaggcagcaatgggcttaaagagatgtacgcagagagaaaaatgagacctgtaaccattcagtaaaattacagccctcgagacataatcatatgaaattaagtattatttaatataaaacaatatgaaggttctttcaaaaaccaagggagaattgtcatatattggaaatgaaaaacattcttttgaacaaggtgatcattagtaattaaaaaataacaataaacccaaaaaccaaagaatcaccatcatcacaggatttagccactttaacaattagtatttcaaaactgtcctttccgtagaaacaactgcttctatgggttatgacagttcgactgactcagagttaatataaggactttcagtgttagactttagatatcaaacagtaactggaagcaacgatgagtatcagtccatactcagagaggtacttacggtcattgcagagtggtccactgaaggaagtcatactacagtcacagctgaagccatcccattgttgcaagcacacaccttgattggaacatgagtcctcttggcaggttgtgctgggccctgcaaaacaatccaaaggaaacttgggttctttaaaagaatccaaaagcattttatacatgagctagatcacatgtagtagttgccaacaccacagatgatatgtccaaactagtttttaaagttctagttcacacacctgaattaggaactgagaggctgtaatatgaaggttttcttaagtttcaagtataggataaaatacattataatcataaactaaaccaacaaatagcaaaaacaagcacatagcttctagtatgattattgtagcaggtaatctcattccaacttcaataattctttatcactattttgattttagaaaatgaatggatctccttaacattctgaccaatgaatagagacataatgagaaatggagattataacttcatgaaattgagataagattggcaaaataactgaagagagttatgcaaaaatgccctagaggtttccaaacgataaagttatgattgctgggtgttttgaataggtatgttggcaagtatcaattcacatgcttttaacaatttcatgcaattaaacataaaattaaaaactccatataaatggcatgccctcaataaacatacaagtaaaaagaatgctagtctatttctaaagaatcataactagaacactgaaaaacaaagaactaaaaaaagcatgatcaaagcactaaaggcaatcactatacaaacatattcaagactgaaagcctttatacaaactatgctacaaagttaggcttcttgcacaacgttcaagaaaggaaaagaatgaaatctgaacccaaataacagttactgcagaaatgtaaaatatgttattttagggtttccactgtgtattatggggtttcagtcttgttatatacacacagggctatctaccttgcaagtcagctttcatcaatgcaactttgtcagcaaaataaaaaaaaaagcaaaatatattaaatgttagtaagcaatactgaaatggggcaaacacagaagaatgttcagattcaaaaggcatgctgctgtaaagagggagaaaaatgctatgtagagcaaacaaattaatactaacagccataaatcttaagagaagccaaaaatgagaaagcagaaatttattagaatttaattgtacatatgtatatatataatggttaattgagccaatgacatgtaatgaaggaaaattaaaagggcctttgtatgtttcctctcttggatagatatgaatgcattaccaaagtgactgtgttgcttatttggaacatgcagcaccattcatcatgtgcagatacagtgtagactatgatcagtagcaaagcaattatccctttctatgtttttccctctagatcctttatctttctgttgcaattaaggcttcaaaccgtaatgccagccattcactgacaacagctggactttagagtgacaccaaccaaatgctgcataaatgatactgtatatcatttagagtggatgaaagaagtaggaaggatggaagaaataaactgcaatataatccatcataaaggaattttctgaataaaatttccatgtgcagcgtttatccttgaacttaccagattgggtatatgccacttatgaatttcagagttacgtctgtattttctacactttcacaagtattttcaactcttataaacttccctgtggaataactgttacagtaaaacctcactaataagaacctatcttagaggagggtgaaaagggaatacagtctacctaaatagctttagagtataaactaaatatattttctagtaaataaacatataggttttataaaaatagaaaaaaagacaacagctaattagatgctattaatgtaaaagagagagcctctgaggtgcctgctttagtgaataaattagaattttctgtaattatattttgtataaatagatgattttgaaaatggcttctaaacatgtaccttacaatcacatttgtattataaatttttagtaaagatactctttattgaatgttattgaatttagcctagcctctgagaattcacaaattcagaaaccatgatattgtaaatcttaattctgtaataataataataataacagcaataattgtaacaataattaaaacaaaaatagtagtttatataagtagtaatataataagaagacctcccaaatccaggaaacctgaagagagtaacagttgtttttttcaacttagttatttgtaataaagaactaagaactaacaaagaactaagaactaacaaagaactaagaaccactaaactcaacttagttctttgtagtaaagaaataagaaccacttaattgcttagttttaatttttgttccaaactgtgagagggaagtggtctactgatccttatcccatggcattagagatcaaaaataattagcatatttttaaaaataaaatctctcaaagcaatattccttagcatatttcttccagtgttaagcaaataaacagggagtaatacaagcccagtttggggagatgccattttatcaaatagctatttgctctctgacctgcacagcagaagaaaaggtcagaagcaagaactaatgaagatccagattttggtttttgttttttcaaaaattatcagaaatgcaattgagaaacaatgctaaactctaaaaatagtaaaactacaatcttagaaaaataatctgcccatattgtagagcagcaactcagagtacctgccaagcttctatgtaagcatacagacgtgctgtattttattttcattatcacaatagtctttatattcaggaattacaagacaatgcatgcctttgcctgacaagacacatttttcaaagtactcaccttctagacaatacttaaacattgacaggtattacacaagagagagccttaaatttatttttctttttagttatgtaatattatctttattttatcactgaataaaattaggaaaaagctacaaggacatttgtattaagttatttaaattaataatatgtctaaaagggaaagaaaaatgaagataaaactacaatttccagaaacaaaagaaatgatacacaaaagaggttaggtgtctctgctttcaagtaaggtaaacttgagtttgaaacttgtgtcatccacttactaggtgtgggactttaggaatgtcaccttacttttctgaggttcaatttactcattaaaaaaaggcaatgatacctattgtatagagtcttgatgatttaatgagatagtataggtaaacatattcccaccagtgtttaatcaatgatagctgtcacgattaaacagaaaattattcctgtagatataatggagcctagagctgaatgttacagttgtacaaaaagagcatctattaaaatttcactctgattttatgtagagatattatcttgactttagtgggcctgcttattggttgaattccagtgcccattttctgctacataaacagaaaaaagccatccaaagtatggtctccagtataacagcatcagcatcacttgggaacttgttagaaatggaaattctagggctctatctcagatctattgaattagaaaccctgggggttgtaatctagtgatttgggttttaatgattctgtaagtgattctgatataggctaacattcaggagacaataatctaagtagacttcgacgggttaaaatccgtactctagctgaggtgaattttataaataaaatgaaccattactccctgaaataaattagaaataaaaggcaacaagtgattatttaggaaagatcaaaagttttttgtatgcaagaggcttagaggtgtgtgggtgtattggataggaacaatggaaactcctcacaagatattattaggttataccaaacatatgctaagtagtcctatcaatatggagcctaagtgattccagtgtggtttggactcaaattccatgacataacaatctttagaaagagaatttattaggtatctacagttaaaacactaatcctaaaaaatgtgtgaatctcatcaactgtacctgtaacaggtaaatctaagattattcctagaaactatacaggtcagaaataatagtaaattaaaagttgttcaccttgatgttggaatgaaagaatcaggacagaaagtaatattctaagagtaaagaaaaaaaggggtgtcagggtgtgaaaattataaaagctcagatatataaagcattctagataaggaaagaaccaatgccataagtgactgggttcaaatgttcaaataatagtttaatgtgtaactaatcatcttaaccaaattccttactagattatgtgggtaaacaacaccaaacatcattactgcaaatgccctttgttagtatatcctgctcctcttaatctacttgcttccgcccactcactcacattacataccagtggtgggggtcctgtgtgtttgcctcttattttctatctcattgggtatatctgcctgctctcaccatttcttgtaggtgagaagtcacataccaaacaacttgtagaaaggcctatttttaacaaatatgttccataagggattgtaatacctttctttaaaaaataaaataaaataaaggtacacattctcactaatgagatcacctccaagaattattatgttgtatcacattcttgtgttcatccactaatgggaattgatccccttaacaattttgtctctcttaattaaaattaactgaaagggaaaaaaacatagtttccttatgttttacagaggcattatgccaaaatatcaaataaagaaatatactaataacattaaaaatgaactcaacaacaccttccattactaaccttatcctctagtattactgaaatacagtttaaatttcacctaacatttcatggaaacacatgctgcacagaggaaaaaaatgtattttcaaatataaaatttccatgtacttaagtaattgctaaatataacgacattattttggctgagaataaatgattcataatcacctgggggacaggaattcaaatttctttcttcttctctcatataaaacatcctcatcctcataaatctaaaattttcaaaatggcccaaactgtgttcagtattacaggagaggcagcaacacatgcagagccacaaaattcatgataatgtgattaaattacatttatggaggaagaatttgctcaaataatctgaggtgttgaagtgaaaattatctaaaatgaaagtggcaatcaaaaagtactcctacagatcttggtctgatagagagcacaaaagaaaagaagatacttcagtgcatttctgatataggaatattagcctggggtgatacaagaaacttgtttttgctaaaacagactgaaaatatacaggatacagtgtttctgccaggtacacaccaactgaatagtgctttgagaatggggtatctgaacttttttcttttgttatatgctattggatatagatttacttatttttattttactttttttttaatttcagtagctttaggtgtacaagtggttttcggttacatggatgaactatatagtcgtgaagtctaacatttcagtgaacctgtcactcaagtcttgtacgttgtacccaataggtgttttttcatcattcaatccccttcccacgattccagcttgtgagcctccaatgtcccttataccatgctgtatgcttttgtgcacccatagtgcagctcccacttataagtgagtaacatgaagcatttggttttccattcctgagtcacttcacttagaatattggcctccagttccatccaagttgctacaaaagacattattttgttctttctatggctaagtagtattctgtggaatatacataccacattttctttatccactcattggcttttgggcacttaggtagattccatatatctgtaattatgcattgcgcagtgataaatatatgtttgcagatgtctttctgacatagtgacttctctcactatccttcacaaactaatgcaggaacagaaaaccaaatactgcctgttctcacctataaatgagagctaaatgaagagaacacatgaacacatagaggggatcaacagacactggggcctactggagggtggagagtgtgaggatggagaggatcaggaaaaataactaatgcgtactaggcttaatacttgagtggcaaaatcatctgtacaaaaaacccctatgacacaagttgacctacataacaaacttgcacatgtaccccctggacttaaaattaaaacaaaaagaatgtagatttttaaaaaatgggcacaagttgattaatactcggtggagcagtatttgtttaatgctataaagcaagcatcgtagaactgattaacaaactaatcaaatgtactacatagctcaaaaacaaaaacaaaaacaaaaacaaaagcaaaaacaggcaaaaaaaccaagatccatagatatacctcccattttacattgggcattaatgtaggcttgcaaacagtacagaaaatttaaggtttatgagataaaaaattaaaaacttgaataaggatgtctaagcccaaattgggtatttgaccagttatcagaattttgctggacagtgagattcactctcagttagacaggtggaattagaattatttagagcatgatgacaaaaatctaataccttcacatcctctctcgatctgtccgttgcagaaaagagcatcggagatgaggtccggaagccgtccatttaaatcaactgatgccaggcagccttgaaagccttctttggcatgtacaagttttggtaaggatttgtatgtttctttagctactcctcctatatataagtcacctgcaagaagatcaaagtctttgttacaaaagtaccatgtcattgactttaaacacacagtaggatggagaaaaaacagggaggtttatttttcattaagttaataaaaaattaatttatgactagctgttttccccaaagtgctaaacaatagagacgtttgaataatatactggcactaggagacatttctaaaagctatttccatagacaactaaagtaattccatattatgtggtcaaattgaaggaatgtgggctagctatagagatgcatacccttgcgtggaaatccaggcctggttatttgcaagccctacagccttgtgtgtgtgtgtgtgtgtgtgtgtgtgtgtgtgtatatatatatataagtttctctgattattagtatcattgtttctaaaatgggaacaataaaaacctatgccagagggtttcatgatgattaaatgagatgaaatatatcaagcatccacaagagcaaaagtataaagtggacacacagtcaacaggcattattattaaattcaccttctgcttagagatctctgtgtcttccatttcatcagaagttcagtaaatttcttcttgtatctaaagtcacttctatactaggctgaagcccactatccttgcttgcacctctcttgttcgataattcacataatagtctgtacataagtggatattgcatccttcttgaggtatttctgtttttaggtaaaattacactactttcaatttttaggctgctctgaaatccgttaacaaattttcaacttatttttctaattttattgcagtttctaatggaagacattgcttagctttgtttaactttttctctctaggtttgagattccccaactttatggactattacttaaaaaaaaaaagagattacaatctatgttggattctgtttctttttctatttcagattatttaccatatctggataatattcaataaacataactaagtgactttagtaaacatttaatcaatgtggaacataaggaaggtgagctcaaaattcagtaatatgctgctatagctccagtctacaagttctgtaacatactctttttatctacttcttcaactttcattttcatttgaactttctttctcatgttaaccattctattcaacttgatgtcacttggcacattttccccagtgtaacacaaaaatcctgcaatcttactgttcacctgggtccttctgtgttgtcttcacgagacttgggaacaaggagaactgatacacagactgttgagctgtgagtaacaaattccttggtctcccatccagaaatattctgtcttctgcaggcacccattaaacagtaataagctaacctattaatttgtatgtagggtaaaatcaaaccacagatataacactcttgaactgtactcatgaataaattgaaatagaggaatcatgtggcatactcaaagtcattcaacgttaaaaactgagaacttaggtccttgacctaactaaaacttaagttttataactatataatttgcattgaaagtactggatgtatttacttccccccttttacataaagcaaagtctactgactattaaccatcattcttaatattaaaagacagcatggttttggtcagagaggggatactattttgaagaattatttgatttttcttccatatttccattctgtcctttgtttttgctctcacttaaatttcaggccattgtgttttagttgcctcagagaaaggatatgaatcagaaatcaaagatacaaaattagctttctgtatttaagtctaaaaatcctagactcttcgaggaatgaaatagaatacattggagtttacataagaaaagtaaagctttcctactcctctttcagtcaagcaggagataaagttggaagaacctagttgtgcaagtacagtcattggcaaatgtcaaagagggtgctgatttctaatttaaggactgagctctggtgaatctcaaaacctcaggtaagtttcaaggagtaatgcaaacctctgtgcatttcctcaggagaactaagagggagcagtgagagctctgaaaagaaatggctgcatggtggacttagataacctgagaccttagacagtctcacacaacgttccgtactcctctgtgccatgggagctatagaacaatttccagactggcacagaaatagcaaaaaaaaaaaaaaaaaaaaaaagtccaacctaaagaggtcatgcacacaagaatgaagatgctgggtagcacctcagtgagcacctgagttgtgactctagaatatttgaaacaagcttccatgccacctctctttacccgcccgcccccctaccaaaaaaaaaaaaatgagtacagtagaactcaccccattgagttatttagatatgacacaagaaaaagaagggaactaaaattgcctgagattgtaccttcactaactcaaagaatcaaagctcaaaatagaaaccaaggtgagttatagaaaaatagaaaagttacatttcttgtacatcagagattgtgggctgagatttataatttgacatgacaaatagcaatgaaaggaaatactacctactcctttcatttgttgaacaaaatttgttagaaaatttcagctctcctccaggactaatgaatgtagtagagtggggaattgaatgaagaattcttggcacagctttaggcttttcagatgtagaactcagtaatagaaattatgtatagaatactatatatttattaatcaatcttcctctgtctgactgtaacctcctgaaggagagagactgtgtttcccagagtgcccggtactgggctctaagcacggttggccctcaataaatattgtcagccaccttatggattgaggccacggtagaaaagaataaaaaaagaggaaacagtaaggcaacacatgaggagagtgctaattctaaaatgcaccaacttacttccttttcccacttcctaccacaatccctatgtttttctattaaaaaacttacttgcctgacaacattgtaaagcttattgaagagaactagtaatctttcccttgagttactaaagagcagaaaatatcagttcaagcagtgtgggatacaaccttcaaacatagcaaggtagacgaggttggctttataaataggggactcattctcattttcattactgaagctgtacttagcaccaccacttagtactgtttataaactctttgatatagcaaatagtgatctaaagtcccttggtgggttgccacatgaagagaacaaagaaactcctttagtggtctgagccctgtgtactattatcactttatcaaagatgcaggttctctttttgatccttgaagtgacgggtttaaaaaaaaaaaatgacccattagcactaatgggtcctgcaggtgagtccctgtgcatgtgaaggaggatatacttaatggctctgtgtatgaacaagagcctgcatgggcaaccagtaaaagccaactttcctgtagatatgaagctagcctgttacctcttcttcaaaatgagtggctgatttttaattcatatgttttaaggaccatgtaggcaattgataaggcaaaggttgaattgggacactttcagcaaaagaagtagagaacatgtacaataccaaaaactcaaaagtctaaggggtgagtttcttaaaataatctcaataatacccttatttttagtactgtatatacacagccactatgttcctctcaagagtgttatctgtgaatgaactggggtgatatcatgagtatccattccgcagtaattgagcagtaatgactagggaatagggcacaggcattttggttttctctgtctacaaaccctggctctgccacctactggctgtctcagtgtaggcaagttaggttacataacttctttaagagtcagattcttcatctatgaaatggggttgataatgcctaccttgcaaggccataaggattacaaagtatgcacataaagcatctagtatacagcatggacttagcccgtcattgatactggtatggctgtcagtatatctgtaaggatgacacatctatgatgtacctcaatctatgctgattccactgagaaatgcagaagaaggagaagtatagtttatctcctgtttctagcacaactggagtgacaacatgtcaattttataaattctccatgatattttttctattggatttagttgacagtcatttgtgtgctgaagtgtgccttacactattctaaaagtagctcacagagctcctttgacttaatttgaaattcggtggcattgaatctggtaatataaataggaaagttgcttgacaaatatcttctaatttgacacaaagcgattaagaggacaaaaaaactctatgaagcccaagggccaggttgtcagttccagactaaacatgccttagaaaatcagagaaataacaggtttttgtggactgtggttgcaaagtgggggagcatacaaaagttgagacaagaagaaagtatgggagacattactattgtaatgatataaatgtggatgccagacacagggaacagcacaattgtaccatggagacaaaatttatatggcatttaggaaagagaataaaaggcttgactggaagagaggagttttcagttatttattaagttatgtaaataatattgtataagtaaagtcaaaggaaaggccaccatagaacttatgactgctggctgaaaaaaataaataattaaagataatgagaaatccaaggatcaaagcaaagcaggctaggaaactagggaatttgaagcagtaataatccggaggagaaataaaattgcatttaacgtcatgtatgtggaatttgagtaggaacatcctagaggaatccagtgatatgaacctgggccttagggaacggaggttggagcttagaggccttccttgggagccaccaaccaaaagcagacaaatgacgcggtagagatttcctcttcacttaaaataggaagcataaggcaattagagtaaagaccaagctctgccttacagtagcagaatgcaagtgtcaaggtataattagttctttgactcagctttcctgtttattcacatgtacttttttgaacctcttaaatatctcactttcattttaatttttttaaaaagcatacagaaaaaggacaattgccttatagatttgaatagctaaaactccaggaaatatgaaggaagctctcacaaacttttataaatggcatttggggaaaaagaaaaagtgaagtcacacaaattagcttactttcctatagctggactagagaaagtgcaattctagacacttcattttaagaagattggaccttggagagaaaatttgggtgcagctttttctcctaattcttattgtgattggatggtaaaagtagtgcaatcaagcttgggtagtttctgagcacattctatgggaagggtgcctttcggggaacaatcaacctctgtccccaaatttgtaccattatctttaattttaatattgtattgcacacacataaaggaatatctgtaggtcagaccttatctagatacactgagagagcttgtctttaggtgacaaatccaaacctctaaaacaggtgttccctgttagataaaagaaaatgacctataatatctgataaacaaacatttgtttgctttcttagtagaaagcctaagtgtgactgcttaaataaataatattaaactactaaaagaaaaagcatgggaagtgaatactgctctaatctatttgagcttacaagtaaacaaatataaacttctataagaaaccacacagaaatgaacaatgaaaactatacaagatcatttctaagttcaaggcttgtaaaatattcaaaatggaaatcaaatgggcaattcaagcagacattttgctctgagacacaagatctgtgtctgtaataaatctccattttttaaaagattaattttagaaactctccgctgaagagatgttaagtggtcaccagcttgatttattgttttttaacttctatacatcttagtctcccttggtacataaaaggtttagccttacaacaatctatttttgcttctgtaggaaataaccataaattattatctttaggcgtgtcctgaatttctaggtccagcctaaaatcaaaccttcatcatctcccttgctgtgaaattactttttctaaactttcatgttgtgtaacagccacatatctagtctacctgctctccagattggaaattcagtatcatttttaactttattttatatctcacaccttacaatcaactactgccaaggggtgaatgactcaactttgccaatatttctgacatttgttgtttcgttttcattcccatttccagttcttatctatttttcttcttgtacacaccttttaagtactaacctgttacctggtgtcactgtctccattcagcctcctcatcaacactgtctcagtcactccactgtgttctgatatcttcaatacctttctgtatcatctaaattaagtctaaggctcagcagtgatcaagattttgaattacttctcttcaaaaacttttgctaaactttgaactatctttcaaaaataacttttgccaggtagaagattgaaataatatctatcttcgccccacagtccgacctttagtcaaactttgttggcagcctttccccaactctgcattttcccactgctccatccttgcttgtggtatacaatacttccagcatgaatgcctttcctcttctgatgttgttcttcaaaatcctactcaacttgggggactcaactcaaactccaccttggaaatgtgtacctgtttccttagccacagataaatatcttggaatcctcataaaaaattgaaccccttttctgaaaatgattttatctttttcagttctttgtatgtgtaagccttatgtaaccattagtttatacattatttgaaggaataatcctaaacacgtttatattctcattttcacttagtaagcatttgataattagttgttgactcactgaatgaatggatgaattagtagttcacattcaataaataatcattgaaacaataaggacacagggaaggttttatgtcagcactcatatttgtccctggctctttttacctgagcaataatgaattaagttaattgtggaaaatttttcatctactaatccatttctttttcttttttttttttttttttttttttgagatggagtcttgctccgttgcccaggctggagtgcagtggcacaatcttggctcactgcaacctccgcctcctgggttcaagcaattctcctgcctcagcctccagagtagctgggattacaggtctatgccattacacccggctaacttctgtatttttagtagagattgggtttcaccgcgttggccaggctagtctcaaactcctgacctcagatatccgcccgccttggcctcccaaagtgctgggattacaggcgtaagccaccatgcccggcctgatccctttcttaaacacaaaggtgaagccatccagctcattaagaaaatttagggaattcaatggcatattttttcccactctgatagtgtaacttgatagagtaatacatgaccagttttaactgacacatactgaatttatttgtagaaagagatacagagatgaagatagaggtgtagaaacagtttggagtatcagtgtgcgtagtaatgagaacccatgcatgaatcgtcttctccaattaaaatatgtacaaaaatctttggaggaaattaaatttgagcctatcctggccttctgtttcattctggctctatgctgctccatatacaaagatgacctgattcatgcatcctccataggcatatggacaccatgagcacttcacactgtctctccagactcatctgctctgttattatcacaaagaaagacatgcatttatttgctgtgtgtgtctgtagaacacagagaagctaactgtgtggacccttagtgctctgctctagtgagtttgttaatcctcatctgcacttccttttggtttgcagatgtttcactccttctagcctttgggccaccactcaaagactcctaaggttagagtccttctagtttgtagcttctatttcttggctccttgtcagccacaggtgttcctgatgctacagcaggcttacacatctaacagtatattgctttagctaaaatgactttgagtttcacaaaaatcaccgagacaactgaactgaaatgtacagagtcctgagtgagagaggtcttccttactgctttgaatctttggtaatcagtgtcaggcattactatggtcaaaaccagaaaaaacagctctgacttcatcattataataataactgacatgagttaagtatccttaacttgaccaagcatttgcacatatattgttatatctggtttttgcctgttgagctacaagaggagtaaaggttatcagggatacatgttacagatgaagaaactatggtttagggctacaataccagaacagggcagggtcttattgcaagcccaggtcttctgaaactatgttaattgtccgttaatccagactgacacgcacatgtacaccctgtacactctaagtggcaagtggccaatatgtacagcttcactactacaacatacaggaaattttggagagttgtggctagttgataaaagtaatggtaataaatggtagcaaaaatccaagcaagctaacaaattcctgagacaactggtacaataagagactcatctgcataataatggagtaatctcataaaggcaaagtcaattttcttccataattataaatattaggtattcaaattctgatacataagtagaattcttatgttcaaaactttttaaatcaaattttatcaaaatgttttttaccaaaagtcaacatttgatttttagatacagcagttacttttcaattgtctcccacaaagagataaatcagacacttgtatgtatccatggcccaatctagtacaaaccagcacttacgtgggacaagttggggaggggcaaccccaagaagataagagtttagaccttaacgttttcctgtagtgagttttggggagttaatattgttattatccatatcaacagaacatataattctttcaatattctgaacttttgtttctttttttttttttttttttttttgagacggagtctcgctctgtcgcccaggctggagtgcagtggcgggatctcggctcactgcaagctccgcctcccgggttcacgctattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggccgaacttttgtttcttatttaaattttgaaacaaaactgcccccaaaaagatttttttaaagtatgattctgaaacttacaacaggaagacagattttgtttgtatgtttggccaacagactgtgaggaaacctggtgggcatgctaaatgggaaataataaagtgaaattgctatgggagcgtgtagagtaatccatcttcttttaaacccactctatgccagtaacagtgtggcagatggggtgcgagttcagggatataaatccatgccaagctaacttcatctaatggctttaaatttttaaatttacctttaggtaaaaattgggtacaaacagtttcagttttttccttttgtctcatccaaatgacagccagtttaaatacctgtgacattccttacagcagacaattctgtcaccattccatgtttcattttttttacttactgtgtaatgctctctgggactgcatatggatttgcaggggttttcaacctcacatatactgctgtaccttacacatgcataaacagtgcagtttgaaaggtgcttttttcagaagcttttgaaccagagtgactccatcttgaataggggctgggtaaaataagactgagacctactgggctgggctgcattcccgaaaggttagatgttcttagtaacatatgagataggaggtccacataagatacaggtcacaaagaccttgctgataaaacagaatgcaataaagaatctggccaacaggcgcggtggctcaggcctataatcccagcactttgggaggctgtggcgggaagaaaccccaactctactaaaaatacaaaaattagctgtgcgtggtggcatgcgtctgtagtcccagctatttgggaggctgaggcaggagaatcgcttgaacccgggaggcagtggttgcagtgagccaagatcgcgcccatgcactccagcctgggcgacagggagagactccgtgtcaaaaaaaaaaaaaaaaaaaaaaaggaatctggccaccaaaaccaagatggcaatgaaagtcacctctggtcatgctcactgctcactatatgctaattataatttattagcttgctaaaagacactcccaccagtgccatgacagtttacaaatgccatgtcaacgtcaggatcagaaagttaccctatatggcttaaaaaggggaggaaccctcagttctgggaatttcccactcattttctggaaaactcatgaataatccaccccttgtttagcatataataaagaaaaaactataagtatactcagttcagcagtccatgacgctgttctgcctataaagtaggcatttgtttgtttctttacttctctaataaacttgccttcactttactctatggacttgccccaagttctttcttgcacaaggttcaagaaccctctcttgggttccggttcagggcccctttctcgtaacactttcacatctcttactccatttgatccttgttgcaacccttcacaataggtagggtggttattattatccctacctgacagatgaacaaactacccttctgaaaagtttagttacctgcccagggtaatacaagcaatacaagaataataatgccagcacttcagcgtttgactcccaggctaattcttttctgatgcaccacactctctcctatttttactaaaacccttctcaatgacaggagtagaatagatagaggagtttagaaatgactgttctggaaattaaaagagactgataaatagggaacaagtagcagaacttatgtaaagctgttattttttcccgaatagtgtatagaacaattagactttctttcccaaaataacttttcttatttgaaagacaggtttttttcttatttcaaaacaaacgaacatttattttgggtggggaagacccagtggtataaagggcaaatataaaagaacagctctttcctataatacgtctctttaatgtaggtgaaaaattggcaccggctctcaacttagatataaacaggataaaaaaggttatagccaccagtggttttctgtgtagcttgaaaggacaaagtagtataaagcacacacaaaaaaacttacagacattgccaaagagctttcaaaatattatgagcttcctggagtcaaatcacactcttgtttttccttaagtatctgaacatttctgtatttttttttccaaaaaagaattccttctgtgctcgaaagatggaatattattaataccaataaggtcatcacatccagttgctatagtgtaatttcctagtgcatgtctccaaacactttgttcttccaacataagctattcttaaggagaaatggagatacttaaaagcagggatccctcctccaggtcagggaagtgttaggaacttttcctaaaggctaaggaaattaagggctttgagagctgaatgagcctgcaagtagccagtttgcaccagccgatgactgattgataggccaacccccaatcacccaaccaagtactagattttccagagcctattctacatacctataaatgcaaatgttctgcagaatatatataaaggacacacagcaattaaagttgttagctgtattgtttgaggagaacttcaggggctaagaagacagaaccaatatatagatgctatgcaaggcattggggagagaagagcatatagaaagtaaagtggaaatatccagttcctttgcaactaccagaagtggaattttcaatgttatacaatgtagtagaaaagtagaagcttgattaagattttttatggaatagaaagtgttttattttatgatatttccccccaagattaaaataaatgttagcttttcactgtagacattcagaagtaatcctttcaaatattttggcaaatacagatggcagtatttaaatactgccgtagacctgggttcaaattctgtttctattgctttgtgctacgtgacaaatgaataactcacttaagccttccaagtctccattatctcatctgtaaaatgggggcactaataattcactgatctaattgttgtgaggattcagagaccgtatgtgtaaaataaatactaaaattgaatttctgactgaagtgccaacacagtcaatatcagacaatgtgagaatgagacagacatccagattcaaaatttatcaaggaacaggtgaaatactggttctaaggcccttgaacccctcagctacattaaggaaataataaaaataaaatggatcagaaatgggaaggaaaggtgtctgagaatattttttgaagtagctcgtactatgcagtgagtttgtgctcctacattctagctccaagcctagcaaggcagctctcagaggagggtctcctggagtgcttgctttgcgttcccgaccactggaggatgcagaactggcacccgacacgctgagaaaactttaaagaggtcaagatggaatggaacggaaatgagagcattgggaatggggtacacttccaaggttgaggggacaaaggatccatggaaactcctcgtgggccgagataggccccaagtgcatgacagcaagctgggcaggactgcctagagacaggtcagcccatgtggtaagagtctgtgaggagggagcagaagcatccccctacacagggattaaggttggaagttctagcagaaaagccttggatgaacccaagaatgcaccaggagaggaggaattcgagggatctgccagaccaagagtcccaacatcagttgatgtgccttgtcaaaaagctgtcgaaagataattgcaggaaaaggcagtagccgaacttgccctttgccctactgccagtgactgaccaaagcagagggcagcctcaattctgagctttgattagtaactcagattggtggtttgtaattttaatgaatgttatgttttataatataaaattattatataattaccttaacagtgaacccaaacatttactctaaatcagtacgtggtacaaaaccttaacacaatacattttaaagtgatcggttgcggtaaaaccaaaaaatgatattatagcttgaccacattaggacatcatacttatttaatgtaatgctttcacacataagcccttaacatgatgcatgacatataggcatgcataaatgacataattgataataacgaggatgatggtgacaataacgaaggtaatttattatatctttgaacagagaatacagacagacccaagccataagatagtttttctcacgaaaacactcagttttctacaataccactctattgatgtgcatgattcacacatgtcgcagccaaaagacatttaatgtcattttggatatcattttgggaaactgagttcattgggtttcacaaaaaatatcgggaactacacatgttaaatttttaactgtcaaagggctgttgtgttagagaaagaatggtacactagtacaggcccttatagtgtttgaattctttttacagtcccagaactctaaggggaagccagtggtgagaggcctaaggagtctgtgtattgtgggtaggggagtgtgagtggggcatgaggaggggagagggaggagagaacttcccacagacaggttaggaatattgataactaacatcatactagtcaacctctaataaacttgagatggcaaatgggctctgcttgtactagggtagttatgggaaattggcctaaatattgccaacacctgtcagatccaaatgagccttatgagccctcctagtcctttttatgaacccttgagcatcaaagaatacactggcaaaccttgtgtattgttctgggaattaattgagatgagataccatgtgcaaatctttataacagtacatgagatacgacgaacccttagaaatggttacaataatttctatttagtattactatcattattgttctggtgagatgcttaacctccccaagcctcatgttagtttcatcacctgttacatggtgataagaacagcaacttcatcagtttgtcacaaaaattaaagagaaaatatatgtagctgtcttacctaatgcctagtaaaggtagatgaggatgatggtgatgatgatggtgatagtgatataccctgcctaaggaaatacacaaaagaaatggcagagatgctatttcacccaggtctttctgacgtcaaagactgtattattaattataatgctatatgcttcttgtattgtccttacgaacaaccaaaataattaattgcaaaggccaaaaaggggccacttttaagaatggacacagaaaaccacattcatgtgatgtcaatgggggacgctgattgacctaatgtggttcctaaggagcactggaagtaccctctagtgcatgaaaataaagagccacaacagtgctatgtcattaaaaatgcactttcctgtgtggataaagatggcagatttagcttttgagcatttctaccgtgggagcagcaactttgttttaagcccacccaactttcaagtctatttccatgttgacccatggctcaagaggaattgtacagtacccgggatggaagctggctttcttctggcggggactgtgttattactgaaatccaactagatgagacaattgcctgaaaatgatagtgacattcccttttgggaatatagtaaacaactgtaacattgcccagatgtcagcctgggcccctttgtccattacagatctagatgagtctggttaggaccctcgcatctgcacagaaggtaaaaatctaaggtcctccttcttctggcatttcctgtgaattcctgggaacctctgactattgcttggctttgctacctcatgtactccctatgtataaacaaagtctctgtctccacccaaaaacaaatgctgctcactcaagcacttatgagtttcatcatctaaacatttgggtatcacctagcacctagtattctatcaccttgaagaatttaggccctatcctcaccccctactccagagcaaggcaaaccctgtccctgaattcttgcatagcaggttaaaaatcacactttttgagcctttgatatcttcatttataacccaagtagcctatccccatatttctttaaacaaatccagtaaactcatatttgtataatgtgactctgtctcttattccctcaacctggcacagggaggacatctgtcttgatcaaatgtactcttccaagaatttggcactagaactgctaaacttaaacgagtctttcttgggtgtttgagttgatcaggggtgaaaagccaggtctgagaaggccaagtttaccaatgcttgtgaaagcagagaaaactagtgtgcagagcaggagaggaacaagggaatgatccttgggcagcttttgggaggcagctcacagccccagtagagaccaagtgaggctgcaacactggcttattgctaagagctttcctgagtacgccttttatggagcccagcattgatctttctctgttcttgtccgtgggttcctgtaatgctacatcctgtctccctgtccctttccacatcacttgtcagtctgaatggttttatgctactgtactccaaagacttctgtataagtctcccttcagcaaaaggagggaggtctgagagctaggaaaaccctgaagatttaaatcttacttgaatgagagagatattgtcagatatctgccttctcagatggctgacaaagacagctcttgaacaagaagctcgaattctaagaagacaacgcatcaccactcctggcattccctaaagagggacctgcaccaaaggctcatctctggatgacgatgaggtcttgtgagcagtcacctgacctttgagaactcagctctgagcacctgcaggtacttgctgctccaaggcacaaatgtcaccaccttgaagagctcaagccatctaatcaccatcctgctgggacgtggtaaactgtcagcttatcatgaaaggcatctgggcataggattgaactttccagtagcccacacttggcgtggaaaagctgaagaaagctatttctccctgtgcacaacctccttgtggctgttccaagcatggaagccaaggcctgtggctgtcagagttcagctagtgtgctgggtgagaagaaaccagccccagggctttatgcatctgcaaatgggatgggttgggatctttaaagtttcaccaaaagcagagtcaataggtggcactctcgctaccaatctccatcttgggcctgtgactgaacacaccaataatcttcaccaatgaatccacacaaaggtgcagatttcttttcagtgtgttgctgcaggttgtcactagcagtcaattgagattgatatgagcaacgcaacttctatcttctgagctatggtaaagaaatgtgaaactgggatagctgtgcaggtcaacctcccctgagcagatttctctcatctgtaaaaggaattggtcacaccagacaatccccaagatcacttatacttcctaagttcacgtgattctaatggtgggaagagagatttcaaataatatagttggagggagttgataaaactaaatatagacaacccatggttaatgtcagaaaaattcagaaacaagtaaaatgggtgaaggaatttttaaaaaatgcttttagtagagaataaagaatttacactctgctgaaatactgtgagctgggccaagaaccacagggaagcagagggaagaactcccaaaccaaatgttggatagcaggtcccagataactgcatgggaagggaatgttttaatcccactctcaacttcccgcctccttaaggtaggattaaaacacactgacaaaggctttacagtacggagaacagattgagacaaattctgcaaaacccggggattcaatggatgtggcagaagagaaacagtttcacatctctgtctgtctttcaagtaactgctctaaaattcttgtgtaaggaaaggagtaacaatatatcaagtcttatttctacatactcagaaacttattgtctttgttctgtaccatggcaattgcctcaaaagtggtgtcttttccctgaacctcggctcatccatcccattgaagccaaaggaataattctaatgagcattgtgaactctcctctgcttctcaaaaccctttaatttcacctttcccatcttctggcatggcgttcagggcccttcaaaatgagaaaattaccctgctcttttgtcaggggttacagacggccttccaacccatagtctccttctcttccctttcaagttcaaaaagctacctctgtgtaattgtgtaattggactaaagaagtgagcctagccagtagcagcaggggaaaagcttatgaagttatagcctagacccaggtccacacactgtattaaaccctgtactggggggaattggaaagtgagatgaagcagtgaatggacagaagtggaaacatacacaggaataaaagccataggtgtaagccacgagacagaagaagccaagattggaagaagccagcaggcagagaggagccatctcacagcagtgccagcagacagaatagagcgagggtggctgcactgctgtcacggtggggcaatggattagggagcagtgaacatgtgtatccgagggaaaaaccaagaggatggctcttgagatcccagtatgactccaagaacaaagttcttatactctgtgaggcctcattgctcaacagctgaaagggtttcttgtctgtcttacttcctactggatccttaaaataatctacaaatggaaatagtgttaataaatctctttcccttatatagactaaaaaaaaaagtaacctcaaacagcaacaacaagaaactaataaagatggcctaaccacaggacagcaggaccttccctccacttccggtgccatatcctgctctaacgttaagctcaacatcactcttccctgaatattttctatttaaacaaagtatctgggcaagacaagtgggctgtcagatgtcctgtgggctgaatgtacaaagcctgggcatgtttaaatgtgattatgactttgaatagaatctggtttactgaatgacagcagtaaagatttgtcaagtagcaacatgaaaaggtataaaatggaggggatatgtgttatattcaggattggagagggcagggagctgagtaatagcaactggtcagagatcaagaagaaaagagcaagaatactatttatcttcaaactttgcttagaggttgagtatatttgaaaagaaagtccctgttgagttgtttctgattagggacatttaagtggcttcgtagcaggatgaacaatagcaggcagttgccttcagggtgagatttaaggaggaatactaggaaggttgaggaggagataaatgggtgatgatcctggtaagaaggaaaaggggcaagatcagaagacaatgaagacaatgccagagctcaaaatccttgaaggagttttgggtttgagagggagaacagaggaggaagaaaggacaaagtactgcctgggctgacctagatgtggcccataaataaatcactgtactcagttttatgtagttttgctaggtggccacctgagggcactctatgctacacagctaggaatctttaattttccccctatcaagtaaactatatatatcctcaatttgctgaaggataaacttagctaatgctttaaagaagggtactcattgaaggtgggggccaaaagcaattcttcctccctattttttccctcaactagattaataaatgagcaagactgacctcaatttaaatccctgggtaattgcaaggattaaatacagtaacttcagttaaatctatttagcatttagtaggcacttaataaatattagctccctcccatatatatgcacatcctaacatacaaatttgccaaatacaggaacaagagaaggaacacaaggaggaatcgcaccaaccatttatctctctaaagaaggcagggctcagaagtcctaaaatgaatacaaagctaggctaggaaatcattccagagagcaaatttctgctgctcctttcattgcatgttgctgcttgtacataataaccagagggaatagaacacaaacagctgggaaataaagatgaaagcaaaactgtatcagcaggaagagacacacaaccccctgagaatcgagcggtgtcatgagagataagctgaacaaggccagctgcatggaatttatcttctgagagaaagatcattagattcctacccatttctgatcgtttctattggagtcaaggtggagaatgaaatacatgagccccagttttcaaagttctacactaaagtcctgttcctataatgaaacagagccacggacaaaagaatgcatcactataaaagccaactgtggaattttagatgtctgaaaacaaaagaaattctacttccccttgcaaacggagcaggttgaggtttccccaactcccgggtcctatgcagcatgttttgtggccttctgctgccctctagtgtctttttaaggtatggtaaaacataaggaggataaaaaaaattctcctaataatcctaaccagccaacaatgtgacttcagcccagggctggtaaaacaaacaaaaaaacagtaacattctgaaataaaagcaaaaccaggatttatacaaaaatttaaaagtgagttaaatttggcctcaacatagatcttgcattatttcaggactctgaaataatggcatctctatcagtcaatgcactttaaaaagaaagatgcctgttttctgtgcatctctctcaaatgattactgccttggttggtctgagataggatccagaaatatgaacttcgcaaacaccacaacatgattctcaagtagctaaagttggctgaccttcttttgagaagcaccaaagatggctgcaatgactctcagcaggatggagagtaaatctgatgttttctttaattctttaagaatacaatctattgaccaaaacaggtcaactttcatttttcctgcagctcagtgctacatgattagtatgcaaagaaaatactgctgtccatgtctgagcgaagagttcatgtagaagttctcctttatgaataagtccctctaaattccagcaggcatccaggtggaaaaaagaaaaaaatgcctcgttgctcttgctcacccttcaaatatccctcaaacattactgctgcaaaaaagccttccaggtggtcccagcttggtttcaatgccccactacagctccacagcacctaaaagtgctgtccttctctgtcctataagtgctccctcaacgccagtgttctcatagagacggagagctttgcattgcagaaaccctgttgtcctctttccaaagtcaatgctccataaatactcatgctctggccaatgcccacagccacccttacccaaagtggtgatgatgggagacaagacacatcaggccccacagcaggctgttctcaaactccctctagctgatggtgcacatgataagaggcaccgtgggatgactgttgccatcggatcacatacccaatttgttagctcaaacttggactaattttagaaacttgctcttacttttctgcaatgcagaaggtattattctatactaatgattagccccttcacatgggaaattcacaaacaattttaattgtgctttttaaaaaaacacaagtacactgagagttcattactatatatcttaatactatgtaatatgccatttttaagttcatacttacagtgttttttctttattatgggcaaagcctgttttatcttcagagttatccatcacttaatgctttaataaaaataaactctgaagtacttaggtgtgtaagtacccccaccagaaagaatcctagtctacaatctcctattaccttcacttccatttgttaatgaaaaataagcagatatttacttctcaggagacagtgtcctaactatctgaagaaatacaatccattgtctcacacggcttctctggaccctcaatgtgtagggctgtacatgccacatacttcaaccaattataaactgctttttttttagccattttaatttccaacagagtatccctaatttccagtgaagttcacttatacttactgacgtctcacctacacaaacagggcactttttgctttagctttggtgactcgatcagcacactggattttacaatctctccctttcttttgacaattaccacctgagcccactgtgcaaaacagggggccatgaaaaatacagaagaaaaagctcttcaatcagagggaataaagagaaagaggtttggcctgtaagaagcagttctttgaatttcattttattttttgagccaagctattagatttgtgggtacaaataagatctctttgaagttagcaagaagcccactgtgaaagaagggagacggccattaccacacattttatatgttgagcaaataaagtcccaggattcaaaatatattctgcaattacagaaagcaaaacacttttctttctcctttcaccttgtttagaaagagcatttttctctagaaagagttctgttgaggctgggtgcagtggctcacacctgtaatcctagcattttgggaggctgaggcaggcggatcacctgaggtcaggagttcaagagcagcctgaccaacacggcaaaaacctgtctctactaaaacacaaaattagccgggcgtggtggcgggtgcctgtaatcccagctacttgggaggctgaggcaggagaattgcttgaacctaagaggcagagactgaagtgagccgagatcgtgccactgcactccagcctgggtgacggagcaagactctgtctccaaaaaaaaaaaaaaaaagagagttaaattttctctttccagtttcctaactcccctcctccgattttctacattgagaataacaggctaataatactttctggaatgcctgttgtagtgttaaattagatgggatacacacatatattcttagtgaatcacaaaatgtgattcaaatagaaacttcagtcatttctcttctattattgacatgttttctcagcattttgtcacgtgcatttgagaaatgaagtatcaataaggaagagaagcgtatgttaagactttcttagcagctggtgaaagaagcattccgtgtgtgtgtgtgtgtgtgtgtgtgtgtgtgtgtggtgtgtgtgtgtgtgtgtgtgtgtgtgtgtgtgtgtgtgttgggatgggggatagaattcactgttggagacacagggtttctaagccaggctcaaactcctgttggtcagggacttaggatccaggaaaccttaccaaggaaagaaaactaataagctctataataagctcctatatatctggttccctgactccaaatcaattgaaaactgttgggacttaagtaacttacaaatgcctttttaatatcaagaccaatattatatttttctcactttttacattttaatcatgcatgcttccttaggtgctgcattttttgagctgttattaaaaatacataggttcctaccacattaaaggggagcagaggcttgtgtgttgtattgttaattatgtgctgaaaatgaaattctggtcagtctttgcagaaggtacaaacacacccctaagcaaaggattttccatgtgaagggagaccgtgtggtgcaaggctcgttgctctgacttaacatgcacttactcttgaggtctaagttcctggctccggcggtgatttgcgttgtgatttttgtgtcaatctttacagtgtggaggttgctggtgtcccttgatatcatcacgttgtgccactgattgtcattgagaggtttatttgagcttcctttgatgaggttagcaccatttcccaaatcaaacacgtaatgtaagtacctgggaaaaaaatgaaagaggggaaagtgccatcactttttaaattttgatgaacctaaagtagatattacaaatggagattttttttcaggtggttccatccttactagaagtcatgacaataagttacatagaaactcagctatcaagaaggtaacaaacactattctgtttcagcaaagaggattattcagtgttttaactaaaggaaacagtgaaaattatttttaaaatcatggtctacatttaactttatgaatttggaaagcaatatctttcaccacgcgctccctgtttccacaattccctccatccttttctaacacttaaaatggccattcttctcgttcttgcacttgcttttctcctctatctcgattccctgtttgaggatagggaacgtgtactcatccttcaacatccaggtcagatagccactccctgctccacatgtttttctaatttacctgaagagtctcctgagcctttgaatgtgatcacctcaagaaacatgtcacagtgcttttcttttcttttctgtttatgtgttcatctacaaaccctaggattgtatgttggtgtgtgtgggtatgactcacagtggtagaaatctgagatgtgcatacgggtggcagaagtatatatatttatatccgtgcatggcacctgatgtagcatattgtaaatatacaccaatatttgcagaatgagtgaataaatgctgaaatcaattaaaatacattaaattttcctcacagttttaaggcacgtttacacaaatcttcctttctaaattctctaaggcactctgacatagaatgaagtttgagttaaaagggtttttttgaaatttaaacaatctgagtacttgaattagctatttaatttagcatagactatcctacaaacctgtatcaatgcttttgtggaattacattgtgcatagtcaggaaatgcccatttgaattgtaacattcatgaaatgcctaccataaattagagcccaatgtaatttgtatctcatatgtgaaaatgtaggtgcaaaaaactgtcctaaatccatattaatttaagatacctaagagatgatttaaacaaatgccttcttatttgtcctccacctgctccggcccaccaccttatgagccagtatgttcttcttagtgtatatttttggaaattgacgtccatttttccaaagttttatttatttgctattgaacaggcatgtactcaccctttaactaattcaaccacaataaagtcatttccatccccactgttatatagaattaatccatctagggatgttgtcttgaactggaaaaaaagatgcatagaagtgtaggcttgcaaggtagctaaggcaacatagctcgatttggtcttgaaggtgacaggatctgctatgatgttcctgaagccaaatctggcattaagctcacagtaatctatgtcgccatttttacacaggtcaatgtatgccattccattaaatgtcaagctctgcaggtgtccaatgaagttggaggggacagaagaaagataccgtcgttctgtgatgatgccagtctctatgttatggaactccagcctagtatgatcacctgccatttgacctaaaagagaagataatatatgattattttctgtatctgaaaggcactttcaactttaggctttcataacaatatcacattctaaaatacaaggagccaaatccctccttggtactcagttgcatataggaagaacacttaaatgatgccaaaaggtaagcctagattatataataaaacattcttaggccaggttataatccctgtccaaattttagtcttaacaaaaaatatcctcattaacaaaagtaatggtatcttttaaaggcgaaaaataaacaaattagcaagagagtgagcacatagtaaaagaaggagagggaggaaaaaaggaaagaagggagagtgcacagagagacgcattaggagcagtgactattctcagtcacccaactagaaagtgatacatctcagcctcatggataggtgatgttattccttataaatgttcttccaggaaaaaaaaatgtgactatatattttcctatacccagtagaaagagtggagagttgcagccctttcttccagtaatgaaacatgaaagtgtgtttgaagttaaatatacactattcactttccctcttcgtgctcaataatgaccatagtttttgttcatgctagtcttctaaatacattagaaatcctgttgatttcttcacctatgcctttttttgtccttaagttttctataactaaatcaagcaaaatacactaattgaaagcttgcccaattttgataataccagtaaaattggcccaccatgccccataccacaaggcaaaaatcttctttaaacatcctagggtgaagcttggatgcaaatttatttagcaactgactattccactcagtcctcatttctctctatccctgcatatttccctgtcaaacccattaatagcaaacttagtcccatctttatctccagagtgatcattttacctgtttgcaaggttgaaggtaagataaataagcaaagatgtgaacttgttttctaaatattaaaacacaacataaatataaggtacttgtatcagtaccagtgattcacacccaacatcttgctcttgtctaaataaactgtcagtcactctcttctgcaactaaaaatgctcatttattttgtaatcaagttcttccacgtgctagcttccctgcccgatttgccataattggaaaatgtttcaagttacctctttccatcatccacattattaatgaaaatattaattagagctaatcccagaatcagcccctgagaaaatgcattgaaccttttccccaggggtaatgaagactgaacaaccacctatgtgtgtcccctttggccagtttgacaaatttccatttctttagtcaagacagtaaaatattagacagtgtttaaggaaatatctgtaagtaaaatttagacgtcatgctttttgttgtgcaacaaaaactgtttatatgtttgcttaagtgactttgatgattatacatatatttgtacacaaaactcccctgaactgtacttaaccctatttcattttcaaacactcttttttagtcttgatcctggaaacaacattctactcatccttggcatgttctcttttcagccattggtttgttctgattcccttcctgcaaacatttttaaaacaaaaatgtcaccataaataattgtttcgtctctctctaccctcactaccatgcctcctgattgtctatctgatgcaaaagtactattacatccttgtcaattctggtttctcctgtgacatcatttctatcttctcccccagttcttcttgttcaatgacctcaatattgttctgtggggatctacttctttggtaaaaaataaaattaatccttaattatttccaaatataaagctctaaagacaccagcaacattgaattaagaagctaagtacaatgaagaatatgagaagcttaaaaatcgtctagatgcggtggctcacgcctgtaatcccagcattttgggaggcctaggggggcagatcacctgaggtcaggagtttgagaccagcctggccaacatggtgaaactctgtctctactaaaaatacaaaaattaactgggcgtggtggtgggcgcctgtaatcccagctactcgggaggctgaggcaggagaatcgcttgaacctgggaggcggaggttgcagtgagctgagattgcaccattgccctccagcctgggcaacagagcaagactccatctcaaaaaaaaaaaaaaaaaaagtcatatgggctttgatatccctttgggttgatttttattctatgccacattaaaatatgagccttaactcagtgacccctaccctgatcctgaaactgtcatgtttcatcttaaagtctctattgatgaaacaaccaatagtaaaaaaattctgaaaaaaatatttctaacacttgaaattaaatattacctccagttgtcaagttcttaccagctctaaaagaggaaagaccagttaattccagactaaggagttcagtaataaaaataagacagtatatctgttttcctctctcaaaggaatagaatatgcacacagagcataaataataaaaaggtagtacaacagcattgaagcaactatggcccagttacaagataaaaaaaaaatataattacagtgatggtagatatatttgttcactggggagaattagcccccaaaagccattatttgatgactaagaaaatattaactgattgttgccttctttaaaaaattattttttctcagaattttactccaatgtttaatcctcatcagtaatacagccacttctactactgtagatatttgttgattaaataagaaaaaattataagacttcgaaggggaaagatttttaatgttctaatgatttaaaaatgcaccatccaaggaaaatttggaataagcaaaatgcctctgatcacaatatttaaggtataacagattgacaataatctccaacaagacaacaaccaaaacatgtttcctagatgctgtgtttgtatagaaatctcaatatttccaagtcaaatatttttaccaaaatagatagcaaggttaatatgtgctctgcgttaggttacatttctcatgtcgagcaaaataaccctcccttacatccacttgttaattcacttaaaattgctgattgtgtggtatatgtgtccggtgctagccttggtattggagaaatagtgttgagaggggcagaaagggcccattttctccaaactcatggtctacgggagaaaggcagacaaaagaggttaaggttgtaattaaatctataataacaaaactcagagaaatgttatgaatttgatgaacgaggtattgtgttggtaaatgtgaaatggaagaagatgccaggtttgatatttaagctagatttgaagaattaaaaagagaaagccctgttaagaattggagaaagggaatcaagggtggattccaggaaggggagacggatgaaggaaggcttttggataacaaacagctacagagcatggctggagagctgggaacaagtaggttagtgacccacatgggattgaaaggagcgggagcgccagggtccagatttctcatagtgcttcttacattcagagctaaggaggatttgaagcaggggttaaccatgactcgtgtatgtgtgtgtgtgtgagtgtgtgtgtgtgtgtgtgtgtgtgtttattccctttgtgggtgcaagagattggagagtgaactagggcagttatagtagaaatgaaaatcatcaacaaaaagataatttcacagatataatttccaggatttactaatgatgagcagaatgaaggaagggaatgatgatgcctggctttcaggcttgggtaactggatatatggtgaatgttgttccataaaggacatacacacacagattaaaaaaaaaaaacacaattctagatttttacacagactggatgatgaattgaagcccagtgacttcccacttagggattccacaaaatttgtacaaccccttgtcatctatgacctaggaaatctccttccttgggcttctctgctggcaaatactatcctcacgatcctaggtgaggtgcaaacattcccaagaacagcttgagtatgtactgccctgtgttcaacagataactgacttaatagaattacgataaaacttaaagatatgggaaaatgtaggactttgcatgaagagtctctagtaccttccttgcagaaattcttctcattcagtgatttctgacttgctgtaaaatttaataagaaactcccattgcttctctgatttatgggtggcttcaagtggccactaggatatttgaaggaaatctcaatctaaagctttcattgccacatttggaagccttttatgtactacgtaaatcaagactgaattattcttatgaattgttggctttcatgagatctctgacaaaatagaagaagaaggaaggaagaaaggaagaaagaaaggaaagaaggaaggaaggaaggaaggaaggagggaaaaaataaacaatttacccaaggtatttaaaaaataactcagcatttgatgttaagtcttaggaaggaagaaatgagacaaacagtcgtaaagtaatcctgacttatttgttgccttcaactaagaaggcagaactactataactgccctagttcactctacaatctcttgcacccacaaagggaataaatacacacacacacgcatacccacacacactcagacacacaaacacacacacacacgagtcatggttaacccctgcttcaaatcctccttagctctgaatataagaagtggtacgggaaaagcaattttgaaactattttagatgcattattggattaagcaaatcaataaatgacattactgggagccaggattctcatcttggatgaaaacatatgaaagtatggaatgggaaaaataacgaaacaatgttgtaggtatgaaggtagcagtgtaaactcacactttataaaatgtgcattatgtgtatgtttatatgtacatataatgtatatgtctgtgtgtagatacatttacatgtatgtttgggtgtaggtatatatacttgaatacatttcttatctctgtctgctgaaggggtcaagtagcaatgataccccagcagcactgaggtcacctaccacccaaatcttggtctgtatcattcctcactaaatggaaattaaatggctaattctaggggcgaagtgtggtagacaaaagttgtacctggaacatcctgttattccgagaagtaagaaaagggccaggcacggtggctcatgtctgtaatcccggtactttgggaggccaatatgggtggatcacctgaggtcaagaattcaagacaagcctggccaacatggtgaaacctcatctctactaaaactacaaaaattagctgggcatgatagcatgtgcctgtaatcccagctacttgggaagctgagacaggagaatcacttgaatgtaggaggcggaggctgcagtgagctgagatcactccactgcactctaacctgggtgacagaatgagactccatctcaaaaaaacaaaaaaaaaaagaaagaaagaaaaaaataagaaagcgctaaaaaaataattggaatgaaggcatgtcatgagatcatagaggccaagttaatgaaactcacactggcaaaaattgaaaaacatttgcgcaccaaaatcataagatagcgtaattatgaagtattataaaaacatagcaatagtgggtctacaacaataagaaaaaaaggaagggaggaagaaagaaaaaaagagaaatgaaaagaaagaaaaattaaaaaaaaaataggaaagaagggagagagaaggaagagcccttgcttacagcagaatgctaagcattgactgtaaatgtggaaggagtgctggagtttgaaaataatcattttttgtaactctcagagtaaagattgaatcaagcaaaactctgcaatagatactaaatctagggcaaaattttgatgagttacaggatatttacatggtcttaatgtctccccacagacagtttattagttgaaagggagaaaacgtagtaattatacaatggagaaactggacaacatgttgaccaagtggtcaaattaaatcaccaaagacatgggcagcgtatgccccagatgggatactgtatagaggccataacatcaacaacgcggtatttcacccaagaatgtaaaatatacattcagtcatgaggaaatatcagataagcacaaactggtgactttatattaatacaaagcaggaagagattatatacttcaacaatgttaatgtgatgaaaaacaaataaagtttatggaaatgttctagattaaaggaggctaaagaaacatgacaactaaaaaaaaaaaaaaaaaaaaatagctggccctagactgcgcactgtgctggaggggaaaaatgcttattgcgtattgataacattgaatcaactgacaaagctggaatatggattacagattagaaaaataaattgttatctatgcaaactttactgaagtcagtggcttttatttcttaggcaaggggatattcccatttttaaaaaatacatgctgaagtatttcgggttaaagggacactgtgtatgtaacttaccctcaactggctaagagaaaagttagagagagaagagacagtgagagagcacaaatgtcaagacaaactggcttaaatgttcacagtagtaaaggtataagggtattctttgtattatttttggaactttttataaatttgaaattattttgaaataactttctaaaatacatttcttaaaaaaaatgtttttcaccattcttttgttttcatcctgctacatccaccgcagtacaggacttattactttacaccctagaccatccaaaacactgccacagaattaatttcgctcaaaacatattttctccacttactcttcagtttaagtgcagtgacttccaatttcctgaaagtctacgaaatataaactacttcatctagaccatcaagtcattggcctcaaaaggccattctagcaccatgcacttgcaagaagcaaaataaagcttcttagttccctgaaaattattctagccccaccagcatcattctttcttgtctggaattctttcttgcattatcctttctttaaagcctagatcaaacattatcaattgctttaaacaatacccaaaaccaagttccttaacttctcttctgaactccaagactataaagtactcaagtcaaccattcagtagttcatctgttactctatgtaacatatcaccctctataataatctgtgttttatatgtatgtatgtatttgccttataatatcatgcattgtctgataaaatactttctatagagccatacacttactagatattgacaaatataaagcaagggacggtaagtcaaaaaccaacaaaccaaaacacacaaaacaaaaaaataaacgtaggttctctcctcagatctcgtaacacattccaataaaacataattcacttatcctcttcgagtgccacttacctcatctacaaaatgggaatatgtgtgtcctatctacttcataggactctaatattcaagaggcactcagagattttaaaatgttctgttgtagttctggcatgatcttgccgttggcagctgcctcttcccaaactcttacatgtgaccttagatactaactgttcatttccatgccttttgataaaacccagttgtccaaactgtggatgctgatctaagaaacaattcattcctcttcaaagaactgtcctagaccaaaactaattgaactccaatgatactcttctgccctgtaaattttttttaccttcctttcctaagttaaggaacgattgtttcaaaagtttaaaatcctgtaggtaatatatccacattgacacagttgactgttctctgggcatggggacctccttcgaattgaatgaacagacacgtatccactgtacaaggaccattttgtgctttttaccagaataattaacatggctatctctctgaaaaaagaaaaagcagctaatatcccagtgggtcacgtgcttggagttgttttcaaagtaaataaaggcaaaaggatttttcttccatgaggctttcctatgtttctagggtggacctgcatacagctcacctcaggaatctaaaaatgggggttgaacttgacatccttaatattagaatttaaccaactgagctgagtggccaaaaataatctattatagcttaaaatgaaaaagtgtttcatctgaaagccagatagataaacgccagtatatctatcatcttacctagaagttaaaaggtaaaacttgcagttgttcattgccaaaatatatacaaaacaaagaaactcaacagaaattggcatctaaacatgactgcaatatttgatgaggcaccaagatatttatcaggccacaaaagaaaatatattataatttcttcttgcactattaaagggccaagaatatgacataaaatgtgtcatttttgaggaaaaacacctaacagactgcttatttaataaaatagttactagaaaaaaatagaataaaaatggattgtgtgaatacatttcaagttgtgtaccagccttggtgtgcaaaaccacctgcaagaaatgagagtcaaaagcgttagcataggaaaagacaatgggacagaggtgtttacctgtcatggcctgttggtcatccactgttaactttaaactttttccacgccgaactacacgcactgtgtgccactcgttatcattgaggttatagccagcaaaaagagtctcgggacctttgcctgtagaatatgccaaacagtcattatggacactcagaatcagtcaagcaaatgaacctcacagagagtgagagaaagagacaaggggggaaggtgagggagagagaggagagaaagaagaaaggaagaaagagagagaggagggagagaaaggaaacagagaagaggcgggctggaccaattttcaagcccattagagtcatagcaagcaaggaaaatgacaacttttacaaacattcaggtgtgaccatttaagaatctttaatcctacgcattgatccataacaagtgaattaacctgctgtcataaataggcacagtcaatacagcactgggaacccacccaaatttacacacacatttttaaaaataaattctctgatttttagttaccactttcctgctaacaaagtgtctagccatcatgtaacctctgagctctagaagacatctgactgtagcccattagctaatcgttttcagtgagataagtctcccagtagactctgggagaaggtactatcttgtgtgatggcggctattccgctcttatacctggtacctccagtgctcaacacgttcttaggttctttagcctcctaaatttatggaatgttgagtctaaaaaacacatcgaaataaaccttacaactaattgacctgtacgtcacaaatctgtctgtgtgtggcagaggcacttctggcaggtgtaggtataagtattgactcacagtaagtggaccgaagaaaaggaaagaaaaaaaaaaaataggcacagccaataaagggccaactgttgagcatgaaggaaaagtagtgatattaaacaacagtagagagcaagggattaccagtgggcatcgagtgggcaagaagtataactgggaaagtaactgctagtgaatctatataaacctatgcaaatgaaatttaaatggactcagcagagacatattatttcagaaaggtgtttggtagaaattattgaaatgattaagttagactatatccgtcacctcaaaaaaaaaaaaaaaaaaaagcaagggaaaatgcttttaacataaccagatatttttatttaaaaaataagtatttctactaatctgacattatgagtcattgagaaaaaataacattaaagatacattgtttggtaatgaattttttccctggtgtttttttaagtatggaaacatgctggtacattaaaataatgaagggcattatatcattgagtttcatgtctttcaacgaattgagaatcaggattggagttcacaatttgtttaaccaaattctgccagcaaaaccaattaatgcccaaggatcacgggaggatatatgagaaagtaaagatacaggccaaggagaagaagaaaaaaaaagaggagagcaagagagatcgagtaagagacagagaaccaagtaaaataaacctcagttttccatccacatgagatcattgttttctttcagaactacaccctatccaccagcctattgatttctctcttatggtgctactaataattcaagtgttgtatccttggctggtgtatctcaggttagaaatgagccagtgatatgagctaaattttaaaggatgaattgcctcagttatttatatctgtttgtatctttagagaaattaaattacaactccagatacatgaatttaaaactattctagatataacagttttaagagattgatggctaaataactagagaaagcctgctagtccagcaactgcaaaaatactttgagatcaaatgttgaaagcaagttccaggatgaaaaaaaaaaaactctttctaaattcaatagtgaagaaagaagtgtttaataactctgcagcatcttagcatcctgctggcagtaagggtcatctttcattttgatccttgaaaagagaacatatcattttagagctatttttatagggaactttttttttttgttagaaatatgtgcttttgaagcagcttcacttctattcttttcttttttaaatatattttgtcaaggaaaggaagcatacataagggtgatatcatcgttataccccatccttggcttgatcttgcagtaaagtcataatgcttaatctatgcaacaactatttccataacaacaggcataaaatccaattaaaaataaccctttggttcataaaaatctctgtgcgccaacttctagctcctttcatgcattattaaaattgtgaacagattgattttagaagataaggtttttaaaaaggcacttaatagtctcacttcaacacaatgttacccatgcaacatgaagtgtaatggaaagtgcactagactgggagttaagaattgcagttgctagatcatgatttcctactaaaaaagaagttgggggttgctgagtgcttattatgtagcaggcactttgtctgttgtcttgcttcacctttacattattaatctgcagatgtgaaactgaaggcctataaagctacaactacttgtcgccaggtcacacagctaaaaagtggtagaaccaagtttcatccttggcctgacctactcaaagcctgcatgcttttccctgcattattcagcctcgtagttatgagaatctttggctaacaacttaatttctcactttccccatattggaacaaaggagatggaaaagatcctctttgtggtgactcccagcttgccctacagaatgatcacactgctagcaaatcctacacaccctctgcacaagtcctggtggaagcaaatctctaagtaatacaatgtctatctagggatgctgaaatgactgttcctaaagatatgacacagaagaagggacatcattttaggacctgtctccacccacaatcagcaatttgctaacacactcaacttctggtggtctcagcattcccatccataaagtgaggagagtttccagctgatctttacagttcctttagaatttcactttctcacagaatttaacatatacaaacttgttaaagaaagatggtttaactgttgaaattttgaatttgagagtttgtcctcttgctataattttaatggcaaaattatagtaacttcaagctgttaatgacctttcaggatttcctttcctttgggggatatcaaaccatgcatcagttgtgccaacgtctttctccctgcatcaatgtattacagacttaatgtgtgtgtccctcagaattcactatgttgaatttctaacccacaaagtgatggtatgagaaggtggggccttcaagatatgattaggtttagataagggtggagtcccatgatgggatagggccctcacaagaagtggaacaaacaccagagcgtcccctctgccatgtgaggatacaaagagaaggtggctgcctaccagccaggaagaaggccctcaccaagagccaaatctgctgacacttcaatctttgacttcaagccttcaaaaaactgaggtgaaaaaaaaattctgttgtttaagccatccaatctatggtattctgttgtaacagcccaagaagactaacacagtgggcaatattttaaagacttttaagaaagtctatagctggctgggcatggtggctctcgtctgtaatcccagcattttgtgaagttgaggcgggagaatcacgaggtcaggagtttgagaccagcctggccaacagggtgaaaccctctctctactaaaaatacaaaaaatagctgggtgtagtggcaggaacccgtaatcccagctactcaggaggctgaggcaggagaattgcttgaacccaggaggcggaggttgcagtgagccgagatctcgccattgcactccagcctggatgacagagagagactccatctcaaaaaaaaaaaaaaaaaaaaaaaaaaaaccacaaaagaaaagaaagaaagaaaagaaagaccatagccttatgtctattaaaagacatcattccttatgttttgtagggagttttgatttgtttgtaattttacacttgatttttactgtaacatattatttaagccagatatattaatttttcattttatagttaaagaagcagatttaaaagtgttgagcgaattattaagtctcaaaggcagtaagaagtagagagaagactgagattttgaaattttctattttcattaaaatgtgttttccacagaaaatgatctgcaagtagtgtaagaggtacaacgggactgaatgcccccagctaatatttcaccagaccaggtcagaattcagctctacaggctaatgttatattaaagaattttagaactaggagggacatgagaagtgtagaatttcaatcatcatctacaaataagaaacatgaagtgcaaagacattagatgacgtccccattgtcacaactgttaaattaagaagcataggtctctagactctcagtctaacaagcttttttttttttaattattattaagacagaatctcgctctgttgctcaggctagagtgcagtggtgcaatctcggctcactgcaacctctgcctcccaggttcaagtgactctcctgcctcagcctcccagggagctgggattacaggcacccactaccatgcccagctaatttttgtattttaatagacatggagtttcaccatgttcgaggccagtctggtctcgaactcctgatctctgccagccttggcctaccaaagtgctggaattacaggtgcggaccacagtgcgcccagccctaacaaacttttaaaaaattattctgttcattagacaatgctgatttagaatgaatttctcaaggcacaccaaaatctgagtctgagtttaataagtctgtcagtgcttgtcaacagagtttgacctaatctatggtacaacagccaaattttttggctggtgatattcactgggtttgctggtgaccctgtagctaaaacctattgataacagatggaagtagaagcagtaaacatttcagttttccttaattcagtgtaaattgagtgttcttccacaacctacccatccataaattcaaggtgtctctaagattaactcctaagaagggctggagttaaccctaacttgaggcatggtaccgacagaggaaaatgtgtgttagcaagtatatgtgtgtatgtgggtgtgtgtgtgtgagagggatagagagagagacacacactcaaaagatggtagatttttggccattttagtaaccacatttgctaatgacttttacttccattttcacatcaacatgattcttaggtttctttaaatattagtctcagaacaaaggaaatttcatgctataatttgtagttatgggaggtaatggtaaagaaaattggattttgtccccagtctgtcatcaactaattatgttaccttgaagacgacatgtattctctctattcctatttttatctgtaaaatgataatcccatataaaagcatattaaaaaaaaaactttcctacagccaacttcaaactattgtcattcttagaaggaccaaaactacctcgcggctacatgaaagagtgcaatgttatagtgaatatctctaatggtgcaagctttttatttttattattactgttactaatttcatcacttttgttttggcacagtaggcagagagcagaccaagccttaaagaggctcttctacccaagaattactacactcaagtgaagccagaggacaatattaatacgtgctagaaaatgtgtttattattttatatagtcaaattttaatggtgataacttttttcttttgacaacatgtaattatgttacaactatttttgttaatcactataaattttgttaatcactataaattatatttgaaagtactgaagcacagactactaagtgaatgtatttaagaaagaaagaatagcattcaagggatgcatagctatgctacttagtccagctctccttttacagacatctccatgggaggttagttgccttgcctctgtcttccttgttattggcaggatgaaactaatgcctgggtcttgaacttatttaggacctaacatgcattacctaattgtctggccaaagtcagagagggtaaacattctttgacctttgcatatcattcctttccctatttatatttttacatattcaaaaaatattgttctaaatacattttaaacaaacccacctgctttggatagcagaatcagtacaatttacaaagaacctcactgccatacacagtttcggaagcagtgatgaaacgggtgtgttttttcacatacctctttacatttggttcaaatgtagattctcatatatttcaggggagatctgcatgcatcataagaaaagcttgaacttggttgagagttatataaacttggatttgaaagcaggtattgcattttctggttgcttaggcttgggtatgttagcttctttgagctttccttccatcatctataaatgtgagataataatgcctaccttatttcatagatttgttgtaaggactaagggatataacaaatctaatgtgtttggtgctttgcactttgtgtaatctcaatgaatattaatttcctttctctcctttttatggaaaataagttaagtaacagtgcatgagttctgcaaaccaccaaaggatctaccattaaaaaatggttgacagtcaaatacactatacactatataaaaatgtatattgaaagaaacatccacaatttttatttgaacacgcacactgcagtctagttttttgaaattaggcctcccaaagtcaaattttttggaacagttgccattttaacctgagatttcacagtatttgtgtttggttatttaattcctaagcattcaccctgaatataaaaataaatgtaaaatacacttgcaagggaacctgaaatagatcaataacgacatgcttaatcttgctgggttaaaataagatgtacatgatactaaatttggatgctttttgctacaaagccttctgtgcaaatatcttgtgaacaatttatactggtttatgaatgtggagggaaaatatagtgaagagaaatagagaagaataaaacaaagctgagaccctttcaagcaatggaagcaaagacctctaagagacaaaactggcagatgcctctggaactgaaaggtggatgtagctgtacagaaacttgaaaaaaaacaaaaacaaaaacccatagcagttatatttggagttttaaactcttagatgtatgtgccccaagtgtaaactcattgcatctctacacaccctttaggtagctttctccctctagtggtgcatatattttaaagaggttaactacataaatgaactatctttatggtgtaccctgcttctggtatatatatactctggtacagtgcaaaccaattggttctaaagttcactttatttgtctaacatattcattgtaatttctactttaaaattctacctagttatttcagtggttaatctgacttactcaattaaaccatttatcgagcatgaagattttgatgggtatttctgcaaaaccatcacctaacaaattgcacagatgatggacaggcaggaattttttaaaaatactagaatcaccttatatgtataaattggttctatatttatacatgattgttcaatatatttagacctacagcacctggtaattgaattaggaagagaagttacagtaccatagcatctgagaattataaaattttaaaactgaatggtccatattgtgtctgttgtttatcccatttagctactcatttattctgggttccatggcacccatatgctattaattttgtttaaaatttattttgtgccaaataccgatctcagcattgggaatatccgagttacagtcaaaggaacttacattctaataggtcagaagtcaaaacactttttctgtaaagggccagacagtaaatttatttgactttgccgaccatgtgttcaccattgcaactcttcaactttactattgcaatgtaaaagcaagcatagaatgtatgtaaacaaatggagtggctgtgtttcagtaaagcttcattaaaacagggagctagcttgagagctatagtgttcaagaccctgtaagataaacacgtatagataatttaaacgtttcccataaattctgcattgcatattaaagaataacagaaacatactcaagaatttaagtgcgaggaaacctgagttttagattcgatattgccactaactgtaacataaccttaaaaatactaattctcctaacttttttactgctgtttgttttcttaagaaacaactaaaatcaatttttaaaggctttaagcccgggctccccaccccccaggccacagacaggtaccagcctgttaggaagcatgccgcacagcaggaggtgggcagcaggcaagccagagaagcttcatctgtatttacagccgctctccattactcacatcaccatctgagctccacctcatgtcagatcagcagtgacaaccgattctcacaggaatgcaaaccctattgtgaactgcacatgcaagggatctaggtttcatgctccttaggagaatctaatgcctgataatcagtcactgtctcccattaccctcagatgagactctctagttgctggtaaacaacctctagttttactgattctaccttatggtgagatgtataatgatttcattatatattacaatgtaatagtaatagaaataaggtggatgatacatgtagtgaaattcaattatcctgaaatcactcccgtctgtggtaaaattgtcttccatgaaaccagtccctcatgccaaaaagtttggagaccactgctttaaatgacacaaatcaattgcaaagtccttctacttataaaatctaggataaattaggttcctttccttttctgcaaatttagaatagaaacattcattaaatgcttggggtgtgtgtgtgtgtgtgtgtgtgtgtgtgtgtgtgtgtgtgtctgcatgcacctttgttaaaaatttggttattaggtttctacgtatatcaacttttccaggtactaacaagttttatttggcagttgactttggggactgtagtctctggggtgaggcaggaccttgtgagaagctggaagcaagccttgtcattgtgacaatgatgagaagatggaagcaggagctaccactgcttgatgcctgagtcatagttgctggcagcagtacttcctacctacaaatgatgagaggatatgtttcccaggttgtaattatgacaccttcagcctactatttgactttcccattactttctggttttaaagtaatctgtcctccagttaaaaaaattcaaaggagattaactcctcattacaggtttctattttatccttctcaatttttaggtattgagttgtgagtgaaacctgtttgttttaatttttcacaagaatcagctagaacattcaattacaaattaaatttagacatgtaaatggcacttctaaattttcctttttctgcctcttaacattactagaggcaggatgagccacataatttgagagtccattgcaaataaaaatgtggagtccttattcaaaattaagaatttcaagatggtagcagtggagcattaacccaagcacaacacaagctcagcatatggcacggtgtgactgcataagttgtatgctgttgaagccagttctttttaggagtataagttttgtgcttatttatttttgatgcttcctttagtagattctacattcaggaatgagcagacaaggctggaggcaaaattcttcatttatctatgtgagaagcatagttgagtcaccttccccagagtatccacacttaatgacatggtctctggggtatcagagaagctgtctcaggcttgttttgctggccaggcctggtgccaatcatgaactgggcttggtgatacaccaataaccctcagaaccaggaagcaaaactacctgctgacccatgtaactcctttctcttttccttctctattcctcctcaagtgctcctcaatttagccaaggatatacccttgagaactattcagaatgtcccataaagagatgcttgcctccttttttttaataagcaaagagatagagtcctaaggacagacacatttctttatgctaaaaatactagaaatactcatcccagttaaaaagtactttgactaaatgatataaagtcagacattcagcttgatgtttgtttttcaaaaatgaacactaataacagagaaagacattttataaactttaaaaaatccactggagaaattaaatagtcatgtgctgaccaactatattgcatttattttttgacccacacagactgttgagttttatcctggttctacaagttattagctgtgtgaccttgagcaaccttcttactttctgcatgcctcagtatcctcatatatctcataagctaatactagaaacaatgtaaatgggtttcatgcatcttaataactcaaaactacttttaatcaaaggtttaatgcatcttaataacgcaagaagcttaccataatctgatttatggtaagctttcaattatagtagtgataaaagtaactatcatcagtattatgttgtcatttttatcttctcctcaatgagtttaaaatctcagagaaaatatgatatagctcagtgccttgaacataacggcaattcactaagtatttgttgaatgggtttatttgtgtaaactttgtgggacttttttttaaatggtagatgaaataccccttgatattaaattaagccaagtagttgatgaaaagtaactccatcttttaatgcctccattcactaagaaaggtaaatataaagaaaactctgtcctcctgttttcatatttagcaggatggaatttggtaacccctacagttggagaacttgagtaactcagttatctggataactatttggacagctttttcgctcagttacattgaaaataaacttcatgatgcatacagcctagtggaacaaaatgacctaaggttagcagtgaataacttccgagtccaaaggaaatagttggcttagaaattgggggaactcaaaacttactgagtatttaattataaaaaaacacagatcttgtcctcaagtggatgtgaccttggagagttgttggaaacaccctccagagacttttctgccattttcctaaatgatagcaaacttattctattatctacaaaataaatttcagtatttctcgatgcttcacctcctgctctatttcttctggcctataaatatcattgcctatgcaaacgaataaacaaggttaaaatcacctacttcatctactaagaaacattaagcctctgtagttttgtcattgattgtacccatttatgacagacaaggataaatatctcttatgtaaatatatttcaatgcgaaaaacatacattttaagaattataatttactttttaagaagagaattacatttacaacacagtaaaaatgaacacaaattaaataaatatatttctagaaaaaatgttctaaaactagcaatctttaaatctaatctagctcaactggcaagtttaagaagtataataaaataagcctaatacaatgaaagtaacaattcagactgtgattttatttttttcaaaaggtcaattccaagggatgcttatcacataacaggacagctagcagatataaaattgagtactaaatagttcaatttgcttttgagtaagcattaaaaactgaaaatgtattcagtgtttgtgtagtgttaaagaaaagggttatactgatttatagtaatactcatttaatgtattttctgcaatacatacacaatgccaagttgtctgaataaaaaaaaatcaaaaagcatatgggtcctgagcatttggatatttacaaaatgtaaactgatattccataaacgaagccatggattatagtcacaaatgcatttttttaaaattaaatatatcattccatgtctaaatacaccactgtaatagttatagcatttttttaatgaggtcaagaaggatgtacattttttcataattcaagatcaatgaatttaccttttactttccatttcttcttaacataaggatagctgaatattattaagtacatgactgaattcacaaaatttagttcatcctcagtatttttgagatattctagtataaactttttccaaaagtaagaagcatattagagaaaaaaaccctaagtttctgcctttattaagtttatttattttttcttcctttctttttactgggaagtcattataatgcgtagaaatctatttctcagtattgtcaactttatggacctatttgcttaaagaaaacaaattctaagaaatgtgacaattgatgaatggtagcatctcgtgtcttgctttctttttgtttctttacataatgattgttcaaatgaaggctatggacaaactgtacatgattattaatgcattcatcatgtgaacattcgaatgcaatatattttttctaagcaatgatataattattagctaaacccttctttatttgaattttaagattttaatgacagtgctaacttaattgttttctttaatcatcactggattatttattaagctagcttttagtcagtggcttgaattctatgattctctttgaccatttattttagtaattgaaaaatattggaattaattctttgaagttatctttgggcaaatgtcttctgaaatgaatggctcaccttatgctccaggaaatgttctaaaatggcaattgtccaactataacaataacttagcaattaaatcttaggccaaattaacttggtttatctgaagagacagtgtgtgaaggttccttggaactggtcaaaccactgatagaaatgttgagttatgtctctgtgcctgtttctggttgatcttcctaaggtaagattatgttagattttctattagtaggttacagtcaaggacgataacttatactaacacatctagaagcatcttctcatgtgtggctattcaaatctggtttatttctcatgatcttgttcacagatgctcccaaccagttatcatctgagaaaactgagatcactgaagaatcatggtataatttccattggtagacatatttttcctccctattatatgttacttcaactggctcagtgacctggaattgctttatataaccttggcataaaatctaagagaaacaatagattacatttaaaaatattgtatgttttaatcaaagacaggacataatgtttacaagatgttgctaaaattagagaacggggtgcaaaacattcctataccatggctctatatttttaaagaagcacatattataccatgtgttatatattaagtacataatgtgccaagtattatgtgctataagggcatttaagacattaataaaacttttctgtgaaaattgaaatcctaggctacttttatgtattttctgtttcctttagcctccaaatatgaatactatttctgattaggaacaaaatgttgttctgaaagatattcattctattttgagagtcaaaattagtaggaaatttagcctgtaaattaatttaaaatgtacatgatgtattacaaatatatgatctagtgtagctttatcctaaatattggtgggattggtttaaattatattttacttttacccacttttgattttttaatcacaatagcaaagaaaaaacattgtagaaattatagatgatgaatagaaaaaaaaactaaaaattacctcaatctcaccagcagatataaacatttagagggatatacttccagaaacataatagaaaagcaattttgttatgaaggtcccttgcctgttccataattgataactcaaaaaaaataggagatgctgattacttcttcactgcctattggctgaactaattttacttaattgattgcataaagaatttcttgattaccaatatattatttttagcagtataaaatttctcagttgatttattaaacagaatttattttatggggtttctacaatttttatttattgtactcatcataatggtctaactccatatttatctgcctatttcaacactattaggtgaatatgtctgactactaagagaacacctgcattatttgatttaaaaatttcttttttattttctttactagaaacttataattcatgaaaaatctgtaaaaacaactttaagacatgtcattacagtatgtttgttctataatattttggttttaatttttacatgcataaactacttcctttgcgcctactgaaatgtaaaacattttagaattctttaagttgtatagaagttcatacttatttacactggaaacttcctggttccaaagctggttgatttctccatgtatttgaaaatttaatgggtgcacttcactagaaacctacattcttcgtaagcaacatttaaaagggattttgttaactcatatcttaaatcacgcatttcaaaagcaattttaaccataacatttatctgtagaaaaaggcaattgtctttgaaatttaattaatttcaatagtactatgcataaaatatttcgagtctgtatttagactgatatcctgggaagtgcagttggagagtgaagaatttccacaattgtatgaatgatgaactcaaagaacaagtaataataaacaatccaattttaagtacattaaaaataaagtaatttagccttttagtatttcttattcatcttcaggaaaactgttttcataatgcatttcttatccatcttgctttttgctcacattgttaataagtaaaagaagtggataagagttctgagcacacaaaacatttcaatctccaaattctttgaccgtccccatgatttaaagagccttgcccacttgacttatgtaccacatgttagccagtaatctgttgaacagattgtaattctcatgggtattttatagctaaactgaaaacaattttcagtcagacaacatatagaaaagatgcttgtgtagaaagcttgctgctcctacatctgctctgaggagagtgtatcatgtggcctctattctaatgacagctatttggatcaccagtggatccaattggatccagcaactggatcatctgccaccaaaactaagatctggtgagtagcttatggggcgacctgaactgaaagatttgtccaacgggacaaggataagtaatagattcactagattctctttctagaaaagtcgaatatacaacatatagagagtatacagccagtgaaagggatgacagaaagaaagagagagagcagaaaggaagaaaaggagggaggaaggcagagaagaatacagtaaaggaaggaagagaagaaactcaaaacaatggaggaagtggggtatgtttagaagcagctcttcataacgacaacaaataaaaacatctggccaacatgctgtgttctcttagatttggggatatttgtataaaagaaactcccttttcacagaaactaataagagaatatcaagtttagaatgtttcttctaaaactttcttggattttataatactttttacctaggcaattgttataatgccgactctcaacaattgaagagaatttgatcaatttggtcaacactcaagaatgttgcattactttgagagtctctgcagtatcaataatgcttaacgtgaataaattaataactgtgcttggtttcaacatgcattcttaaactgcacaagagtagtttttagaatatcacagcattttatatttgcatataagcaatcagtagattaatcattcactaaaatagaccaaagcaatctacttttcaaccactcacagtatcattctgttgcctaatccatgtagtcatctaaatatgcaatgaaagctgtattcttctttacaattctcataagtttaaacatgtggataatttaaatgggcttccatttattcatttatttttattcattttttttttttttttttttttttttttttgagaggagtcttgctctctcacccaggctggagtgcaatggcgcaaccttggctcagtgcaacctccgcctgccaggttcaagcaattctcctgcctcagcctcccaagtagctgggattataggcacctgccactatgccctgctagtttttttgtatttttagtagagacggggtttcaccatgctggtcaggctggtcctagaactcctgacctcaggtgatccacccgcctcagcctcccaaactgctgggattacaggcgtgagccacagcacccagcctcaatttcgatattattctaaagactcattgccatgtgccaatacactgcctgtttttatttgttttctgtcagaaatctatgttcattctttacattttacatgcaattttttttgatttttgctgaaaataataatttataaactttcttttcattcccttcacatatactttaagtaaaacaacacagaaacaacaacaaaaaacaacgagacttctgttttctttatttatactttgaacttcccttattccttgagcagcttctatcctaggcaggtggatagcaccagtcactgacaggcaatgactggcagaactccacaaatcaagtgactgctgtgtgaaggcagaggcgaaagactcccttttacagttttctgctctcaggcatcaagcagcgactctaaactgaatatttactttatgttaacaagctccagcccctagaaatttcctcatatctttttaagtagcttctcaaatggcagcctgatcaaagcaatctaatatggcttaagtgccagtggttgacattttgcattcttttattgctttccatttttatctacataaaaattggtgataactaatatccatttgatcttttcattctggtaataaaatggtaatacaaagatcttattatctactccagacatccatcaaagtacatttttcaaaaatatactatgtgaagtgtttcttccctatacccaagtcaaaagcgaggtcaagtacttgtccttagatgccccttctctccaatacttgggcactggactgcaaataggaattgaacttcagcccttgatgctttgttcacactaatgttatatgtaattgtgttgtctctgcctcttaaatacactattttctgtgagaagccaaaagtacttggaaggtctgcttaaatattttttttaactccagagtttttattcttctaagaagacaagaaaaaagataacggaagaaacaatactggaaatgaagaagtaagaagagtgaatcttaatagaaagaaaggaagtgcaggtaggtgggagaacagacaaatgtaataaggcataaagaaagccacataatgcaaacaaaacaagccccagagatcatgagtttattaaatctatttttatatggatgcagaagtgtccctgaggacgggtgtggtggctcacgcctgtaatcccagcactttgggaggccaaggcagacagatcacctgaggtcaggagttcgagacgagcccggccaacatggcaaaaccccatctctactaaaaatacaaaaattagccaggcatgctggtgcacgcctgtagttccagctacttggaaggctgaggtaggagaactgcttgaatctgggaggcggaggtttcagagagctgagattgcaccactgcactccagcctggatgagagagcaagagtccatctcataaataaataaataaataaataaataaataaataaataaataaaataaaataaacgaagtgtccctaagccttccagtgaacaagaaggtcattccgtaattatgccattgatttggaaaaacaaaaagaatagaaagcataagaaaaccaagaaacacaaaaggctccctgaatccactgaatccactgcatatttaaagtagttactgatatgacaattaggacttacctatagttgataggagcaagtttagttttcaaaatttcaatgtatttacacctcaaaagattataggtctaacgatttttaaggttaccagaagaagagagaaagaaaaaaatggcactacttaatcatgcagtacatcacaaaaaaggccaaattttcagaaaaaaaatacatagaaacacatagcctaatgagtttggatgtatcgtttggaattattgggcaccaaacttgaaattgagaccatcattataactctgagattgacattaggctatgtgctttggcagatataaagaatgcagaatgagactaatgtcctgtacagaacctactaacaatgcacttgagaaaatttcacaagcaatagaaaattctttttgcattctttatcatttttaaatgacttactaaagtcatttaatactatggaccaggcaagagactgtaaaacagtcatcttctcatgcaaataattcacgtgctagtcacaaaagcaccttgttcaatatgatttaaggtttcaacaatgatttgttaatatttagtttttgttagtacagatttctttgatgagttttaaaatagcctacaatttgtgttccttcgttaattcagatagttttttcctttttatgttaaaagaatgtgactgtacagtcccttcccatctacccttattaaagtatccttcactgtctaagaaagaaagaggaggcaagggtaatctgattgtccttctattcctatcctggacagaggagagtggtgagccatggataattcatttctgtgctcaccttgcagcccatggatttggaaacactgaccttaatctaatcccaaattgtagataaacatattttagcaatggtataagctaatgagcatcaataaactgagactcgtctgggattgtgtgcagtcacactctgtaatctgcaagatcaaaacatacatttggcagtgaaatggccattattcagagagacagctttttaaagaaagtaccctatctatagctgaaaataagcttttttatttttaaatgaaaagaggctctcttcttccatttaaggatgcttgacagcttttcttcccgggggggaaatggtagcaataaggaatttgacagagataatacttggaattcagatctggcctttctcagaggaaattttaacaaagggctgtgccctaacatgtccatggaaaactctgtcactgcatctaaactactgacacaagagtggctgaaaaagaaacattcattcaggtttgaatacatgtagctggaccctctaccctcctcacctcccacccatttttcactggcaaagattagatagtctgacactatgtatattttccatataaagtacaaatgctgtaaacttggcggtggggtagggaaagagaaaatgactataggaaacagcagcacaattttaagtaaaagtagaaaagtgtttctggggaagtttccattcaaacgtaataacttagagtttaatattagtctttaatgtaagataatcttttatgttttactttgtatatttcttgtgataattttcttaaaagatatcaattgaggtatttcatattaatttcacaatacagttgatagcttaggtatggcacaatttttagagataatggtgttatcggctgtgatttaataaacgtacattaattttctcagtctcagacaaacctatggctcacagaggacacatgtaataactcagtctttcattaaactgcaagttatactgagatacagatattgttaatttagtttttattgagtacaaaatgcactccaggtagaaatcactgctcatttaatcactgtgtgttaggtttgcattatctggaatgtaaattcctccctttcctcaaaggtgagtcttttttatggaacttgggtttcttactacacctgctccctattccccaaataaaacagaggcaaaggaaatgaaaatgttacctgttcattgaatgttctttccagtgactgctgtcaagttaaggaatgtgcagtcctgtccgatgtgtacactggaggctcacaatcattaattgaattcaagtatcacatactcattaaaaagggaaaacaattcactaaacagcaaaaacctttgtcctcaaaggtattattctgtggaatatccagaggaaaaataagactgtcctcaataccagagtctcatgatataagccaaatggcaaacgagtctaacaagggtaattatactataaacatacatttaaaaaatcattgatatagccacagaatacagaatcacatgtcatttgaataattttcattaattgctatactttgcatagttatattttgtaaattcaaaaattcatgccttgttgcatgcttcatataaataaaataaaaagagtacataaggtagaggtctagaaaggaatattggtccccacaaggattttctaagatgcaggagggatcaagaaaacctacagccagagtgaggcacagatctggctttggcaaagaatattttgtgagttgccactttgcctgcatctatgcccccagctgaaagcaaactggacctggtattagatgtgcaaaatgtatatccttttaggaatgcatggaggagatagagttggagaggagattacatatatttgaaaaattccgcttacgtgagagctttgacaggttattttcaggaactattttgttcgagatctttttaaatgcctgggatattggttataatttattaacttaatttttaataagtcatcattctgttacttttttattggtctgattgaacaaactcattttaatgttatttttaaaagaatattaaatatatgtggatagaattatgagttgtaagaggcacagtgtttgaaacagtacgtattttattaggaaaatagtcttgttttcgcaagtttaagacctctatttgttcctcagaggatgccttattgccacttgaaaacatggccaatgctgtggggagtagactccatcaactcacattcagcattgttttgagaatagaaaaaaattctttactgtgacagtgagagattagaaatttgttagaaccattttatttaaattgctgatgactttgtgttgtgatcattggagatttcttaatgtgatcagcaaaacctggaaagaaaaaacctgagcatttatgtacagaaataaataagtttacacttaagataatgccacaactcaaaataaaatcacagtccttatatcctttcagattttcatccaaattcaaagaaaactcagtccatgcatcttttcagactcatcagtttgcatgcatgtcacagatttgaagggttttggttatttttgcagagatatgattaggatgtaaaaattcatcatataaacattcttaatgatcaaggaagaacgttttagacgagtaattttctatgtctatgtaaaactttagatgggtttaatagtaactctcgaagtaagaggaattaagtatttttttttgtatttgagttaaaagataaagacaaaagaaaataagacccacaatattttctcctatttggttatgaagagaacaactggagtctaaaaatgccacttgcagtatctaaatgtctataaggtgctggcacattctgttacaaaacacttgtcacctctttttccatatagaggtaggaactgcagtgggaaagtcttcagctgtacaaatttaaaaatgaatttttacaacccagatgatggactggtatactttaaaagtgagctcatgagttttataaacacatttctcttgctctctctctctctttttcttgactagcttacatcataatggaggaataacattttaaaaattttgaataggcacttactggaattacagttaatcctgatacaatctagatggggaagaatagatgaaaaatgaaaattcatccttcaaggtaatagctgcagacatccaataaaattacagtccacccttccggggacagacacatgcaaatatggccactccatatcattattctttacatacttataaagcccagatgttttgttataaaagtttaccattggaaacaacaatagaaggttttaaaaatggccaattcaaacaaagctacatggtgacaaatctaagtgaagtaaagaattgttaaatgtcaaagatgtttggcttagactggctgcaactttctccccatctgtgaaagaacatatcattgttttccgcaaaatgtaaaagtgctccgtcacaatggggtacagtgcaggttcagctaggctcagacatcttggacctccgaaatctaatatcccacaaaggccaacagaatccttcagaattgcagtggtcaaatggaaagcaagttaaaattattcttatcttaccctaagggtttttgttttgtttttaaattttatttgcttgggcataaaaaggtaactgccagatgttggctggattccataccttgcgttaattggaggaggaaagaaacaactgtatgtttcctttagaaactccagtggctaaggagcagtcattattcaaggcacacaagcctatgcctctcttaggagctaacagtgttatctctgtgtaataagtgtcgtggttcccttgattttcctttcttgattttccctttcttatatttgctttatataaaagtagctactataagaacagaacgtcttgtatgggtaacacaaactgtaattatagtggttatttttaaaagactgtaggatgtttcatatttattttatatgtatttgttggtttgggttttattatttaatgcctttggagaacataaaaaaataaacctagattctgtttccatatagctgagtttgtcatgtgtcgtcaaccgcatcagaaaagtggttgcaaacagccaaggaccagcacctacacacctctttctacagaatgctttgctgttcgaaaattctcatgagtgtttccactttgactaacagcagctttactgcatgcaattaggcgatttgttttgattggcttgtaataacctgtcatcgtcactagagggtactctaacagaacagtaaaggagagtgctctgtgttcttaaagtagtatttttttaaccttaatatttaacttaatttcactaatattaattaaatatgattatatgcaataagataccaatgggataattttatattttatgagttatcgttctgcccagcacaatttgaaaatgtaggtggggtttccacaaatgccttgcctcatcacattttattactccttttttggggtaaatctatgtagtttcaaatttcatttttccctctctgtttattcatttctatatacgtgtgtttaacactgtcaaaaatacagtaaaacctcattaattttgactcctcttattttgaaataatgataacactgaaaatttgggcagagtatttattcttcctttgatatgagcaaagatctcttaagaaaaaaaattaaactcataaacaaacaagactttgaaaagccaagcgtgggaagaaaactgatttccaatacttcatgttgatggcatagtttgcatgaaacgatgtgctaattataattaatttttatccaaccattaaaatcagcctagagagccctttccgtgataagactttccaaactattatgtttttgagtataatttataaaaataaaaactgcttaaacaaattttaaaatctgcaattcagactttttcctaattcagcctggtttttccccataattcatctagattggtgaggttttactgtaatgggtctttcttaatgctacaattaagcaggaaagcattatctttctgtagaagagcctgtgtctctagtgttctcatggctgtttgctaagggccgcagactttgggcattgaagggctgtggatcgctgtttgatagcaaaataccaccacacagtactccgaaacagaaaagacagggtaccacaaaggtgattattcaaaggagaagcccatggagtagagtaagaacagctcttgatctagataacaaagcagaaatttgatattttgtgcaaatcctttctaagaagacatgcttttatttatctgcaaggatgtcacctacaaccgatccaaatgtcagtgaatatatcaacagaaaattcagcttgaggcaacctcaggcttaataatttatattttcaattaacctcactgacagacatggcctctcttttaagaaccctcagtggtagaaatcacaaaacagtaagttatgttaaacataaaaaataaaataaaaaataaaaagatgcccccgaaaacctcaaattactttaaatgatggaaataagaccattaagtgttttaattttccatggcaaacaggctacttgatcaatgtttgcaggcaaattgaacaaaaagtaaaaaagtgttagttcaatgggggaaggcaggttgttacctagattgaccgtcagtttcacacgtcctgcgtctagctccaggcggagggtgtcagcagagtctctagaagtggttgccatcagaatgccatatgcacgctgggatcggaaccgtaaggaaacatcctcagcctccgtatgcatgactacggggagctgaattttcataaacatgctcccatcatagctcaaaaccgttgcctctagagatggaaaatgaatatgataagttcttggatggtatagcgcattaatactttaaagaggaaaaggatcatttattatcatttatttaagacttccagaacacaatactacaaaatcaattcatcttcttcagaaataaacaaaactgtgagctggaaagagaagtcacagtagaggacttcccttgtgagatatttgctaaagcccagaaacagagatatcagcagttcctttttttttgttcccagagcactttctacctatagcattaatcatgttgaattttgagtgtttgattatatgccccccttctcaagagcaaagatcacgttcttttgtacagccacagtgtgagcctagtttgaaacaccagcgaagttgtggatttttttgttgttgtttttgtttgggttttgttgttgtttgtttgtttgagacaaggtctgtatcccctaggctggagtgcagtgacaggatctcagctcactgcagccatgacctcctgagctcaagcaatctttccacctcaacctcctgagtagctgggaccacaggcgcatgacaccatgccaggctagcttattattaatacttttttctagagatgggtctccctttgttgccaaggctggtctcaaactcctggactccagtgaccctctcgcccaggttcccaaaaggaacctgtgcccagcctccagcaacttttcaatgcatgtttatgtatggtaagcccactgactagttctgtgaaattagtcaaccttgccttggctctgaattattcatctgcacaatgagagggtactgccagaaggtttctcagggctttgatctgttctgaaaacctgtagttctaggagaagttactgtcatcatttttttttcataatctctgccctgatagaattatttttaaaagaaaaaaaaaagaaatatagcttaactataggaactaggccaatactttaccaaaggtgatgttcaaaaagaaaaaagaaaaactgatattaccaaacaacagataatacttcttttgagccattatgtttagcaaggtaatttttacaaaggcttccttttaaggaactgttacttccttttaagattaatttatagaaggggagtaactttaaatattatctataagcacagccctggtgtcctgaataagttctcatgcaaagcagtaatgatgtgcttttgctacactaaataagcatgggggtgggactggggagcttgtgaggatgtttgttactaaactaaggcagatggcatcagtagggaagttgcttagtactgtcttaaacacacaaagaaatgaataaaaaaaaaactgttgatgacaacctgacggctttaagaaatagtcaggactccttaatgttaagcaccatatggtagtggaatattgcaaaacaagcgtgaatcagtttgctttctcattggttccgataactcaggatgctacttaataaagaaaaactacctggaattaaaatgaaccaggaaattttcattattttgcctacttacacagcatagcaattaagtgtactgatacaactgtgttcaatattaggactatatttagagttgtggttttgtaagtttatttttcagaaagtcaagtactgtttctataagactttaatcactatttgttgtcatgatgggattaagtgagaaccagaacctctctaagcactgagtgttccaggtctccctgcttaggttagctcccttctcttttccatctacctcttgacttaagagatctcagtcaactcatatgctcactcctctaatatttattaagcgttctgacttctctcctgagctgtagcattcattgcctattggaaattttcaattggaatatgaaatttcaattggaatatttcaattggaatattattaaactcttgatttactcccttcaaaaatgaacaaactcaaaacatgctccttcttcagtcttctccatctcagtaaacatgataatctcattgctcagacctaaagctttctgatttctcttactctctctgccatgtccaatccatttgcaagtctgcaagtcctaaaggctctaattccaatccacattctgaattgattgctgttcacctctgccactaatgtccctcagactttgctctcatctctcacctacaccactgtagtagctccctcaaccgtgttcctacttttttaaacctacaaagatcagtgtgaccctggccccagtccatctctctggcctcagctttaagtatgtcccgcttcttgttcagtgagctccagatacaccaatttcatgatctcactgaagtgtttgcacttttagatccctctgtttaaaaatgtttcaccccagatctttaaatagctggttctttcagcatttaggtctctgctcaaatgttactccagagagacctgctacccactccagttattcaatatatattcatcatttcactttgttgaaatgaccatttcttgtttgtagagtattatctgtatatgccctttagaatacaagtaccttgagggcagagatcagtctctcatatgcattgctctatcagcagcaagtgcccccacaatgccaggcccacagcagagcctccataaatattaattgaatcaataattgcacacacacacacacacacacacacacacatacacacacagtgagctaatttcaatttgaataccaagcttacataaaagcttaccaaagaaattaagtatttattctgcttattgcaagtgaaatctaatttcagtactgtgcatgaacgaaatatgtaataaggtccactttgaaggccaaaattgggctgcagaagataggctagggaagtgtctatttatcaaaacaggggcctcatggttaggcaatgccctaagcactgataaaacaaaatatggtctttcaaaaatatagtggttctatataatatcatatttttttccaattagacaaaaagtttcccaaatgggagtaaaatcccagtggtcaaagaccagtgcaaataatcaaattgctgttgctcaaaaaataatgaaaacctgagtgtaaagttatagtgaattctagagagaaaaatgcttgtggtataattttaaaagaaatttgatctttacttttgtttttcctaaactagacaatcatgacccatatctgtaaagcaacaagcacccgaataaaagtgtaaaagtcattatcatgtgttcagttactttggtttcatatagataaaaggatcaaaacagtgtttgttttctcttctttatttaatctctataactaggctctattattcaataatcacatttttgaaataatcatattcttctgggaaaagtagcttgatttgattgaaaactaaatagggggcacctcctttaagaaatacagatgactgacaatggatcataaatatagtgtgaaatacaacccagagaaaaaaataatcagaatcattagcctttaacattctccagaaagctgcaggactgaaataacatagtaaagtaataaaactagagtgcccccgagtgtcatgttaaataattctcaatgtgaaaataacttgttgataaatgacaaatgaaagcctaaacgattcctcacaattagagttaatgtttaattagacaagaaatggaaaatgcacagggttgtagtctagagttgccaaataaatggtaaacaacattctgacatttgaaggttatgctatttggcagcatccttgaacactagtaaaattatttcatcatttagaatatacaataattctttaaaaggctaattccaatacaatacttcccactgggggagaaaaccagtttcaactttgtcttctatatctccttctcccttgtcattaagtttgataaatttccttttctacattattctttgttgcagtctaaagtgtacacctgtgctcagttttgccgaaaggcagtcacatattgtgatcaacgatgaaaatcagacagggagccaaattatattgctctgacatctgtccctccatctgttagaatttaacaaacagtataaagcagatctctgattatatcaatgctcttattcttacatataacagaataatttttatatgatcaagtctccacaaattctcagttttattaaaaataaagcagaagggaaggcgctaaatttaacttttattcattgaacattatttctgtactactccttcttataggatcaatacatgtaaaacaaaatactctcttcttgtctgcctaagttagcaagtatcttattctttcttataaactcctttgcttccttaggcatgataaacatctcctataatgcaattgcaacataatttttccatgttgaactttctaaatccaaggagctgaacatgttttttaattactttgaataattattttcataaattataaattatcaatttttgctcaaagttaataagaaaacaactttaaaagttctcttaaaaaaagaaacttcaagagttgtcaactcttatttgatcaacaacagccttaagtgaccaatgtgtgtctggagaagaaactctgtcaaagccccctgttttaaattggaaattcggaggttcaggcacaatcttgtgttaactgaactagggcataatagccacgaactgggcagaagccaaattttgtggtattgagcatgacaaccatcacacatttcctttgctttcaggaggcaccctaacgtgagcaagaaaattacttctgaaaagcaaaggactcacgcaatacacatgggtagtccagtaacaagaaccacccaaaaatgcatacagccaacctggagacaaagaaatctgcagaaacctgcagcctcctatcagataaagacgtatgctgaatcccaatgatgaagtttgctattaaattctcatttacaaatctacatatgcttgctgcccctttttctaatcattgcaatatataaatatttcttctctcatcctggctctgaaagatctacaatttctattttcatttttgccataggtagtagcggaatattgccacagggtggtacaccacgcatagttaacagaaagcttccgtaattcatgtgacagttgagttatacccttttttcagcttcacttaaccaagaggcatcagaacaactggcagctctctgggtgattaaaattaaaacaaaaccttaaatcgtgcaagtccgctaatctcatattatgcgtaactgtattataccttgcaagctttgttacattgttcatccttttggcaatttccaaaaacaaaactaaacaaacaaactaaaattaggaagcaaaatgcaaagaggaaacttataaagaatatacaccatactaactaaactatatagaaatagctaagttgtattgacaattcacagaaatgccggttaggtactatcataaagagaatgaatatatctgtatctatgtgataacatacccgtctactgacccatctaattgcatgacctacaataataacagcatatggtaagtggtttaatatatgatttctatgttactattaaatatttatattgttaatattaatctcagaactaataagttgatgtacctcctttttaagataaataaccaaaatcaggtttcaattttgggtttcacaaaacaacccctctttttcctaggaggttttcggcaaactgaactgaactatttcaggaataaaaaagggaaacaataaatattcatagcttaaaaatagatgccaggtaattttaggctaaatatgtaataaagcaatgttatttgtagcaggtgaggacaatggaacaactcatcaatattttttcatattgatttttagttccattgttgaaaataagtggcaataggtgtagtgactaaagcatttatctgaaacactgggtcgatggaagaataaacttagaactatttgttctgctatttattcctttagcctgttctgcagatcaactgggatggctattgcccttcagttttctttgaatcctcattccttttattgtatagggtgaaaaaaaagaaaaataaaatgtgggtttgcctcctgttagaaaaagagaggcagcacctgctcagaacttcaataggcacagctaagtcttaacagcaaattggtaaatgaatcctctgcagttggttaggtcctagccaaaggtaagtactttttctattagggtacacttccagaaatgttggtgcaccttagatgattgaaagtcagcttacttttcagagaggatattgcctcttttgtaagttgactgaagtgaaatgagcaggctaacttaagtctcacccagttgtgtcagggaagttgcaactcatagcttagcttgcctcaaatgctatttcttagcatgggtattagcactagaagccataggtatgtataattcatgcctcttttactgtctaatgttctgaagttaaaaactgggcaaaaaagacagcagttactgtctataatacatcttaggctcatactctagaggatactaaagattcaagtttctattcctgcaatatacttaagaactgtgtcctttcagaatcaagctctttgaaaaacattaagagctcattagtaatccatgtcaggtatggctgctcagcttgcaaacagagtttacttcagtagagtatacattacgtttcaatggtcagtgcaggtttgaggtcaacatttaataaacttttcatctcagggagttggctgctggggttttagaatcctacctctctcacaggacctgccaagatagcctgttccggaacaatcacagacatatctgttccacccatccctgcacatgccattgtttttgcaagggttgctaaggcacggttttgctgtttcctttgagcaggaaggcttcactccagcagtactttgaacttcagccatttgccggatatctttgctttggccatcgatgaacaaatccctgatgcagcccacgtagccatagttgagcagagcagtccacacctcggtggggaagacaaggccagctttattttctggcagcccccccaggtacaactcatcatccaggtccagaatctcactctcaccaggagcagtgtagggagtacgcaacgtgttgacagaaatggtacctatttcaaagagaggagaatgcacaggtctttaaaaagcaccaacgtgttataattatctttctctctttcgtctgcttgatggttaactccttggaggcagacaattattattattctttctgtcctcactttttggtatttcctagagaaattaagatatctgtggtattaagaaactttagaaataaaacagactaaatggttccatttgaactcgagaatggaaacctaagtgtacagccaacaaatagtgtttgagagcctcaaacagttcagtcaatgcatgtatacatacattaaaaataaagaaactgtaattctgtatcagtctctagaagaaagtcagattcccctgggttagtgcttgttttcaaagccaatattcaattgcaatccaaagaaagatttcatgttcctattttaactgacttgattactttgattgagcacaatagtttcacagattacctatgtcaaaacctgacttcatcactcctagctgtataaacctattgattaacttacatagttttgtttcccttactcataatatgcgcataataatattacctaccttatagagttgctcttagtgttaaacaaaataatactagtaatgtacatggtttataataatcactgtataaatgtttgtgattatatttcagtgaaagaatcaagtaaaaccaattgcttccttatttgtaaaccaagctagttatttatttaaattaacaaggctttctttttctcactccaaatgttaaggagaaaaatctattggtttataaatacaagggctctaagtcctaagtatggaataaccaggtattcatctacatgggatcatttgagggtcacagaaaaatattagtggaatctatgaaaaaaaaagaaagatataaagcatattcctgatcaaaacgtgcatacacactgtcagattaccaaaattccactgatactttatcttcagaaagacctttgtacaaatgcaaccatgatacctgaacagaacaccacaaggacccacaaccacattatcccagatttatttctcagctccagattataagaaaggataggaagagtctgatgagagagagaggatgagaaaaggtctgatagcatgctggggcatgggtatagaacctcaggtatttagggaagagacacaagagagacctggagatgggaggtgtgatacagaagtaaggacaaaaagaagaagtggagggtaggtcaggtgtgtgtagggagacacattttagttgctacacagaataccaaaagcccgccccaagtgaaaacacatatctaactaaggatgtaaggctgtgggccctgatgtgcccaggagtattccaaatcccagcagaagggcccccttcaatctaggcagtctaatgggatctgtctttgtcagggagaagggcatggaagccactgacaaagactgctcaggtggccgagtcattaagaggatatttggctctctagactttcagagaaagaaaagggaaaagctcctaggggagaaacactcaaaggcattgctattttggccttccaatgaggggagcaaaatagagatttcctagggaagcagctaaaagagaaaaggacaaagtattcatttttactgttcacatttgtacaagtgtctagaagaaaactctcatttaggaacatatgggaaccataaaatcctatttagaaaaatataaagcatggcattttggggaaataaaatttataatattgaaagagaatggtggctcttttctatttcaaatggaacgatcattacacgcattttaaagcatcattttttatatagccctattcaaaatacctaagaagcgaataaacagatggtccctatcctctgcagtagctaatgaaagttagaatatgatgagaaagagtgtcttttaatgacaaaaggaaaggtggacactttaaaaagcacatattatcatggaaagcaaagagttacatgcaatgaacaaagtgccatgttctttttttttttctttctgagacagagtcttactctgtcacacaagctggagtgcagtggcaggatcttggctcactacaacctctgccacctgctttaagcaactctcatgccgcagcctcccaagtagctgggattacaggtgtacgccatcacagccaactaatttttgtattttcagtagagatggagttttgcaatgttggccaggttggtcttgaattcatggcctcaagtgatccacccaccttggcctcccaaagtgctgggattacaggcgtgagccaccacacccagccaaagtgacatgttcttaaataaaagagagaaggattctactctattttccaattagttcaataaggcctcctaaaagccgtagaatttttgaggatttgacgaaatgaatatccactattgagaaattgagaagaaatgttaggagacacggaacttagcaaaggaacaatgacaaattattccaagtgtggtgatatattcaaatatacatatatataaacatatatgtatgtatgtattcccatatgctctttttattcagctcagatggggaaaaaagccctgggaaaggctgtactgtccttgctcagggtatcgtaattctgacactaagaggactcctggaggactcctgagtcgaggaaattcattggcttccacaacccactttctccctctattccatgtagtttccataccttggtgcactgtgtctgcactcactctaaggggcaaaacggctgccaggtggtttagacaatcattcattacagtttgtctgacagtaaggatggagtaactgtgtctcttgatttttatttatggtgtgttagtgcttgctttgagcaaagtattgtaagagagttcaaataagttattttaagaatgtgcttgatgatatggacagggtaagattcttactacaaatttatcattagacttgagttttctgaacacggtcatagagaccacaattttcaaatatcccagtgcacacttaaacacacatccacccacccacccacacccacacacacactctgaaacaaatgtttaaaagaaaaaaaaaatattcaactctacagcctctgaagcactttgatattttctctctcatcatatcattttattaaaacaaatgctggaccatcaatggattttagcaccagctaaaatgttgtaacccatggtacaaaaaaataaataaaaaacaaaaacagatttaagggttactatcataaagagtaagtttctcccatagttccctattgtccctttgagagacaattgtagagttctcatagaaagaacaagcaggccaggcgtggtggctcatgcctgtaatcccagcactttgggagaccaaggcgggtggatcacctgaggtcaggagttcgagaccagcctgaccaacatggagaaaccccatctctactaaaaatacaaaattagccgggcacggtggtgcatgcctgtaatctcagctactcgggaggctgaggcaggagaatcgcttgaacctgggaggcagaggttgcggtgagccgagatcacgccattgcactccagcctgggcaaccagagcaaaactccatcagaaagaaagaaagagagagagagagagatagagaacaagcaacaaaacatgagacagaaagaaaaagggatataatcctacctttaattcaaatttaatccaagaaagactagaacttaaattgagctctggattcaaagttaaggagacacatcaggcaaatggatggatcagatatcagtcattggaatattatgcaaacagacatcataggatgaagaaaatagggctgaaaatcaagtactactttatctatatgctttgctaattcgtatgaacttgtattttagaaaatctttgtaaaagagatggcaaataatcagaaagtaaagaatttagttcaagtgggatggaaacaattatttttatattttgaaaattcatggagtaaaaatggttagaattaataattaaattttattactgagacaaatgcaaatagaagtttatattttagcctaaacatgtgtcctgaaatagacacatttccaataagggatttgaatcccagacctccttaatgacttttactatggatatgaatcaaagaacatattcacctagcaaaagagtcatcacagaatccgaattagtttaaaccaatttaactcatagatatgagcatagtgaaatttaaatattaaggttcccgtgtgcttattttattaaaattgagttataaaatcagtggttacaaagaacacatcaaattaatatttaaacctggttcattgataattgaagacaattgagtagttgccaaactctatatatcaatggaaaaggagaattttcaaaggctgaggtacataaatgttataaatacatttttaagagaaaacaaaaatctaaatatattaatgggtcatccctctatctttttccaggaaccacaaatactgacatgttcttttttaaatagtttgattccttcatacattctaccccttctactgaatttatatttgcagtttctggtaaattaacaaaatattttatgtaaacattgttacattaaggctcctaaaattggggaaaagttcatatttgagaaattatctagatcagggtttcatgcttcactatttaagaatctgaagcaccctgctatgctattttattttttaaaggaatgagatcgcaactaaaaataaattatttgtggacatacaacttttataattttaatgtagaaacgacattacattatattcttacatgtaaagctgttttttcacgacacatgtaagaggtaaaatgaaggtgataagcagacaaggtaatatttaagaatattcataaacaagtaataaatttatgtttcttgtaaaactgtatgcaaaggttcaaaaaactttttaaaacagctcttagttataaaagtggaaatgaaatttacaacgtagtgaggtagtttttcattacctattagtttccattaacttttctatcctatttttattgtctgttctacttccataagattagtttacagggtgagaagaaacacagagtgaaggtgagatttaaaataagttaagttgatgtcaagagttaaattacttcacaagtttaaattactaggaaatgaggagtagaaaatagtgtgctgtaatagggaaccctttttcctggtgagaaaatccgatgttccagctcttcaactaactagctagcaagtttagccaaaggatagatctgttaggcttcaatgtggctcttatgaaaaataaagaaattcagtagatggattattaagattcatttttgaataaacaatctttaaattactgcttaaatgaattgtttaaattaatgtcaattttatctatacttaattctgctccacctgtccctacacaaatgaatcagatttcacaaagttacaaatttacttgtcaaattcctagtctaataacaaattcaaacttgatgaaatatgcacaacataagtaataaaaacagaatacaacattgacaatagggtataatgtaaaatgtaaaatatataattatcataaaataattttaaaaaagaaccaacatattaagagtgggtatttggtgacagtgtaattatgagtgttatttaaaaaatttctgtatcttttttaaaaccaatgttatctatgaggtttttaaagaaataaaattaactgtatttgaaaacaaaacaaaaataccatcttaatattccactctctgcttattaccatctgttttctgcttacttgattcatctgtgagctgggaacttcaggaattaaatcaatatatgaaaacagaactctaatgacaaaaatttaaaagtttaataatgtctggtattggcaagaataagggggaaagggcacttcaataactgtagataagaatgtaaattgaaacagcagttagtaaactaacctgtcattgtctttcaaaattaaaattacaattaatccagcaatcccaattctcacattcaatcctagagatattctgaccaatatacacaaagatttcatgtatgaaggaattatctataaactagtttaaaacagtgaaggtttaaaaaagtaaaaattcaaatgttcttccatagagaaatgcctaaatatcagtatgttcaaactaaggtatgtatggtgtcactacaaagaatggcacagaaaaagctatctttaagtttttttgttacacagtaattggtaaactataatcttgactatagaaaaaaggctgtataagtattttatgtgtgtgaacatatttatagatatattgatgcctagaagaagaactgggaatttttcaacgccaaattattttagtggttatctatggagaacagagtaaattgatgagggaatgtatggtaaggggaaacgcttcacttagctagtttttgaattgcctgaacgtgttcaccaaaagtatgtatttatatattaaatacatcatgcattacaaaaatgcacatatataaacacacatacacattcacagcaatgtatagacacatatacattttaaacatgatcatacacaatggaaggttgtaaatatcaatcaaataacattctgcagcaattgaaatattattttgcagaagttccacagatttccactcagcattccacagtaagggtcactaggtccgcgtgtggtcagtaaactgcctatcttcttagggtgctactgatgccatagtccagagtctgccccttagctaggcaagcccaatgaagagatttggtagattttcagagggcggtttcatttcccaggtttgactgatatttactaactccataacagcaatgtataaaacaagaatgccaagttattgatttcctctgaggaattacctattacaggacatgaaatacttcccatgtagctctgccaatatggatgtcaattataatcaaatattacttattcatttatgatgagaaatttacttgttacaggaatgtgaatactcatatgcattcctcagtatctgtggaaattggttccaggatctcctggagacaccaaaatctgtggatacttgagttcctgatacaaaatggcttagtatttgcatataacctatgcacatcctcccatgtactttaaatcatctctaaactacttatatctaatacaatgtaaatgctacatagttattatactgcattgtttaagaaacaatgacaagaaaaaatgtctgtatatattcagagcagactcaatttttttccaattattttcaatccatagttgattgaatccacagatgcaaaacccacaaaaaatggggggccgggccgactgtatacataactggtctattttctccctccactctaatcagacttacaatgggaactaaatcttaatcaaaagagtgcatggggaacatggattctgaacaagaagaatgcatgagataaggaaatgtatagtaatattggcctgggaaggcttgacacccttatctcagttaaatgacctgcctccatctttacagtggggatgaagttgtcaagttcgctaagcagtgttcagaagattactgctaatatttgcccctgtgagtttcttttctttagatatgttaatacatttaagttctacaagcccaggggcctagctcaggtacttctgaaaagctctgctctgaatctttgcttatgattccataattcccagaaaataaattttgctacttagatgatcttgagcaaaagagtacataacaccatattaaacagatagcctgaaaaattatgtttatactctaactgcaactatataaaatatatataatgttaacaaaaactgaaggaaaatgtacaaatataaaaaatactttgagtgtggagaaacaataaatgatttttttctataaacttcttcagaataaataaatataaacattttaataaaacttaacattacaattttaagcaaaattgaccccatctggtcatatgatcaaagaactagtaaattattggtaaggtatttcggtgtttcctctgatgaatagtggtttatgggtgtggatatgaaacaaaatataaatgcacttaaaattacttcaatgtatataacaggctactaggcagaggcatgggaggaacatttacagtcagagggcaagttcaaacaagacctaagcagagaaattgtctaatggttgctcaagtagaaatgtttaagtgtggtgattcatgaatggtgtacacagaaatcagtgctggtaatagatagctagaaagtgctgttcacatcaaacagtgattactataaacctctaattatgtgctcttgagagagccttgtacctttcccactgtaatatctagttcttaaactggaactctacgacttcaattcaaatctcaatggcttcttagctgttaaatgtaggcttacccatgaataaccgctgacacaatcagctgtaccctgctgtatacaagccaactttgacaagaataatgagttttctctttgatttcaatgtgtaatgatggtttacaaaataaataaataaataaataaaataagactggcagtttgctataaaaatacttgagagggtactttgactgagccagagtttaacacaaatttaaacaatatttgtgccccaagaaaacaatcattaacctcatcctaattgtagctccattcacagtttagctaaatacctgggcagctgttttgtgttgagggtgggaccagagaagaggcaaaggggaagtctggaaagagagagactggtttaaaaacaacaacaacaacaaaaacgctcagctgtaagtcctgcaaaaattgcaaagtaatgggcctcttcaatcatatttattaagtccactgacttaggggttttgccctgttagtagctaagttatccacagaggttatttacattttgcagcactgaagtcatccactctgattcactaaatcatgcctgcacttggtatggtttctcctttgctagcttactgcaggatctggaagtgccatttacggctcagcccacttggctttccatgtccctgaccctttagtgagcaggcagtggaagaaagctgcactgcacataaagaacagctatagccaagcagaattagtcaaactgtggaaattagagtgaattttccccatgtctcagattggaagaaggaacatatgttagaaataaccagttacaatcagttttgccaaaatgagaaagttttagaaaattacacataaaggtgttatttctcattgaataaggggttcatatacccctttcagtgaactaaagaccaaagaaccaaagggaaggccaccaaaaagatggacatcctaggttcttgtcaagagcacacttactgtggttgcatatcccagtcctcagaaaggagttaccaccttccttcttgatggattttcctgctccctaaatgtctgcaaaatgatatagggacctcaagaccaagaagggacagaagtcctgttctcataaaaacttgtcatttttgtaccaggtttacacattcgctaacaattatttaactttctcagtggcttatttcaaacatctgggcttggaggatggtgttgcattcacaagagaacaccagtttttatcctatatcatataaactgctttcagaaagtaatgtaatttaaataaatgcttacagttaaaaaagttgcatttacaattaaaagagtgccattattctccaaatgtaaaaaatgatgctgctaatttattttattttatttttttttagagtatcaggggttgtttggcactgtactacttacatgtttttaatctttagtttttcttataccaaatatatactgaacaactgctatacccaggaatgtactagaaactgtggataaaaaaataaatacaattttctctatctgggatggaaattatgaaccttataaagtgggtaatattaaaattaaatcatttgtgtccaccaaatatgattttaaccctctctctatccaaaaataaccactacttagattggcagcaaattaatgaccataatggtctcattatatttctatttactttagtatggccaacagcagaaagaattgctcttaggcgtgggttccctctactttaataacagagataataaggcttttaaaatactgagctaaggaatattccaggcaaatcaacagatatggcctcattatctgtatgtcagaaaggagcccatgttaccctcttgtcatagcagtacactttctccacattatatgaaaaataatattcatatagcccctgaatataactgatataaaaaatgggtaaaataaattatttcatgaaatttccatgtttcttagttgtaagtgacctctgaatcttactgtttcaccagccaaatcagaaatatcctttaagtaaaataaaagcaagtatagccattcattcaatttttaaaaggctactccataccaaaccaatgcagtgtgcaaatatggaacttaattaaaatactatatataaaatattaacagctgctattaaaattacattaaacacccttgagctaggctaacctaatatgagctctattttttttcaatttaataaaggacagaacttggcttagtgaatgaactttggtttttatattgtttgtaccaattcactaatctgaaattttaatcacataaaagtactttaccatcacaacagcaccaagcatagtaatctgatctttccactggattcaaagaaaaatctcatgcttcgtttattttctttcttagatgcaaacaacacttccttagaacgtgtttctgttcttcccatacagaattgagctttgtaaattaaagtagatatcatctaattttgaccttctccaatgagggtacaaatagagtaattaataaactcttggtaatttggatgaattaaagagcttaaacagaaaaagtagattttattctgcttgaagattaaagtatttatctgataattaattagattgcatcaatactttctccttataataagaaacctcataaaatattcaaaataattttgttctctgtgagtatgtgtatatgtgcatgtgtggcatgtatgtacatatgcatatatatacatacatatacacatatacatgtagagagagacatgcacacatatatagacacacacacaatttacatagaagaaagactggaaagaaatacccaaaaatataaatcattattttcaaatgaataatgaatactttcctttttcttttatattattttgtatttactagtattttgaattaatcgtgtattacattcatatagttagaaaattcctcatttctaagtgaatgaaaagcaattgatttgatgtttggtgttttttttctcctctgaactttcagaagataaccgtctaatctgatatgggttgttttgtgttgttttgttgttttgagacaaggtcttgctctgttgcccaggctggagtgcaatggtatgatcacggctcactgcagcctggaactcttgggctcaagtgatcctaagtgtggggattacaggtgtgaaccactatttttggcatgttttgttttaaagtgctataaaatctgacttaaaatatctcttcttgaaagtaattttcaaaattttattctagatctatcttaagtcaaattataacatccacaagctaatatttcaaagcactacataagcccatgcccacgccacttcaaaattcttctgcttgaaagttcatatgtaccaaattaactgctatctctggcagagataggctggaggaagtcagaggggaacactctattattattgttatatttttgcattcccatcaatgaactcttctcagcttatttttatttttattttttatttttttttatttttgagacagtctcactctatctcccaggctggagtgccgcggcccgatctcggctcactgcaaaatccgcctcccagcttcatgccattctcctgcctcagcctcccgagtggctgggactacaggcaccgccaccacgcccgactaatttttttgtatttttagtagagacggggtttcaccatgttagccaggatggtctggatctcctgacctcgtgatctgcctgccttggcctcccaaagtgctgggattacgggcgtgagccaccgcgcccagcctcttctcagcttaaatcagaaagaagaggaggaggaagaggaagaggaagaggaagaggaagaggaagaggaagaagaagaagaagaagaagaagaggaggaggaggaggaggaggaggaggagggagggggagggggagggggagggggaggaagaaaaaatggtaattcaattccttgtagacttctttaggaaagtgagaatatttagggagacaaagtttccagagaggaatgaatcagaaacacagtctccaatatatctgggaatcagagtaatgggttctgaccttccttctctccacactcactcccaactccttctcaatttccatatattctatttctttattttgttaggtaaaaaacatatttccaaacaggcaaacacaatcttcttgatctataaacagcagaataaaaaaggaaggataagagggaagtagaaaatagttcagctgggagttaacaagtactgagggagcccatgcaaggagggtatgagcaagagagttcagccccaggtcttcaacagggcccttctgaaagaccatggttatcacagattactgagtctaaaagaagcactcagcttagttggttgggggtgggtgaagtaaagaaggagagtagataggtctaaatttagttatcttctattataagatcatttgatttatgtatgagtaggacaatcagagcatgggagcccggggtgaagggaattaaataaatgtagttgtatacttaaaacagatttctctctccttatctctccctgtctgtctgcctctttctccctctcttctctctctctctcttcctccctccttccctctctttctcaggattcctacaaatgtcatctctgcttcctggatgattatttcccctcaaagctcatattagtcaacatcctaagccccctaaaacactcccaaatttcagtgtaaatgtgatttcttcggagaaactttacctgccacctttacccctcctctcttagagaaataaaatgcagcaacaggaagcagaatgtttgctggtggaattccaaatacctttcatcagaaagggaagcagtttggaagggcagcagagctttgccactgtccttgaaatgctactgtattgattaaagtgtttttaatgccatagactcatcctaaagtgtgacgtgccaaactaaggattttatgtttggatcattctaatttttttttcatattttatatttgccacttcgggtacctccaaacatccaataacataagagaaaactgggaatagaaaaactttgaattttttcacttgcaaattcaagacaaaattttctgcaagatttggcacttgattacccaataaaagttcatttaagaagctattttagaagacatttgagcatttggggtttgatgcccaactatgataattaattagctctttctttcatggtgtgaaacagaagcaatatcaggcaatttcttttaggctaaagaaacaaatgcaggaagtctttaatatgtcttggttttcacttttaggaatggcatgggtgggtggggtgctccagcagataaacagcatagaaaaatgataagattacctgaccgtccgtctctctggaagtccacatgataccattctccatcattcactttcttcaacagggcttttatttttatagtacctgaccccatgtccaggaggaggtagaggtggccatctagcatctcaatagcaaagaagtccacctttatcatctgtgggtgcttggcatctttctgatgtcttggcttgccatggctaaataagatgaggccatttggctctgttgtacggaaatcaaatgatatggagccagttttctttgcattccatttaggcaaagagatgaaagactctggggtttcaaaggtgattgggtctaaagttgcaacattctcacatttaaatgccaccactccatggatcttcatcttaggatctccttgcttggcaagtcgagataattccagcctcacatcattatttttatatacaacctgtgggcagaggatagcagtgagaaactagcctccatattttaatatctgaaacttgtgaacagctcatgtaactttcaacgacatcataaaaaggcacacgatatttagttaattttgttgtataaaggcaacatttctcaggcaaataaaattcaagtgtcaattcatagaacaataaccataacaacttaacttgattcaaataatgtgtgtgcagatgcacccgcgcatgtgcatatacacacaaactgcttgtatttaactcaaataatttaaaaatctgcatatatctttaatttcatgtctacattaccatgctaagacttgaacttataaaagctacttgtttcatagttgtctatgatatttttaaaattaaatataagcactgaggttattcagttttcccatcattaaagcatttgaaattggataccattatataccagtcccctaaaatattggatctcttctattatctatatatctgctgtggatattgactttgcaagacagtcacaacaagttaaagcacaaaacagcctgacatttctcagaaaaaaaatatataactaagatacagaagatccctgacctgcatcaatacctttgaatactgttaagtaatgtggcactgccacatgtagaatatggtgcttcccctcaatttattcaacctgtgttactggtgatccatttcacttttaatttacacaaatgctgcgcaagggttgtcttgtactctcattttccaaggcacttcagtgaaagaggctaggcacttctgagtgcttactgatggtcctaaggctttttggattccaattaacacatttgataattcactgacagggttcacggtatcatacatttgctatcccttcacgctaataaattcaaaggtattttgacataaggataaagagagaaggacaccttttctctacaaaatgcatacagtggataatcacatttctaaaatacatagaccatacttacttgagggtgaattagttatctaggtccacatagctgtctaggctctttcaagaagggactctatagatttcaaagctcccaacattgctagactctagatttatttatccacatgtaaaaatgtacatatatatatatgtatatgtatacacacatgtatgttttgtttttcatttttcaggaatggcatgggtgttttatataatatatgtaacaggaaaaataagacagcctgtatctgattagcgctatgaagtcaaccaagacaacgcagcagttattccaaacccatggccaactgaaccaagagatggctgatgagtttcctgataggatttgttaatgaatactttatttttcagagtaattaagagtacatgctctggtattggacttcctgagttcaaattctggctccagcattaccgaactgggaaatctctgtaagcctgtttcactccctgaaaggaaaataatacttcacataatggttataacaattaaataagaaaatacacataagtgggaaaatctacataaaggcattcattccaatgccaatcacattgtaagatttcaataaatattaactacgtaaaatacatgataataaaaatcaatgctttatcatctaatagacacagattttaattctaaatttatccataggaaaacatttagaaataaagcccacacatataattggtttttatacatgatttgtgccaactaaataagtcacatctttccaatgctgggcctggtgtttcagtttacctttatcttggagaaggattataataaagaacatgatatcccttattctttgaacaaatatgtacaatggtttaacaagcatctattgacaacaaaagaagagaaaatgaacttgagcaataacaaaaaggaattacattaattcttaagaatacttttttgaaaagagaaagatctattaagtcttagaaaaatttatttaggattgcctttctttggagatctttagaggcagggaaaatgcttttcaaggatgattttccaagttttatcgcttctctctatgactttcatgctacttaaacctatattatttttcctttttcctattgatttatattccagcatgtggacattcttttgacatagatattgatcaagaataagtattttcagacccaaatgatgcttctcttgatcaatgctaacactcattcttataatagaaccactgtaaaagaattgagtgtttctgacatgaacaagtgggttttagccctggtatattgtctcttgaatctgacatcagccaccacaaagttgaagaatgaggggcagtctaagtctgggcaaggatttcaatgagacataatcttataactgaatcaggtgacttggtgatgaaaaggttcaggaagatgtaaaaaaaatagaagtagggataattccctgggcaaaatttcttaaggttagccatgcatctctcataaaaaaaagtatctccaccagaatcaatgctttatatgctttacactggcaagaaccttgctcaccacagcgcagcaccaagatcagtggctggcacagagtagatgctcaataaatatttgtttatagttgaacaaaattcttccttcacctttttaaacctagtttctagattataggcttttgtaaataacaatatttagacctataattaaaatacagcagaatatggtattgcggaccaatctcataaactaattactattttgccctatttctctagaaaaaagcataaacttatgtgcatatccagttcataattgacaagttggcccatgcattgggaaatttcatcttcacacacattttgtggggtataaattccttttagaacgaagaatgcctgagttaaaactctccagaggtttatacacaaaaatatacactgtgcttctcctcaacatagttcttgtaggtaagaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttcccccaatgatagcatttagaaagacactgaacaagttaactagaatcaataaacttgcaatgttcactactattttaaaaggaagtgatgaagatactttccgcatcagtctttcatgatcttgccgaaagttatctcaccataacttggggttaagagtttctacttcaagccagcagatgctgctaagaaaggcaatgcatgtctgctttatccaaaaaacttttcaatctcctgctagtttcaatgggggaaaagtagcactattattattattttattaggggaacctatcttcccatataccaagaaaatatctttgaactgataataacaaaatagtgacactaaatgatgtgtctagattaatcaatgcatcttcttttgtgtctccagcctcataagctcagtgaagtttcctccaccacttaattttacatttttctaaggaggcagacattagtataagtatataatataccatttagtatatgtatatgcatgtattatagatagattagacaaatatatgatagatatacgatagatagatagatagatagatagatagatagatgatttcctacagtctgtcctttcctcattgatctgcattgacatactatctattgttttggatataccaatgttcactattttaatatattattactttttgatcatgctcatcaattttaagctttgaaaaaaatttctccaagagagatgggataaccaaacaatttcatgtaaaatatttattacttgattatatttatgtgtgtgtgtatgatatatgtattatttttaatccactgaaaatatgttgtcttctgtttaaggtgaaaatccaaattgacttgctccacaaagagttagttatttgaaccagcacatttttttgtccttctttttcttacttcaacactcaggggaacacaatttttaaataattatttttccgacttgtaaggcctaccacatattaaattattacatatatgagattctatggctgagcacgctgttctgttttattgatgtttattttttcttgatctagttccatgtcacctaactgtcacagctttataatatattctaatgtgtgttaggctccttccaatcaaccaacccattaacattaattagcttacaatgtttatacgttataaacattataaacatctcatgtaatttcgcacgttttttccttatgaagatccgttaataaattaccaaaagatataatcagtttattcacttcaataaaaaaaagcaatcactgaatatttttaaatgaccataacttataaatttttttgtcttctgtattgacaaaataaatatacatcacaagttgctttgatctagctttctaaaacatagcaagttatacattcaaatttacttaaggggactttagaatagcccaaggaaattatatcttgctttgaattacattcctattattacaattatttgcaaagttataacgcataaatgagtttgacaattttatcatatcagagaatctggcctcatgccacaacaataatttattagttggaggatagatatacaactatagagatagattaaatcaggaagaaaacaacaacagtgaatgtagttgtaagtgcgctaattctattccaataaacacaggccctggtagagttccttgtaataaaataccaggagtaggtggccagtatataggagttatctggtaaatgagatgaattattctcagtgaagaagaaagtggagtgacctcagactccactttaatggtggctcttttctagaggtgagggtacttgcctgaggtcacactgctattgttcagagggagtcaacagtggacaagatggaatctgaatgtttgcctccagagcctgaaatggactgtttaatttattggttttctttgtatggacagtttttatgatggttaattttcctaaagcaataaaaaaccataggacttctatgcttcctcaacctgatgtttcaagagctggttatccagttggtggattatccaaactgcatgaatcccctttctttccctggctgcctgcctttactgctcaactgcacatccacctaagagcctgcaaacgaaacaggaaaaggtggcatttaagacagccaatgctgatgatgtttttagcaactgcaatgagaacatttttccaagtagacttgttcctgagaagttgtataagtttgttctgtaattttaatataatttgataaaaacaatgtgttataagatttatatttacatatattcaaacagtctcaggtttacattcctgcattgctacttaactacttttactgccttggccaagttgcttattcttactgaaataatttccctctttatcaaatgagattatgaaaacttattttgcaatgttatttaagcacataagtacttgatcctgggtacctaaataaagggtagtcattactgttgctattatgatcttaactgtgtaaggtcttaagggttaagatcttaaatgggtaagaggggagtgttcattatttaaattagtaagtgactactattgaaagcaaagatgcattctgtaaagtaatcacactcaaatcttgatgttgacaaaaatacttctcaaatttcgtaattttatctcatctctctggaactctacattttgactttatctgctaaacaaatagtatttttaaagtaatattttttattttaaatttattaaaggcatataaatgacagaatgagacagtctgtataatgatattaaattgatggaattatagctggatgcaaatacttgttttatttagcttatactgggtggactaaatatatggccttttctaggtttgctaaaatattgaacacatgtaactgttgttcatttctaactaaaagggccctaaaaagtatagagaccccaggttgagaactgttatttttcaattataactgctaagcagtagggtatttctttttaatctattctttaattatttctttggaaagtcccacatgattcagatgtcagatgggttgtgccttttgccaggggttgcttagttaactgtttatttaatgaatggggttttatgtgctactgaatttctcatggcacacgttagaaaatttttggcagcatttaaattggagaactgagaaacatattggctctacggaagctcaatcagctcccaggcaggtgcagagtttttgccaacaaaaattcagtaaaataaaaaatgcaaagcccaaattctcacacaacccaaagaaaactgactttggtgtccaagattaaatgaatgctagatccaggcagctcaggtagctcaagaatggaaggggaaaatgcgtcataactttaggagagaagcaggaatgggaccttcttgttttggtggatgacagtatgcatacatttttggattgctgagaaaattcaactaactcctaaaaaaaaaagaaaagaaagaaaatagtctcatgtaatttcgcacgtcttttccttatgaagatgtgttaataaattaccaaaagatataatcggtttattcacttcaataaaaaaaaaatcattgaatatttttaaatgaccatagcagtcactgagcatcctagaccaagtatccagatggctatgttttttaaatgatttggccagatatatagacattgtataagcattggttaccagatttatttactctgactgggaaccaaaaaatatcctgacatgtcttctgagttctgaaaagtcctaaatgcacatatatataaaattttactcagtagtacaataggatgagaaaaaacaatggaaaatatttttttttaattaaacactagtttgagaaaataaagatgagaatgtatctttcagcaattaaagtgaatagtaccagcctacttatcattactacatgactctccaaactgtgtggaataaaagccatttgcagtcatctcctcccaagtataactgtcatcaactcctcccgtcaatactctgcccttggccagaccatgtcccagcccttctccctgtctggaagggcaatgtcccgagtcaggcttgttcttgatttctcctctcctagatgtagtttctggcaatactggcttattgaagactcctgcattcttgggacaccagtggatattctttagtatcattttcctgctgtattcagaaatggggagggctgtgctcattagcacagcgatgctgacccgacactaggttggccacctcttggtggctacataaacacacgttcctcacttcaggcctagccaacttggctgtcttctatttcggttgtatgttgaacaagtccccagtagacagttcattagagttggccagctacatccactttgcccctaattgcctttgattagcttctacgttgcctggtataattatttttttttaattgagatggagtctcactctgcacccaggctggagtacagtggcatgatctcagctcactgcaacctccgctgcctgggttcaagagattctcatgcctcagcctcccaagtagctgcaactacaggcacgtgccaccacgcccagctatttttttttttttttttgtatttttaatagatacagggtttcgctatgttggccaggctggtctgaaatgcatgacctctggtgatccgcctgcctcagcctcccaaagtgttgggattacaggcgtgagccaccgtgcccagccatcatgttaatatgaatcattacagcacccaacagcaactgtcaagcaccttctctgtgtcccatgcttgttgaacaacaaacttctacgtctcatgacagtcttatgaagtagacatttttatctccatactaaagctcagagaatttaagtattttgtccaaattacacagtaactaggtgactgagcagggatccaactcagcttttatctagcttgattccaaaatcacagatgcgattctagtgcatgctccccaccccatgggatagtagctgagttcctatttacttattcagccctggttctgggcacactttctcaatctcatcatcatgcctttcgtgtatagaagtaaagggactccttatcccttttctctttttcgaccaagtgcctcattaactagctgtggttctcttaacactgctggtaaaaaataatattaataataataatcccccttaggtttcatcctactctctttctctcttgatgtcaggataattgtttttctcctttctgtcctatgcactctgatttagtgtcacacttgttttgtgctcacttcactcttaggaccaaattaccagactacattttaagaaggtacaaacgttgttttgaatgttaagaattctttaagattttctaagttgccttgtaactggagaataaagaatgaggtttaacactaggatgaataacattcaacacatcagttttcaggggtctagagttagatttgatgattacagcctcctgtagtcaataagagaagagagatgtactaaccacacgtagactgggaccatttttttcattgtaactgatgaagcccaaaacagcagggccagaacttgggtgaggggtcaggtaagtgagatactcactttggaacaaaatataaaggaggatgttaaatctcatatcacgacaaatatttcaatgaaatatttttaaaacttaataagaaaaagtccacaatgaacaaggtattcaaattttaaataaagatatagaatctgatttttccttttgcctcaagctccacaatgctttggtagagccctgcaatacaatattattctaagattaatgaactccatttaatacgttggaaacatatttattaaaacaagtgcaagtaactagaatagtgtgggggtaaatttcatcattagatatcattaaaattagaactagaatgcactactaatttttaaggtgtaattagtcattaaaatcacttttattcaaaaataatgacgaacacagagtgtttagtcagacattcttttaaccactttactcatataatcctcatgacaacctgctgatatagtagaaaaggcccactgctacagaattcccaatgtaatattcattaaaatacaatgtctgtggagctgtgcagcacagtgcctctcataaaattagggtccccatttttcagaagaaactgagctcacatagtaagtaccagaatgaaatttagacccagacagtccagatacagagtgcttgttcctaaccatattatagaaacaaaccaagcctctcaaagatcaagtaatgtagcctatttctacctcaacctctgtgtcactagacctcaaattgcaattaacttttaataataatgatcctaagaaactctccaggacactggactagacaaagatttcttgaataataccccataaacgtaggcaaccaaagcaaaaatggacaaatgggatcacattaagttacaaagcttctgcacagcaaaggaaacaataaacaaagtgaagagacaacccacagaatgggagacgatatctgcaaactatccatctgacaagggattaataccagaacatgcagaagtccaaacaactaaataggaaaaagtctaataatctgattttaaaatgggcaaaagatctgaaaagacatttctcaaaaaaggcatacaaatgtcaaagaggtatatgacaagctgctcaacatcactgatcatcagagcaatgcaaatcaaaactgcaatgagatatcaactcattccagttaaaatgccttttatccaaacacaagcaataacaagtgatggtgagaatgtggtgaaaagggaaacccttgtacactgtttgtgggaatgtaaattagtacaaccactacagagaacagtttggagtttcctcaaaaaaactaaaaatagaactaccatatgatccagcaacccactagtatatatatacctcaaagaaaggaaatcaatatatcaagaatatatctgcattcccatgtttattgaaacactagtcacaatagccaagatttggaagcaacctaagtgtccaccaacagacaaatcaataaggaaaatgtagtatatatacacaatgaataattatttatccataaaaaagaatgggattctgtcatttgtaacaacatggctgaaactggaggtcatattgttaagtgaaataagccaggcatagaaaggcaaacgttgcatgttttcacctatttctgggagctaaaagttaaaacaattgaattcatagagactaaaaggatggataccggggcctgggaagggtagtgggggttgggagaagtggggatggttaatgggaacaaaaatataattagacagaatgaataagttctagtatttgatatcacaacagtgtgactgtagtcaacaataatatattgtacattttaaaataactaaaagagtgtaattggattatctgtaacacaggaaaggataaatgcttgaggtgatgtataccccagttaccttcatgtgatcattaggcattgcatacctgtatcaaaatatcttatgtactccataaacacttagtatgtactcagaaaaattaaaaataaaagaaaataatgaccccaagagtagattctgccataaattttacagaaaccagtcaaaatttgttatatatattatatgtaatataaacacatatgtatgtgtgtataatacatatataatacatatgatgactcgccattgaaataaccttgagagtcactcatactaacttaagaactgcaatccatctctgatattcacccgtctacaggccaaatacagaaactagactaaatacctaaggtatttttataaaattgtgatggatactaattctgcagctcacaggcattgaaaggccaattgaattcagacccctggccctgtcattaacttctgcaggtgtataactggtattcttgtatcagacagccaatgtcatcaaaatggaatacaacaaattgttatataaaacattttagctctccacattaagtagcattataattatatgatgaaaccagagcactgtgaaggattataaaaaagattaaagaattcagaataaacacttgagaccttgtctaatacggatgctctcaagtaactactgttgccaattaacgctgctcatatacatgtggatttctgattatctggtttactactaaattaaagagcaaaaaataaaaaataaaatctctaatgcctctactgtagaatatttctattgatattttggagggatctataagaagccaatatcaaagcaggaatgtcttttagaaacaagatagatcaagcttgtctcttgagaacatgttattctagagaggaagaaggagtaagacatgggctggcagcagagtactgggggcggggggaagaatcaaagacagagaaatccagtggaagtaaagtatacgaggcctttatgctacacaaaatggtgggcatttccatagcactggtacacaggttggtgctgttaatcataccttattaattgctattagtaatctcatttagaattaatttcttataagtatcgtaaatccaataatctgctccttcctccttatgctaacatatcacaagagaaaaattttaccctttgtgaatttagaggtgttttcatgactagatgacttattcaagttagcactttgtgtgaatctttgctttgctgtgtggttgagtggcagaaagcaactgtaagcccaggagctatgttgacatgtgtctcactggtcaaataaggaattagatatgaatgtgtataaattatattaaacccatccagactggaggaaaacaacctatttgataacaaatttataacatggcagtcatgttatatatatataacatagcaatgctcatataatcctgagtcttgttaaaataaagactcaaagtgctgctacagactgtaggatatgatttattttgatatcaaagtgttttccgcagcttggttacctttgtgatttggatcagggaaaggtgtgtaccctatcaccttaccctatgctagatagatgtaaattttccacagaaagaagtggtttgggtagtcactcagttactagattcagctgtttttgaccaagccacaagaaataactcagtaaacaaaaactctttgagaagcaggtctaagtttaaatcccaaatcagaatgcctacactggaggaaaaaatcagtttttactggccatggctttagctataggcccaaggatctgtttcttggagagtctagttgataccaggaaggagatagtagttaaaattaatgcaatataaaatgtttcccacagtgatgcttaagtgaacacaagaacaaccctaatagctgattgcttcagaaaagtaaaatataaatggtcattcagaacaacaggtttgcacaggagaagaaactcagtaagtcacgagtttgaagaattgtattaagtttcctgggtcttaagaagaagtggcttctacattcttagacacaatgaggatgaaaagtttgaggttaaacctgtgtattttcattctctgtcaccttaattactcaaggtctcagtgtatttttgtctagtgtactatctctgtccttgttgtttcttgattctcctacccactgaatctatggctgagcacatttgataagtgtgtagttctgttcagtttcggatctgctaagatatttttaaagtacatagtgagatcataaaatgagatttttttttttggtttgaaaaattttgggggacaaataatatttaaaaactgtcaatgtttccacatttcaacattagatgggaggtgcctaggaaccatagagtatattgcagaaaagcaaataactaaaatgcctcaagggaagttcctgcaacacagagaaaagaaaaccattcagatgcttgggggaaaagcttagaaaaagggaaaaacaaaaagaggcagctggggtggccttcctccccaacagagctgaacctaagaacatccagataaaaccagagtcagaaaatactggtgttggttccacattcatggggaactctgaaagcctctcagagtaatctcgatttttggcagggtactctatcagtcaaggcctaggagtagatgtggtaattgcagaagggagttatattagagaagccccaaagactctggcgggttgcagagaagtcctttgtattttcaggtggacccagagaaaacaggaggactaaggggtcagcagaggtctggagctcacgcaaggagtcttccagaatcttgagcctgaaggcaaccacaaaaccccatgtcctgaagggcatgcacatactgtgcccaaacaaccagccaggtcattttctaatgcttaaaacatgaggtcaataccagacaggtgataaatatgatgctataccaaattctgctgccagaaatcctctccaatgcgctctggataaaaagatatattaataattatactgttttgttttttaatgtctgatctagctccttctgtttttgcaagcatacttcttagtggtttctttcataagaatagacttatttagcccatctaatatatgaatgatttcaaagttaatgttaacaataatagccatcactgattatttccaatatgtaccagtcagtatgcattgcagccattatcattaattgttatatcaattctctgatgtaggctttttctatccccattttcagatatcaaaagttaggtaactttcctgaagctgcacagctagtaataactcattccactgtatcacaccaaattacaacaaatgatttctaacaagtgataaaccctgacaacctctgagaacgaaaaggccagagaattagaagttaataaaacttactttatttttccctattcaacatttgtattcaagattatttattttcttagtggtcaaaacctactaggtactagaatgagggtcaaggtattgagacattttgtttctagtttcagctctttcattaattgtgtgaatttgagcaagtatctttattgctttttcatctgttcagtcaggataacaactgcctcattttactctcagtattatatgtatttctagccttgtcttaattgaaatacaattggataatatgcaatgtacttttacggtgagttaaaaatgcattattatattcacatataaaattatatcagtccaggcatggtggctcatacctgtaatcctagtactttgggaggttggggcaggaggattgcttgagctcaggagttcgagaccagcctaggcaacatagcaaaacctcatctctattaaaaaaatagttggacatggtgatgtgcatctgcagtcccagctactcaggaggctgaggcagaaggatcgcttgagcttgtggggttaaggctgcaatgaaccgtaactgcaccactgcactccagcctgggtgacagagagacactctgtctttaaaaaaaaaaaacggaatctaaagtcaaacacatggatctctgcctaggtctcagatgaaggacctggatgggaaaacatctcatttctaagtctatgtgggagtggtaacttttaaattaatttataagaaatataaatgtattagaaggtataaggttaactattagatagttaattattagaacatttcagatgctaacaatcaaatatgatatttttatccatattacaaccaagttaaggtaagaaatgaaacagcatctcattggggtggaatcccaaagagatgtaaacctgagtagtttcaaaatatgtgatggagaatttgaaaatctgcgcttatagattctgccaacagcggatggaagatatttgaaaataataataataataataataaatacaataataaaatgatacaaataaacaatgcactgtaacaactatttacatggtatttacattgtattaggtattataagtaatctagagatgatttaaagtatacaagagaatgtgcctaggttatatgaaaatactacacctatttaacataagggacctgagtaactacaaattttgccatgtggatgaggaggggtcatggaaccaatccccctcagatggttatatcatataacaaacatatgtcttgttatttgtgttgttgcatatttaagaagtctccaacagtttttcccaggactgggttttaaaaggccttaatctactgataaaagctttgtgcttaccctaaaaagtagtcctcctttacttcttttctagcatgtcaagaaagaaacacccaggaagacattagacaccctatgcatataaaaatggcaataaaagaaagccccaaatgccatctaaccaatagaagtagaataaattggtgggcattttacattcacttaaatatccaaatgatttaagaggatgtcgctaaaaattggctgatatattggcttttgtaaaaaaaaaaaatctgaattgaaatttggatatgaaccaaaagcttccgtcttcaaggacttttcaatttcctccagtttgcacgtttggaaactgaacggttcagcatatctctaataaaaaaatcatctcccaaggctcctttcctatgcaggcaaaatcaaattaacttcaaacagaagaggtgagatgcatacatagaggaagtatcaaactctaacatcactttgctccagctctctaaggtctcctaacgtctacctaggagagaaatccaaatgttaacttcacccaagatcactctgaaaaatctaaagagaagtgtggcttccaaaagagaatcatactaaattaattattcccctatgctgtcaggatttgcattgacaacaccatacggtagtattctggacttttacttaagaagtgatgacagccaacaagattccaggctccattcaaaggctacaaattgtgcggcacccttgccttgctagctgggcagccatttgaatcaggggattcttgtgctttggctgcagaagttgaaatgatgctctgtatcgtttgagacatgaactgctgcgtgcacaccacacaacgtcccccagcaatgatgcattgcactaatatgctctcagagcatactcactgggatgtattagagcaatgtatcaccaaaacacttaacttacaggatgtattgccacgtgaggtggaaatggttgccaatgaggtgttttaaagataatttctaaagttgtgtattaaatgatgtttatgtcacctttctggtgatttggaagataacattttgagattctgttatgcttgatctttggtattcagtgccttttccccctcacaaaagcactcttattgcagatcatttttaatcggaaaactcagtaattgagcttcacctaagtgtgacacaaaatgaatgaagtttgtgtgcattgctgtgcaatcagccctgaaattcagttgtgggcataagccctggtgctgggctgcatcttccccagggtgggcgacatatgggctagcagtaggccctgggcagaaaacatgagagccaggtagggatgctccctagaggcagaaagctctctctgcaggcacctacttcctctgttccaatcccgcataccgtttaatgacaggctctgtattgctatagttatgtgtgccaaagaattctgatctctctttttattgcctaattttattagataaaaggatggagtaacattagaaaactagcaatttacaaattctaaaaatagatattagagtttctcttattatatatatttttcagattggctaaaatatgttgctggatacccatttcataaggacagagtccacatctgttttgcttaccatttttccccagtacaccatgtctgacttgtagaaagtgttcaataaatgtttattcaatgcattaatagtcatgcttcccttttacagtagagctatttcatcacaactttttctttggaggcaaagcatgacttctttcaagcagaattgccctctctcgtaaccagaaatcaaattgcatctaataatgttacatcatggcagttacttttgaaagagttgttctaacctctagaccttgcttaaagccaacctaggatctttataaatatttatttataaaaacatgtgaaaaagacagcagggagggggagaaagaaagaaacaatgtgattattactagtatttaccagtgcatttaaacttcactagattcatttgaaaatatgtttccatacacatattttcagaaaagtctttattttgtaaagagatatccacacatatgcacatagttaaagctgcagcagtgactacaaatagatcagaaaaaatcatatatggcttatacaattagtgttctcatgtcataatcatattttgtatactgcagttttttagttatggtagtgacaaatttcctggtatatttcctcctcagtaatagattttttttggcatttttgacagtgtcatatattctagtgtccaatataaaacaaaacaaaaccctataattcctttttatagttgcatttcaaactaataccagtgcattcctgattctcttcctattaaatcatgtttttactcttttttccccctcatttcattgtacatcataggtctccaaaatagctttgattttaagctacctaaagaaaaacatttttttacttgtaaattcaatagcctctctttcattaattaccagacacacacaaacacatacatacccctcttgaaaatgcttccagttctcttttatacattctatataaaatagatgtaagacttgcattgccaaggctgaatttgttcgtatccagctgggtcagggtataatatgatggcagctccttttttaaagcattgtcaatttatatttctcctaaaagatggctttcctgacctcccttttaactttctcattctcatccctctggctttttccctctttacctattctcttcccccaacctcctctgtggttaagtagctcttctttggggctttaattagtaaatactgcacctctatgatgtaatttattatattcttgctaatcttttctgacattttaatgataagctcctggtcatcagcagccatattctcatccaaaacttgtatctatattcccactatggcaagtgatagactgctactatttggttgtgaattttctgaaccattattacgttttcaaatctcagcattttttcacctaaagatgattcttggtgagacgcttcacatgcagaaatcaatgaataagtaatgtaagctgagagacaactctgaaactattatggggacgtaaaagattaaattagaacattcattttttgtcctgttactggcacaaataaaatatttgaaatccaaaagaaaatgttgttaatctgtaaatataaaataagtctcatcaactgtaatagataaatgttagctgcatatacactagttgtctaaaaaaaaaaaacaaagattactggcaaaagtatctaattctatgtctcattagacctttatgattgatttcccgcagtatcactgcacggcagcattccatattttagttcctaagatcacattatatatggaattccagtttttctttgtttcacttatgtgtttagctgaagaacattactaagtactttttcaacctgcggccaaggttaacaccgtgtaaaaatgccaataaaggagaatatactccattatatctattgttatgatcaacaacttgggacatatataaagaaaattctgccataatacatttagtcacggtaatagtacctgactgaaacacacacacacacacacacacacacacacactaaatggtatgtcttttgaaaggaaataactaaattaaagtcatagcaatccagaatagtgatatatgtgttgggaagcccaagtttttaggagatggaataaattgttaaaacagttactaaccaataattttagctataatatgcaataatgtcatctaattatctttttgttggagcacttgtgcatagatagatactataaagtctgacgtgagttccttaaattatatttaaatgtagattaaaagctaggaaaattgacattcagatttagcaaagaaagaatagtattttcctactataatgttacaaaaccattaaagactacaatttggtactgctcattccacaacaagttgttgcagaatattatgaggacacaacggccctgaaaatcttcatttccaatattaaatccaatgctctagactttcttgtgctttttgtttttagagcccttgaacaaaactaaacaaactttcaatttctcttaaatcactctttttgatttgttcatagcaagagcatagtgtcttggactccggaaaggctcagttccagaaagtccacataggaagggttaataaaacaacgtttgataggggtacttaggaggattcttttgaagctgcatttgtacagcaagcccataactttttaaaaaatttgttttgaggtcatgggagattcatatagaattgtaataaatagtgcagagagatcctgtgtgatcattactcactttccctgaatggtaacgtctttcaaaactatagtacaatatcacaaccagggtatttacataaacacagtctacctatcttaattcagatcctttacttttatactcatgtgaatgtgtgtagctgtgcatgtgtgtatttaatttcatatcattttatcacatgtataggcttgtatatccaccatcaccatccctcatttttaacagtgtatgttataataaattaaaaaaaatgctaaagctttttaatttatattctagatctagatagataaaaagctaaagctttttaatttatattctagatctagatctagacaggcatgagatataaatcattcatattattattattttgattggggtcactggaaaggcattgatgagaatattacatgaacgaaatccacgcctccccctacaacttgctctcaacactgagggcatctggggttagacttcaattagataccatgtaaccatcacttcttacctgcagcacacatttcattttcagatttattttcccttaagctgcatttcctattttgacatgcttctctacagaaatcatccaagatattaatattttcttaagtcatatgatcctaatcttaatgtcataaaccccatccacaaactgtgggtagagcgaaatgaggcgtcttgttttgcaccagtttttaaagcagagcaagtgctttttgggctacaggaccaggaggaaaactgattattagctattgttttctgatactaagtctaggatgggattgattacattttgtacttttattctagaggtgatgtgactaaataggaaagcctgtattagactcctaaggagacaaaaaagccacaaagaaccctaatctaatttagagtgtgatgcagggcatggtggctgatgcccgttatcctggtacttcggaaggccgaggcaggaggattgcttgaacccagtttgagatcagcctgggcaacacagtctctaccaaaaacaagcaaaattagtcaggtgtggtggcatgtgcctatagtcctagctatttgggaacctgaggtgggaggatcgcttaactctgggagattgaggctatagtgagccaagatcacaccactgcacttaagcctaggaagaccctgtcttaaaacaaatacaaaaataaaaaaatatatatattttggagtgtgagtgtagaggaagtgagttgggagttcactgtataatgaatacagcaagattcacaaggttgcattattgtcatccagctttttcataaatatgcatgtaatatgaaggtgaatctagtaggagaatatgacaatcctaccactggaaaaagcaattgaacatcaggtgcatccttgtccgagatctacataagaaagatggcaatgtcactaaagttatcatgaaagggttatattttctgatgggggattcttcagaagaatgttttcaagcagcaaggagatttttctgattgaaattatttatttgctttatttcccttcttgcacaatcttttcccatgaggtttgagaacaggtcttattcttctttatatttccctcagattttagactggctagttacatgaaataactattcaataaatatttacagaattatatcatgcctaaatttcatatttcctgaagaaaatgcacacccatattttaaaagaaaacagaagttggaaaacagacctgcaaattataaactcagaaatcgatgtcatccaatgtatgatgctgggtctattttttaattttagctccgttgtttattgcaagcatccatccttcctataaatccccacacctacatccataaacaaagctagctgaaacccacagcgatctgggtttcaacgtgtttcaaaataaaatcatttaaaaatgatcagacattaattcaacacattggtgttaattaactaaggtctgaaaatgtctataattatttttagttgttacttgattaacatagagaagtatatcactattattttctctagaaataaaactgagtgggacagattatgagacacttctgactcacctagttctccaaaagatgctggaacagagagctacgtatgaacaagaaatgtgtcaagtgaaggaaggttggaagaaagtagaggggtatatgctggacaaaagactactcaacccagtagtcaacacattctagatatctgaaaactgagttttccctctcctttgtggcagtctggttcaagagggtattgttctctctccactgcttgtctcctcataaatcatctgagcagaagggcttatttccatgctatgttcacagctactataccgtctagaacactactgggtctaaatacatactaatgaaaataatggagagaaattaaatataagttgctatagtcccaaaagaactcttagaatatggccatacacatgagtaaattaccttaatcgaaggtaatataaccttgaaaatgtaacaattcctttaaaagtattaaaaaatacttttttggaggacaatatactatgctgagacaaatcaacagaattatgagttttggatttgacattcagcattctcatttacatttgacacctataaaacagaaatatataaatttatgaatacacagaagttccctaaggacagtgatttttgtctatctgctgtatttcttgaattctattgtctggcactcaaacatatatgctgaatggatttataattaaaaataaaaatgtttggctagtgaaaatatcctttcttggcctacagttttcaggttaatgtggcagcacctcgtatctatgcatgccaaaaccctaataatgataatccaaataataacactcatattgctattcccactttattggatagcttatgtttctctcttcaaataattaaaactcaaataaattaaactggccatatttcaccatccctcagattcataggtaatataaaggataaatcagtagcccagtaagagacaactaaaaggttgaatttattattctttgcaaccaataagtatgggctgagttcttaaacaagagttttctgtgataatttttattaggtgcaaagggaactaatgaggagaaataggtttaaattgaaggtgagaatttggagggatcatgagaaagaatgtcatgatgatgacagaatggtactagcaagagtctttggagtcttttgagagtgtcaaggacagagtgggcagctacctgttctggacaataagacatctagctagaaatgatggagccaaaccaggttatctttaagagctcaaataaagtaactgatttatccaagagcatacagttacttagaggcagatccaagactatatgccatgtatataaactaggtgcgcttggaaccatgggctaggtcatggtggagagtgacatcttaaaaatgttaaaaaagctatgccgtatacatagtaatatttcactctagtacatcatcacagagagaatatggcttttctgacataaatagtcataaattagtgaaatctgtttgagaacatacaagccccctgttcgcaccaatttagttttgttaataaccgggaagatttggttgatcttcagaaagttttcttagctgcaggattagcaaaaggattcctcgctataaattgcagctttgatttgaaatattagtttaatagatggctaacatctttcagatcctaaaaataagtaataaaaaattactttgcagggcacaagggctcacgcttataatcccagcactttgagaggtggaggactgctagagctcaggagttcaaaaccagcctgggcagcatgccaaatcctctcacctgtggtcccagctacttggcaggctgatgtgggaggttcgcttgagccagggaggcagaggttgcagtgagccgcgactgtgccactgcacaccagcctgggtaagagtgagactcgtctccaaaaaaaaaaaaaaaaaaaaaaaaaattatttaccaggtgaaagaaagaaaacagaagagaataaaacaaaaatagcaaagaggaaacaactacgaacagagacaggggaagccactagcaaaactagcacataaacataggctacgtagcatctctgttctttattaaccacactttgggatctgccagaaaaaaaaaaaaaatcaaagtaccttatatatttaggtttgtgtttatttctaaaatacttatatgacaaaagtactacctcatatcaaaatattaaaacagctttgatggcttccagttcccccgctgaaccatatggtttcagttgggtttcagttgcccatcaacccccgcaatagctatcagaaccagtcccacgtaccttacttcacagctgtcactcacttgcaaaaattctaatgtctaatcacagtacacttgggttatttccctaaggaacccacactttgtatatattgtctctctccctctctttcttctctcttttctctctgatcccattattcattctattcattcaatactttcacctcccacctagttttttttttttcttttagagacaagttctgccgctgttacccaggctgcaattcagcggcatgatctcagctcactgcagcctcaaactcctaggttcaagcaagcctcccatttcagcctcccaagtagctgggactacagacacctggctaattttgtttttaattttagtagagacaagttctcactatgttgcctaggctggtctcaaacttgtgagctcaagagatcctcttgcctcagcctcccaaactgctggaattacaggtgtgagccaccacacctagcgcctctaccttttaacctgattaacctactcacctttcagaactcaggtacatcaaagctaaaaaccgttccctaaaatcctcctctgggattcttacagcaccaagggtgtactcctatcatagaatgacaatgaactgttgcatttgtctccatacctgccagtttccacaaggaatgttacatttactgaggttagagactacatcatgttaatttttgtatcttactgcctagcacaacactcgatatataggggtactcatctaatgtttgaagactgagtaaatagccaagatttattgagcaccttctgtacccgaagtggtacaggcattgtactaaggatattatattcaaggttcacagaatctatcaattccttctcccaatctagaattttctttgaagaccccgaccagatgtcctagccctcaccatcttccaactatcaataattagttagccatgcctctggcacatgcaaaaagtaagatgatgatacacaaaatattaacataaaattattacaagtatctcttccactgtatcatgtgcttaaaatccctgatttctattcctcaccttgaccccaagtgactagtgatgagctggacatttggttggagcccaataaatgtttgttgaatcacaaccatggaattgacaagagtctagtgatctttttcctcttctaaccatacagaaagaaaaagtctacccagtatactgcattaatacgtccttgaaaaattctgatttctagtttgggcctcaggatacttttgaaggagagtgaagaggttatgtctttgaattaggagagaaataatttcaccataaatccccaaagataatgggttcaaaggtatgttgccctaagaaagttattttatttttgtttgaggcaagccgaaaactatcccttcaactcaatatgctaaaaagatatccttcaactcaatatgctaagttgtttgtgtggccatatgttcctatatttctaggtcagtcttgatcaaatacttttcttccatgcaccccataaatacacttgtactcatcagcccatctgtcctgctttccttggcttggaaactgtggtcattgaaaaagttctatttattccctaccaaccatctatctttttttatgtttaacaattttaaaattatttacactccctttctgaacaaaaggaataaatgggcagctattggcaaagaagataaatatgatgagctattctatgttgacatcaaatgacttagcaaagtgcaagtggtggagcaaagaagagcaggttttctcctcatagtttaagggttctgttaccttaggttggtaaaccaaaatgaactggtcttggaatgttcaaggtcagtattgatgctgccactatagtttggtatgctggtttaaaatgctgcaaccacagtatatctacatgaatgtgatggaaatatgagagttcacagtatatctatatgaatgtgatggaaatatgagaatctcagccccatgtagaaatgagaaggtaaatgtatcccatacacaaaataaaatagatgaataattctgggatgttctcgagtgtggcatatagtcactgacatggtcactgcagtttgatgctgtttctcaaacttgagtcgtgcacacaaagttttttttcataaaaataaaagttttaggtccctaagaataaatttacatacctcaccctcttcccacagatcctgagcattctgatttgaaaaataatgtagtagtagtttagcccatgaattctagtatcagatctggattcggtgttcggtgtgcttagtaaccgcaaaacgttaggcaagttaacctttctaaacctcagtttcttcacatgtaagaccgggacaaaaaaaccactacccttaagtaaaataagccagacacaaaaatacaaatattgtatgattccacctatatgcagtatctaaagtagtcaactccagagaaacagaaagtagaatgatggttaccaggggcttgtgggagaagaatatgtggtgttgtttaatgggtgtagattatcagttttgcaagatgaaaaagttttggatatctgttgctcaacaatgtgaatatacttaacgctaatgaattatatactaaaaaatggtcaagatagtaaattttatgtaatttgttttttatgattaaaaataatacatgcccaacaggattacaagaaaactaaattttaaaatatgaatataaagtactttacctaatacttggcaaagtcaatgcactttataaatagaggctattgaaaataaagcaatcaaaattttcaaaagtaataagcacacagaaatttctactgattccagtaaacaattttcattccctagtcactatttttaattggtttttgatggggcctcagtcaagaagagcagtgtactcattcagatgattcattcatattgccaacttcagtgattgccatgaaccctgttctttcagtgaagcagtaagtggtaacttgagaagtgccagcctcctaagaggggtcactgagttacatttggtcacatctactcaggcattctggtaggcaacaaccatttcaaaaaacctactgagcagagccacacagattttctttcttctggagaaaatgggctggtgacatgtctgttatttgaagcaagaagccaaagtccttctcaaattgactcccactcttacctcgctgatacatcctttctcacttaatttgctccatctacattagcctttttcagtatgtctgaaatgccccaaacctacttaccctccagggtgtttgcacttgctgttctttctacccagaacgttcttcctcaatatagccaaagggatcaccctcataccttcttcaagtttttgctcacatgccactttttcagtgtagctctctgtgaacatcttataaaaataattgccaccatcttcttcttctggcccagggacatgtacttaattatttccacagtaataacagccacagataaattatatattttaaaaatttatctagtgtctgtctccttccagtatagtacaagctctataaaggtaggagtcattttcccttttgttccctattgtataccgacctataatagtgtctggtataaagtatgcacatattaaattttttaatgagtgaatgtattggtgcaagccttattcaatatattaaaaaaaaaagtagactaatcaaaagtattctccccacaaaagaaacatctaagaaaaattagtggcttcacaagcatacccttattaagttattttccattaaactcaagcccttttccagttcagtgagaggtcttctgtttctctaccattaccctaagtggaaggggttggaaaacatagaagctaacacctcaacagttgttgaaaccaatttgggaatgtagaggtacaggtagataaatgtagttaataatgtattcatttacaataatacaaatttcctgttatagtaattagctttatgaaaatattccttagattcctggtttatgctagaaaataaaatgtctataaatattattatatttgccattggtgtcaatacatggcttctgttttgtattaggaaagataatttccaaagaaagaaaatactagaaagaattcacaacagtgagacacaaatcctgagttccaatgcaatcttgtctctacccagctccctgaccttgggcgagacacaatcttttggtgtgtctggctgtaacagttgggttttgctgcaaacctacttaactccagtgagcctcgatttcctcattggtgaagcgagcataagaatccctgttttggccaggcatggtggctcacacctgtaatcccaactctttgggaggctgatgtgggcagatcacttgagaacaggagtttgagaccaacctgggcaacatggtgaaacaccgtctccactaaaaatacaaaaattagccaggcatggtggtgtacacctgtggtcctagctactcaggaggctgaggagggaggctcacttgagcccaggatggggaggttgcagtgagccatgttcaggtcactgcactatagcctgggtgacaaagcaagaccctgtcttaaaaaaagaatccctgttttccctattgcagaaagttgccttgtaactgaaaaccaagactcataccatcggtgatatgctaggtgaagttaagtggttcaaaaactgtatttaatttctgaattatagttatttggatgtgtacttggagggaaaaaagtataactagcatattaaaattgtaaatatatgaataatatttaggatgagattaatttcaaaagtaaattgtttaaatgtaaaatattaattaaatgataagatagagaatacatatatatgtctcaattatgaaagtgatatacatataaatggggtttgtgaaaaaaagcttgaagaatcaatgttgatggtttgtgaattttctttccaaagttaacagtacaagccagggtaagatggtatttatatattaagacaaatgcaaacaaaataagatgaaaataaatgtaaataatatgaagtattatgattattttagtaagaaatgatcttctttgtgagtgcctattatattctaggcactcaataagactaggcattttatctgttagctaaatgcttgctagcaaactgactgcaattgagttagagcaagttgattgtttcctacatcatacatccaggccataaatccagttttgctgattctagcctatgttctaggagagttaaaattttagaaacagcatccagaattcaataaatatatgtttttaaaaaaccaaaaggcaaattccgcaaatgaataagctgctttttttaacatgctcctgatggctccctatggcaatactgtggaaaaatagaatctgagccttatgaacaggaaataataaaaaataacattaaactaaatagtaactgtgacactgggtctttgacagagctcaaagattctgcacctcatgaaatcatatattttaatgggaagtgtgtagaacatatacagtgtgtataaacattgtgacagtataggaagtaactaacaggaactctagagtgctgaatgtctgactcctccgacttcatccattactgaaaaatttgtaatggtaaaaacgtgccttcagtaagttatagtatttctgttctagtctgttcttgtctatttattggctttttggagtttacctagttacctattttctctgagtcttaattttctcagattaattagaaattagttatatttcatcattagatatctaatgatgagtttgctagtacaatgccggttagactacccacagtgaagaggaagatgaaccctacggctcagagtaccgcggcagatcatttgatgttacttctgtgaagcgtagcaagtcaactaaatactttgacgccagtggaaatggcgataattatagtagcggaggtgaagtaggctcgtgtatccacgtctatccctactgtgaatatatgatgagctcatacaataaatcctaggaaaccaattgatttcatagctcagactatgcccatatacccgaatggttctttttttccagaatagtatgttacgatatgggaaattatcccgaagcccggtaggatgagaatatagactttggggtgaccgaagaatcaaaataggtgttggtacaggatagggtctccccctccgactggatcaaagaaggtggtatcaaggttgtggtctgttaataatatagtaatgccagcggccaggactggaagggagaggaggagtaggactgctgtgattaggacggatcagacaaagaggggtgtttggtattgagatatggcagggggtttatgttaataattgtcacaatgaagttaatagcccctagaatggaggagatacctgctagatgcagggagaaaatggtcaggtctacagaggctcctgggtgggagtagtttcctgctaaggaaggatcaactgtccagcccgttccaggtggacatggctcactgcaacctccccatcctgggctcaagtgagcctctctcctcagcctcctgagtagctaggaccacaggtgtgaaccaccatgcctggctaatttttgtattcttagtggagacgtttcaccatgttgcccaggttggtctcaaactcctgttctcaagtgatctgcccacatcagactcccaaagagttgggattacaggtgtgagccaccatgcctggccaaaacagggattcttatgctcactttaccaatgaggaaatcaaggctcactggagttaagtaggtttgcagcaaaacccaactgttatagccagacacaccaaaagactgtgtcttgcccaaggtcagggagctgggtagagacaagattggcactggaactgcaaatgcctatgatttgcctgaaaatagaagggagggatctaactattgtctgtttcctaggcacgtgcaccctcattagactgtaagcaccacatgaagtcagaaaccattaggttttattcactattatatccttaatacctggaatacagcagatttttcataagtatctgaatgaatgtatacacaaatgaatagaatgtatttatggaacacctgtcatgtgacaataactgtgtaaggttcattgctcaagtatgaagcatagtaaaataaatgaagacaatatgtaagttttaaaacaccttgtaaatgtaaaatgctacaaaagcatttttagagttttaaaaaatcatttacttacatgcagttttaaatcacagccctcaaataagttccaagtcagagattttatcaagattgtatttacttttttaaaaaatggagttttatgctgctgtggttatggaatgtgcttgtacaatatatatatacatatacatactgtttgatgtagctctatacaatgctgcttctttataatattgcttatgaactattttgtttaatgccactgcgtctatgaaacattatagactattctgttagtatgcacagcttttcccatgaccttaatacctttatatacctaagcaatgagagtgtgggagaatgtattgcattcccctggacaactaacattaactcactgttacagacctaatatgtgtgccccctctccacccatattcagatattgaaatcctaactcccagtgtgatggggcctttaggaagtgatgagctcatgagggtgaagactcatgaatgtgattagttacttccctcataaaagagagcccagagagctcccttacttctgctatgtgaggatacagcaagaagatggacgatcatgaatcagaaaatgggccctcaccagacactgaatcttccagagccttcatcttggagttcccagactctagaactgtgagaaaccaatatttgttgtttgagctgcccagtctatggtatttttgttatagcagtcagaatggactaagatctcaacatactctaaatactctcagcaattggctcaccatactctaaataatataactccctgccctgattgaaaatgttatgttccaaacacagtctcccccactgaggtctctgtcttttattaagtgttttaacgtagtggttgacaaaatatatacaaataatattgatcaacatgctgcaaagaaaaaagaaagtgcccacagcactccaggggttcaactaacaaaccagtggggagatgaaatagaatagagctggttctttgaggtcagggactgaggcttattcaacattttatctgagcttgttgtttattcaacattttatccgaacttggtttctagcatgtagtaaaatgtctgatgactcgacaaaggaaaaaaaaaaatagatacctaacataagaagagctattagtataaagactctgaagctgactgcctcttcataattaggacagtcaaggaaaattctaccatacactatatatcagatagatagatagatagatagatagatagatagatagatagatagatagatagatagatgtatactagtcaggcctttaaaaaaggacagataatgacctacagaaaggaaaaagtaagccaaacaatgatagtgatgtaaaaaaatgtgggtcccaggaagttctgagttatctatttttatttatcataatgcctatgatttccttcttctttgaagtttcctcacatcttattccagttctcttctctgctattgtgattctgtccggtttcagtggctcttcccaagggggctgacgacagcgaggcctctgtgctgtgctggggaggagggtgacccctatctgggacagcacatggttctcttccctcagtggatgctgccaaagccgagcagggaaatgcgccccagtgtgcatgctaaatacaagttaggcgcccttcagcgaagatttcggcttggcttccttcccttggctattaagctacattcccacaaaattactacatgtctgaggtttctaaaaccttttgtgtggatctcaaacagttactgtgttggatccaaatttcgaccttggttaagcaagcctcaaatccgttccaagctgctccaggcagtgatgctccaaggacacccgatgcaaggaggagataagaataacctctacagcttggtgatcacctactgtgtgtcagtcatcgtgcttcactctttgcatgcggcatctcatttaatcctcactataaactgtgcttgctagctactacgactactctaattaccactaatttacagatggcgaaatgacagtttaaggaaattaagaaacttgttcaagttttacaaccaataattattaaaggattaaaagtattgaaaccctagcagtagacttccacagttggcaagggccagggcaaatgacaccagagtgatctaaacagcctgagtaataataaaagccatcaatccagcacataaactgcctgcactctgtgcatcccaaaagacaaagagaaaagtagtaggccatgtttctttatgcatctaggtggcaagtctatgagctgagagacagtccctctgtgaggagaaacagaagttcacaaaacagagggcagggaggttctcttagcttgtggcaggcaatgagtcaggagaggtaacttttggaacagagcttgctcttggcttagggagtaaaaagtgaaaagacttccaaggactaacaggttctctccttacacagggtaatgaaggctatcacactcagggcttagactttgttgatttatagactttgtaatctattgcagtgagcttgactgttttgattctttttttgatacaggtatctagttcaggggaaaagatgctcagagttagaacccttgtgtatagtttgagtatgtggttagcgaaagcctagagaaaaaaattttgggaaaacaattttgtccaagtgcagagaacaaaacttgcattacagcaccagcagcagaaagcttgtcataaagatggggaagtggagcagtttcccagagcactttatttaggaaggcctcgtagccaaatggaccataatcaaggtggtgatcaataattactactctaaaaagcccctggcataggccaaatgaacctctctttcctctcccttcaccttgatgctctgctctcaatcactacaaaatgaaattctcccagatcagagtctgtagtttttgtgaacaaagtcattgatctctgatcgtgtgttattttttgtgaaacttataaacttaagcatgattaggtgaatgaatactgtggcgggataaataaggttacccaatcttatgtaaatgcacaagaatatgtttggagcatattttcttcattccagtcagcccagctccacctcagtacttctgcattgacaaatgaattgaaaatgaacacatggagtctgtcatctagtcccagcagggaactagtatgatatacttaaagggcactgaatttacaagcatgtatatttctctcatatttttctatctttagaataatataaactgtgaggtataaaaatatggtaattcaacttgtctctttgatactatcaattttaaaagccatcaaataagaagatttagatgaagaaaaggaaaacactttatgaatcaaatagactgaaatgcaatattatatttggggttctatctgatccctgcagttagtgttcttacagagtagattttgtggattaattgtgtgatgctattttatttgttgcttgcaaaggggaaggtgatcaaaattcttttgacttatttaaaaacatctatatattttggccacgttttaaagattaaacaagtgttttaaatggcacatgatagttgttattacatccaacatatctaggctgttaaaaacatcttattgtatgacatatattgtaaatgttaaagaaaagtaactatcaccatatgcttacagttgcatgaggatgatacccttgataccttagcctctgaaaaggtataaaaaaaggtaaaaattgtaaaaaagaaatatattaataaacattgatacattattttgaaattgacaatctgaaacaatgatataaacaaatttgattttgcttggcacttctccttcctgctgccatgcaaatgaagaaagacttatttgcttcgccttccaccatgattgtaagtttcctgaagtctctccagccatgctgaactgtgagtcaattaaacctctttccttcataaattacccagcctcgggcagttctttagagcagtgtaagaacagactattacagatataatttactacatatcacaactatagatattcccatacggaaaatgtatatttgcatttttaaatgtatgctcgcatttccttggttttgtggttcatatttggtagtgaggtatatcagtcatatggtcatatttatgtaaactgaaacctaattcatatgtttctaagttcctgtgccctaaaaaaatcaacatgcacatcagcactgtcggggaacctttaacacctgtaggcgtaagtatgggtgagtcatagaggaagtcatttgctccagattattaaacatggaagaaagacctcctgataactttattacacatgataacgtgtgctaggctaagagagagtcattaaaccaaaaagcaaagccttctaataaagagctgaagctgaagggaaggactaagaaatgtctctttctaaggcccatagaaatagtataaatgtgttgtgtgctacctaatcattgaagaaataagatacatttaaattttagttattgattctattcacgctaacagcattttgaatcctataaagagaggacaatcctggggacttccttgttttccctttttgccatctttcaccacagcgtgtttttacctcttgtcttactccatcctatctcaacaccaggggtgactctcatactgctcagggctaatcactccacgatgctttaaatccaactcatttattcattattcatattgtgtcttttgtccacggtaccctctgagcactgagaggaattctaaaatgaataagagttgacctctcttcttaaaaaaaaaaaaaaacaagcaaaacaatagtgaaacaccagagcggagatcttatctgcacatccagattgggaaagctggtatgttggggtgcacaaacatggggtgtgtattgttatgaggacatgtggccacctggaataaaatagtaaggagggcttttgaaatgatggtgagacctcagtgtgctgagtataagacactcgcccaagaaagaggagtttttcttaggctgtgacctgatttgacagaaaacatattctgggttttggaagaaagaaagaatttgttctctggttattattattatttagatatgagatgccttgatgttatgcaatttttctctgtactacttttttgcaagaagtggggcatgctccaaatcccttgattatgatttatgggccagggtaaaaaaaggaaaaaaaaaaaaaatacccacctctcctcctactccagtttgacccttcccctctacctttgctccaggtgagagaagcactaaatcacagataagagccagagtaacatttatagcattgcaaagatgccacggtcagcatttgaggctatgagtgtggcaagtcctcccggacagatagacctgagattaatagaaacggatcaaagacaagtacccaggaagaatgattccaggaagattggaagggctgcctcagaaaatgcatatcacttgtaattctgccatagaaagggagaatttgaaggcataagtctctcaggtgttttttgactaaagtcaattatgactttagtttctactgccattattatctatgttccttaataattctccaccagttctgctgtagcaaggagaagtgagaaccaaaatgctaaaacaatgcaaaaaataagcaaaagctttaatgtaagaataaacactgtgttatagaggctcttatctttccatcagtttcaacttctctctcctaatggcttcccaacaatgtcttggttatttcctctaagaacactaactttgcataagcatatatattcctagctagagtagactggtttcatgtttgttttgatggcactgttatgatcaggcatcagaagcttctcctcagccttttacttcttccagcaacagtccttctctctctttttgctcatggccaactttctaagaaaaacaaccaaataaaaatacattgcttctttctcttcttcacccactcttcataacctcttacaatctgagttctttggataaatatttttttcaaagatgcttccactaccttccactaccttttctcagatcgttgtcctttctcagatcttctcttttataatagttgtctacatcattcacgatctatcccatgttattaaaaattgctgtgttttggagcatcttctatgtggttctttgttgatgtacaccatttcaaaatgccaaaataaccctttgttatcctactcccctttcacagataaatcacattaaaagaaattatgcaatttgccaaaactgctggacttacgtttggaatagaaatgtctaattccagatctctgactctctccactattccactgtgtctagacagtgatactgtgtagttcacagtaattttattacaactactagaagaaagggctcagccaggtcaaaactacgaaaagctttgtatatagcagaacagatggtgaggtttgcccgttctcccttggagaagggacccatctgtctatctggcttgacagccttcaggagccccacctgacatggacattcagtagggatttccctagtctgcctggaaaataaaatctatttggattgctcctcaggtgcctatgaggaacgtgggaaaattcctaggactttttttttttttttttttttttgacccagtctcgctctgttacccaggctggattactgtggcacgatcacagtgcggtataacctctgctcctggactcaagcaatcctcctgagtagctgggacaacaggcacacgccaccatccagttaatatttttgtattttttgtagggatggggtttcaccaggctgatctctaactcctgggctcaagctatctgcctgcctcagcactcccaaagtgctaggatttcaggaacgagtcaccgtgcccggtgggacatgcttcttaatgaacaaagtcatatggagggtcttgtcttgaggagggacatggctctgtcttaggctttagttgggtctctgttatagctagctcagaagagactgaccctctagccatatcacaataccccaaacctttgaatgatgtgtcagcagggatacagtctctcttatctactactacagcagcctgaggatctactttcaaggttctatctcaccctctccagccataaggccccctctcaagctgtttcctcttgtgttaactgtcattcagctagtgccctaccctgggatacattcctttcctctgatctcttctcttccctgtcttatcttcataccttcattctctaaagtgggtgcatctcaatgtcctgatggttctggttttctcccacgtctcctcattaaacttcccagaatgagcatggcatatccaaatgttcaacacctcctccatgtgaatggctcctcatctctcttctgagaacctgttctgcattcctctttaactgcatgtttctgaagcactgcaaaaataggttttcttgtttgctgctcggcagccaacacacattcagaatgctgctcagtgttcaataaatgtttgttaagcaaataaatgagtgagtctaaaaaaatgatttgagtctccccctgtctgtcttcattaccttttctgataaaatgcccattcccagcggggcacagtggctcacggctgtaatcccagcactttgggaagctgaggcaggccaattacctgaggtcaggagttcaagactggcctggccaatatggtgaaacgtcatctttaccaaaaatacaaaaattacccgggcatggtggcaggcacctgtaatcccagctactcgggaggctgaggcaggagaattgcttgaacccgggaggaggaggttgcagtgagccaagatgtgccattgcactccagcctgggcaacagggcaaaactgcgtctcaaagaaaaaaaaaaaaatcccaaaagcctcaatacctctacccggtgaatttacagaacaaataaatgaatgagtccaaatcaaaactaaattttgcctgcccttatccagtactcttcctgccactgcactgacatcacagcacagaggagggaaacagcccttagaatcacattgatttagtttgcatctttgttcagtctcttaacaggatgcagccttggaaaagttacttagcttccttgagcctcctctataaaaaattaaaaaaataaaaaataaaataaaataaacttttttaaatcagaaataattactcttcaagtttaaagactaaatagcatgtgtaaaatgccccaaagccatttatacacatacttataagctgtaatcctaactctcctatatatgtgtgtatatatatatgtgtgtgtgtgtgtgtatatatatgtatatatgcgcgtgtatatatacatatatatacatgtatatatgtatatatgtgtgtgtatctatatacatatatattcatatatatgtgtatgtatatacatatctatatatatatacatatatatgtatatatacacatatatatgtatatatatatattttatttttgttttgtttcgttttttgagacagagtctctctgtgttgcccaggctggagtgcagtgctgtgatcttggctcactgcaacctccgcctcccaggttcaagtgattctcctgcctcagctgcccaagtagctgggattacaagtgcccgccaccacacttggctaattttgttttgttttgttttgtacttttagcagagacagggtttcaccatgttggccaggctgctctcgaactcctgacctaaagtgatccactcgcctcagcctcccaaagtgctaggattacaggtgtgagccaccatgtctggccaactctcctatttcttttaaagatacatcaactacctcatttaacactcacaaaaaccgtatctgtagatacttttatgtctccaccttacagatgaggaatcagagggactgagaaaatgacttatttgcccaaggtcacaccaaaataaaatcctaggcagtattactacagagttcatgtaagaaatattcttagattgcaagctcactaagaaagccttataaaaattcagcccttacaaaaatgggcaagccacaccgctccaaataaattgtgcctttagaaggtggtcactacttactgaagtaataaagaaatatgtttacctgttgaaatctgacttctcggttcaatgctcaactattttagaagaaaatttgtatctctaacaatgccaaatgcagaataaatattcttgccttgaaaattatgatataataaagaaaacatacttgggaatgtttttccaaagacataatgagtattgcatgaaagaggacttttaagttaaagtgagaaacagaaataattcaagggaaacatgctttactgaaaattatataagtcaatatcccagaaaccaagtaacaatttattcgtcagaataaggaatacatgatcaggaaatttgtctggctaattgaagttgaagaggttgcacttgatgaaaaggaaatcatcagaaacgcctggatgtttcctataagaagctaaaatatgcattataattccagctgtggatagaaatttaatgcatttttacaaggtacaaagggtgaataattgttttgtcagttgatggggtggattttagttattttaataactataacctaattgaaggaaagcagaatggcatatcagaaaatgggggatacaaaaccaaatggtggaaagcaaattgattgcttatattagaaattaattatatattaaactacccagagttctagataaaattaggaacaaaaataatattttagaagagatgtgtctgactagccaaaagcaaggagaaatgcagaatgtcactgaaaatctaaaaataaaagcctgaggtaaagtgattatttcctcaaagaataaggatgcacataatgtatcataatttcttaattagagttctatgacaattgtagttacatccttccagggatagatatattatgacttgcaaagtttgctaatggctgaaaataaacaaaaaaaaatagaaaaatttctaggtaaaagtagttaagactagctttttttttttttttttttttgagacagagtctcactctgttacccaggctggagtgcagtggtgccatcttggctcactgcaacctccacctcccgggttcaagtaattctcctgcctcagcttcccgagtagctgggattacaggcgtgtgccaccatgtccggctaatttttgtgtttttaatagagacggggtttcaccatgttgaccaggctggtctcaaattcctgacctcaagtgatccacctgcctcagcctcccaaagtgctgggattacaggcataagccatcacgcccagccaagtcttgctttttgggggcaaggaatagtaataaatgtaaaagacctgttttatggaccctggaacagctcatgactttacttagaagtttctacagaaataactaaagaatgacatttctccaaaaccagttgaagaactttttagttagatgatgacagacaagaaagtcaaggttaatttgagatatgctggtagaatcctaagatcattaaagctctggtatgaataagaaaagagaaaatgacatgaaggattctgacatttagaaaactagcaatgggaaaatgcctttcacattctaagtttatttgtgaattaaaaaaaaatgaaaaaagaagtattgggttatgttgtagatgcttctaccaatatggttattattttattaagttgaagatcttagtgaattcatcaaggatacctgactgatgagacatcttggcaaaaaaaaaataataataatttggaagaagtcacttaatctcactgtgccttaatttattcacctatttaactacagggtttatttccctaaacagtatgatatatactctttatattttttctagtgttaacattttaagcttatggaaaaacatgactacctacgagaaaaataaaagtaaattaaatcagtgtgttgtgaagatcccatgtgtttcagcattcatcagactgaaggcagtctccaaaacatccaaacagggtttttgagaatttaactcttggatctgttcttcaagtagtataatacgtggtttgacatgcatgctagacacctgtttttcaggatggtaccaaaacaacagaaattctgatgaattatgtcattcgagttatcacaattgattattcaaataactctccgtaattatgatcttgacttctacaatgtaattataagaaagtcagttgttcaaagatatccaaaatgttcacccttggcaagcgatggatgggaagagtggtgacaagaatctgaaatttgaaattaacctgatgtatttgtaagtttttcctaacaatgttgccgtccattaaggactgtttttagtggactttcttaagcttgtatagagttgacctgaaggatttaaaaaccatttcagtttattcagtgtttgccatgtatgccatacacatcatacactggagtacatttaaatatcattaaaatgtaccactgcataagacaggtctgctccttccttgttctaaggtaattctgtttcatgggttagtcagacacaaaccggtgttatcacacagaactgtcacgtatttgatctgcaatgttcaccggttacatggagctaagaaatatacagaagctaatagagttataaagagtctggaccaagaatcataagacccagttatgagttgttaaaagtgagggtgaaacatgtcccttcagttttctcattttaaataagactaaatgatctcatcttttttattttctttaaaattttaaggccttatgcaaaaggctgaaaatctaaatggctaagatttaatggaatccataggatttcaatgagatttggaaaattcatcaactatgtggcacagaaaatacagacagcacacatgtactatattctgtatgggatatcaggaccaaaacaaaacaaaaaaaatcaccatccaggttgataaatggaaaaaagagggtagagatctcttcctgatacatcctcagagaagattttggcctccctaaaaattccactgaaagttaggtgtctctaatgttcatttttcttttttttttctctcaagcttcatagagatcctctatatttaagtttcagttttgtttatctttaaagatctcttcactgttcagaatttcttttccagaatcaacaatcactttccaaaaattgctcttatttttaaattttgtacattattttttccatcaagaaagatgattatcaaaaggaagtttccttccttccttccttcctttttctctccctttctgccccctttgctcccttcttcccttcctttcttttaaaattactgatggctcagatacactttctattcttcatagaataaaagggaacatgtattctggcaaaaaaggaaacagactttactgacccagaaaagaaagcatgttttgaatctcatccatctcttccactggcattttaatgtcctcccataattacacactgcttgcttagcatgtgtgatcataggaccaactacagggatggcttctcactctttgatttatattctttaatggactccagccctggggccagcagagctagaacagaagacgcagtctgcccctgatatttcctggtctttgccaagagtttgcagtcaaaaactctcctagaaatcatttcctagagataatcattcttaacatctatcctctggaagagatctctcacctgttcacaagcaccatacctctcagagaatcaaacaattatttaaaaatggactatgaggcaactgcacacagagcttatccatctacctttgctagaatacagagaggcatggagcagtggaagcatatccagtattttgaatttttaaaaacatcatgtgttttgatcatataccctatgactggactatgggaccagcttcaggtttaaagcagtgaagctgtttgatggaaacctgtaaaacttaatgagaatgctgagctctagcatcaaagccgttggctggctcagaaaggctgtggggacgtgggcagaggcagacttttacatcttgtgctgcttcttgataatctgattcttggatgctttgcccaactttacttaaaaggggaaaaagaaagaaagaaaaactaagcaggcagataggaatctctttcaacacacttttttcttaaatttgaagaggatttggtttgttagtttgcttttgatcaaggagatggtagtggtagaaaattcttgtctctcttacctttttggaataactaaggtcacttagtgtgatatgctgggacccctttggctagatgacttttcagtaagaactttaagaaatttatataaaaatgttttctgtgtttgcaaccacagaacttaaatattattgtagagagggaccttaaggtacacagagattaatgctttcacttgaaagatgaaaaccctagtgctcatagaagttgaataaaatgcattgcgttgcactccacatagactggtcaaccttgatcactgggtagtctaaacgattaaagactgcatctcatgaagccagttttgttagttccttcatgcttccgaccactcaagctccccactccttttcactttaatctgaagcatatctggtttgattgctttgtttgggcagaaatatgtaaattttgcttgtgtttgtattttgtattcttctttctccaaaactgtaaaaagtcaccttaattctacctttgaagaatctctacactgtatctcccactggatctgtttcagtatatttacatggaggcttaggctcttttgatcatttattcctataaaatgctgattctatgcagagttttctagaaatatccatggcagtgaataataaacagcagccttgattagggtgaagttgtttcccttgcatcatttgcttctgtatcaccttatatttctgttaaaaatgcgggtctactgttgaatcagaagcaagggggacatgaagctgcagtttaataagctctcagatgatgcttatgcacaaaactctgaaccactgacctacagggtaaaacccaattcctttcctgcagcagtcacatcctgtcattactttatccatttcaacatcatttatccaaacttttatccagcacaattattgacctcttttccccatgcatcttttctccagacacactaattccagatataccctaaacacatcatttattattttacacctgcaccttttctccaacttttcctgtctcgactcttatctctatttttgtttacttggtgacatactacttttcgttcagtgccatactacttttctcaaatgttacctccttgggaaagccttttcctaaatatttctcagtcaccatccctatactgcgttgcaatagaatgtagcataaatctctcttatagaacctgtttcatttgaatgtaattacaatgaatctacacaaaggttatagaatacctactatgccccaaattataccattaaagaaataaaagtcacaatctctaccatcacaaaaattactatccagcttttttcaacccaaatcctcatctgaaacagagaaaacagaaaggtatttgagtatttcctcaattctcccaaggaggatacataactagcaccattacatacaacagatgtcttagggctttagggtttcatctacttgggaaaccccagttgatcaaatactggtaaaattacattacagtagcaataaatgctatgatagagataattcaaaggtgagatgaaaaagcagaaatatctaattgagtatgtgtttatctctcctcaaccatgtcttaatcctgtttctatgcttatttagcatctagatcagtgccaattatgttgtggtcattgaatacattttattattgaattaaaggcattgtaattcatttttattagtgtgactctttggaatctggccgaggcaatgtgaattatccatatttgtaaatccagcatctagtcagtgcttaagatactgttggcactcagtgagggcttgtagaataaatgaacacatttggaggagttgccctattctccagtagaaactcaatagcaatgacaacaataacccaattaaaaatgggctacggacttgaataaacatttcttcaaagaagaaatacaaatggccaacaggtatgtaaaaagatacccaacgtcagtaatcaccagagaaatgcaaattaaaactacagtgagatatcacctcatgcctgttaggctggctattattaaaaaagacaaaaaagaaaaaaacaacaactgttggagaggatgtggataaactggaagctgtgtacactgttagtgaacatgcaaaatggtgcagctgctctagaaaacagtatggaagttcctcaagaaaataaaaatagaattattatatcatgcagcaatcccacttctgaatattcagccaaaaaaaaaatgaagtcagaatttttaagagatatttgtactcctatgatcactgtagtagtcttcacaatagccaggatgagcacacaacctaaatatccattgatggatgactggattttttaaaatgtggtatatacatacaagggaaaattattccgccttaaaaaagagaatcagccaggagcctgtaatcctagcactttgggaggccaaggcaggcagatcgcttgaagtcaggagttcaagaccagcctggtcaacatggtgaaaccccatctctaccaaaaaatacaaaaattagccaggcatggtggcataggcctataatcccagctacctggcaggctgaggcagaagaatggttgaacccgggaggtggagggtgcagtgagctaagattacgccactgcactcctgcctggccaacagagtgagactctgtttcagaaaaaaaaaaaaaaaaaaaaagaaggaaatcctgcaatatatgtcaacaagaatgagcctgaggacattatgccaagtgaataagccagtcacagaaagataaatactgcatgattccacttacaagaaatatctaaaacagtctatgtcatagaagcaaagaatagaattgtggttgccagggcctggggcaagggagaaatggggagttgccaatcaataattataaaatttcattatgcaagaagaataaattctagagatctgctgtataacattgtgcctctacataacaatactatattgcacatttacatatttgctaagtgggtagatcctatgtgagctgctcatacaataataataataataataataataaaataaaacttctttcatatattagaatatattcatttggctagatgacatagttatcttttcccaagccacccatcaattttacagtcagttcttccctctcagtaagattgaaaattaaagaataataaagttttagaattgaaaaaagtgatagttttaatttgaggatcagaagtaatacttaaagaaaaactactaggaatgcaaaattcttcctttgtggttaatctacatttataactattccacttgacatttaattgcttcgcgtgttatgtgtatttcaaagacaaaaagaaagagtttattaagactgcaaatgaagtgaaaaaatgctgcatttttctgggtggacagtaggggtggtggtggtattttcagtgttattgtcatctaacgaagcctaatttagtttgaatatatattttggaacaaatagcctccaaacacaaattcagtttaggggaagatagtgtgaaaagggataaaatgccataaaattctgatgtcctaaagaaaatgtgagagtctgggacacctccttgttctctgcaaagcctgccgccagctcacttcagacaaagttgtctttttataaacatgatgtaagcatacactcacaagctctctggaaataatgatgtttctacttgtgtcagttaaaggcatccctttgttcatctaatcaccaagaaaatttcaaggcaggtgtgcttcagtttagagaggtgccgtacttcatgggtgcctctaagggactctttacaaaattcatgctgcagaagcagcattcccctaaatggttgcttaagactgcaaatccccaactgtccaatttatatccaaggaagagtttactttctttagggcataagccattatattacaaagtcattaaaatggaaataaatacataagttagcaaattgtggtaaggtaaaataatcttatataaaccatggcctaaaaataaagaatatatacagaattcagcatgaggatattaccatacagaaatgataattaaccaaagtaaacctgcacacagtgattttctgcattttggcaagtgaaaaatttttgctatgaaagcaggactctaaaaatcaaaaaaaaaaaaaaagtaaaggagacctagttttgaattgatattaaaacacacaggcattttactttaatggtcatgggcttaggtccaactatttcagaatccaaagcttattacttagatagtcaacgcacatcattccaagactgcagctgctcctaatttggattgttaggggattatccctataagagtcctcatggctcatctgccctcagtgtaatcagatgagaagatcctgacttccatctccagaaagaaggccaagcccacctggggcctgggggtaaatgagaagcccacatgggtaaatgagagcttctgtgggatcttgacaccgagatgctgagactccaactgtaagcctcagagtcactactgagctacaaatcagcagttttacatttattatttctaaaatctggatttgagttgcaatcaaggtatatcctgatttagattaattggcagtgtttcgtgatccataaaataattgtgcaccaatactgccaatgatgacaatataatatggtggttgacgtactctagctcagtgattttcaaactttaatatgtatattaaatcacttggggatcttactaaaatgtagactctttcagtagatcatgggaaggggcatgagtcttttcatctttaacaagctcttaggtgatgcacatgctgctggttcacatccacagcttgtttagtaaatctctaggtatgctatgagttgttcatgggctttatttccttttaaactacctaaaaactacagcttttagttacatgtccttgtttaaaaattgttcctatatcttctatgtagctttatatgcacatattgttaaacagataataaaccaaataattattaaataataactaaaggtaatgttaatgaaagattggtttcaatccttgatgatcacaccttatagcctggataccttggggaagaaaatgttactgaataaggtcaatttactctttcaaacaaacatttcagacgctcatatgagactctgcttggtttacaggtagtgaacacaggcagggaagactaattgcttctgaaaaataatgcgaaatgaaatctgatgatgacaatgataacattcttaagaactaaaataattacttgtatttgaactataaaaattaactgactattcccaattcagttcctttacaaggtacccatatttaaaaaaaaatccagtttcttatttatctctaccaatttttgatacattagatagtggatgtcatcatttaggatagcaaaatggaaagcacactgggcttggagtcaataaacagaggtttccttctgacttttttcacatattagggatatggctctgataatattatgtatgatttgtggtctccaagttaattcaattttctcacaaagctcttagaacaattaaatgaaacaacttttaatatgagacaatgtgtgcaaaatctcataaattcatctgcaaccaggacaattcacatatttgtaggggtcagtgtaaaatgaaaatgagaagccctctgttcaaaagttattaagaatttcaagatgacaagaagaagatattaaatgaagagcagggcccttctatgtgtggagccccatgtgactgcataggttataagtccatgagaaggccctgtctgcaagataattgtagctaatcctcactatattaatagagtattaataaagtttatacttgattgagatattacaatataccaggcactactctcagagcctcaattacatagtctcacttaatcctttacaggggaaagaaactgaagcacagaaacatcaactatcttacctcaggtgatacaactaccaagtttaagggagccaagattggaatctgggagtgtctgattctaaagccattcatcttaactaatttaatgcaatgagttatctataaaaagttattgttattcctgtttaattcaaatttagaaacctaggctcacaaaaatacgtccatatttcaagggcaattcacttactatgaccttgattaaatgacctatgtcaacctaattgtcttatatccctagtactccacagagagcctggtacatagtccattgtcatgtactatatataaaactaaacactcagtcaccaatttttctgtgcacagaatatttactccacaaagataaaaatctcattttcctattattcaaaatcacatgcttcggaataagagtattattttcatttaaaagcaattaatttgttttaaatgtgtttcaagagtgatgattttcctggggaaaaaaagacaccaattaacatgcacagaaataatttccttccaaacataaggactttgatccaaagatctaaagacaagagtatatcatctcataatagaaattaagaggaactccaaaatactcattttgttttggatgaacttcagatttttaaaaaatatggctcaaacttagttaagtaacaaacttaaatttatatgaaggtgtttttctttttcttagcaatgtgttttctgatccttcatctcattttatctttcctattcttttccaattgtgatagtggaactaattcactgagcttcagtcccatacaatatcatgcccagtatacaactgagcagagagacaaactcagattacttgattaccttgtctttgaaattattactaatgtcctctgcaaagctaattacagcttccattgtattattagagaaatttttcatacctcacttaggaagcttgtattgtaaatctatacttatttgcccaactctctctccagattcctgagtgcattatcttactcatctatgtgccccagtgtctagcacagagcctggcacatactataaatagatacatatatatatatatatatatatatatatatatatatctgtacaaaacagaatagccagatcacttagcccatatactatagtcattactagaacatagcttgtaattatatttatatatatatatatatgtatatatatacacacacacatacatttatatatattttttgagacagtctcgctttgtcatccacgctggagtgtaattgcacgatttcggctcactgcaacctctgcctcctaggtttaagcaagcacgtttcactaattttttgtatttttaatagagatgggatttcaccatgttggccaggctggtcttgaactcctgatttcaagtcatctacctgacttggcctcctgcagtgctgggactacaggcatgagccactccacacctggcccatactagatagttttaatgttgattaacataatgcacacatgcaagtgttaatgcataagcaaatggagcaatttaaacaagatgctctggtaggtgctgaaattaagagaaaatgttcagtctcagacattgttcattgctgctttctactgggctgaaaaatgtcatattctataaaatgtatcaagtcctcagaattaaaatgtcactgaaccccctgacagaccatgctatgctagcttgatatttgaaagcactacaattcattatgccaactgctgatactgttccaggctatggggcatctgctgaaaatgatgggaaataaaaatctgtgggtcccctggaaaggaaagattctatgtttgaaaagctgaattccagacaagaactcaccagatgctttgtggactgaagagctgggttccatttccttggggacctgagcagatgggactccctgaatccactttcaaagaggagtgtctatggcaaggtgcctggtttctgccccaattgtttatttcccttgcctccaaggctacaatgcacagaagtgaacttatccttagcaatgtatagagccaatactttagaaaatctaaaaatctagaaagtacttccaaatgtgttttctgtgcattcctgtttgtatggctggctacacagtatggaaaataaagcaagcattatcttagtttgccttaagaggaggaaaagtgtgcaggctgccagagtagggaagaggttcacagaggtaacagctccagaccaattcaacccggggagtgggaaagattccactgaaagctcatatataactaactgggcatctgagaaatatttcctgctgcttcttctccccaatcagatcttcccttctctgacatcccagcaatctaggctgcatttttctgttttcttttccctaaaggttcctacgaagctcatttcgtctaattttatctttataaaaatactgagaatgagagaagtgaagtgagattgtaatatgatacggggagcaacacagagtggcagttacgggcaaggatttcgctctcagattatttgggtgggagcttagttttgttacttactaattattttcccctaggtcagttacttcacttttcctatctccatgtcttcatttgccaaatagggatagtatttatgtgtacctcttttcatgcttagagtattacctttgcaattatgaagctctgagaaactggtggtgcatccctctctgcaatataataatcataatgtattcaaaaaagggctagtaaagacaaaataccagaaatccaccaaaaacttgttttttttcttcttcttccattactccctttctgataggtttgaaataccaagtatcaaattatttcacacagtttcatggatttgtttttgcaaagttgttgttttactgtgttcctgatgcccccaggcacatgcctcttgggtaactcactggatgttgttgaaattttatgagaaataaaaaatgcttaatatgttattattatgctttctctggaatatgctgactcccttaccccttcagcaaaagctcctacttttcatgtacatttgtatagagcctagtacaatcataggcacattgaggcactacagtgtttatgccatgggggtttgtttgaatgatctgatgcaggtaaagtgctctactaacaggactatcaactcagggatggcactcacagccatgtgttctgttgaggtctcatgagttctcatttgcataagggaatgattattattaacctgcgtgcgttattgtgaagacttttaaaaggaaaggaggatttttgcagtctactattctacacatgaaaggaggcaagggtaatcgacctctgcatttaagtactgacactattacagtagaaggactgaaatacatttcaatatttccgagatctagaagaaactaggctgggcctataacaaactgggttaatgacacataagaatttgtcaaagcctttgacatttccacaaaccccatctagctttcttgttaaagttttcaaagcaaaactatcatcttccatgttttaaatcaggtagaaaaaaaatttctttctatacctgaacttctgccaaaaacattaagcccatttgcctattctagatgggctaaaccagcctctctctgagtcactaaaccaagaccttgcctctaggaatacagcacagagaagctagaaaattgtcattcagccccaagccatcatctctagtgctcactaggctgtacagaatagaacagtcagagcacttagctcaaatatatactattgttattattagaacatggctactttgtgagtcagcccattccagctgacacaacaaaatgacatactgtatagtgcatactgatcctacatgaaacacttttaatataaaagttagcctgtagccacagtcagtccactggtcaaaaattgagcatctgctgcgtatcagcctggccaatgcatgagtacttgagtgaagggacttctttgcattttctcataggctattaatcttgcgggcattagcaaaatctatcttaaaatgattcatacaggccaggtgtggtggctcacgcctgtaatcccagcactttgggaggcccaggtgggtggatcacaaggtcaggacatccagaccatactggctaacatggtgaaaccctgtctctactaaaaatacaaaaaattacccgggcatggtgacgggcacttgtagtcccagctactcgggaggctgaggcaggagaatggcgtgaacccaggtggcggagcttgcagtaagccaagatcatgccactgcactccagcctgggttcatataagtgaagatgtatcaccacataaaatcaaggtagtattatccatagttctataatgatatggtaagtaaaaatatgtggatctgtatggaaaatgtttaggaaaaagtgaagtgggaaagcaaaaagcaactgtcttcccgaaagagtgagggatgaggcatatgggaaggtcaatgtaagtaaattgtaaaatggtaccaaccagtatatggaccatgacaaaataataagagaagagaggcaataagtcagggacctcaacaaggaaaagtctagaggaaatgaaaacctggggataaattgtttaatcatgactttggaatccatgtgagttctctgccaactaaagtagccctccctcctctcatctggcatgatttccagacatcactgaagatctctttttcctccaagttcctgctaggttaatttatccatcaggtccaaagccttttatcccaaaattggaataaattggaatgcaaattctgccatgagattttgttcttacgtgtaaatgacagatactctattcctctctgagcaaacaggaaaataagcaaaaaaggggaggagcggggagggatagcattaggagatatacctaatgtaaatgacgagttaatgggtgcagcacaccaacatgacacatgtatacatatgtaacaaacctgcacgttgtacacacgtaccctagaacttaaagtataataaaaatatatatatatatatataaaataaaaaaaaaacagaatatccccttttggaagtagaagtagattaacctattaaactaatatcagccattcaaaaaaaaaaaaaaaaaaaaaacttgaggaaccaaatttgatgaggatggtcaaccacagaagtgcataaattgagaagccttcaaaactttctaaaactttctctgttgtccaaaagaagaaagatagggattaaggggcatttgcaggaaggaaatatttcatctctttcccagtgttgatgctggtacactgtgatgtgggcacttcatatggcagaggagatcacacagatttcattaaggaatcaatcattttttcctcaaggaaaggaatcaagcattttcaccaataaggtgagggaaaatgcttacaaaagataggatattttccaaacctcatctacctcagtagcatcttccagatttgtggcaataaatgtttctaagtgtaattaaaggctgagccgatctaattaggttgatgaaattttcagtgggacttcattccccttagcatttcactcattttttttctctctctctagaatacttccttaggcttaatctgagcaatttttagtggcagcattctaagttacctcacacaggcagtgtctccactctgattgtaaaacctccagcaggtacatatgactaaaaacaaacttcaaataaaggattctaggttgttttatttaacacacagtcctttcctacctcttcagtttcatttccttactaacaaactacgttaaataatgttcactctgcaggagggaaataagcatttcagagcatttcgggggcacaaagagaccaggaaatgcataataattgcaggaacaggttctgagggggagattaatgagggagcgccatgacccttcctgataggtcagtgactacagaaacacttatacgatgaaaatattgggatagaaacacatactagtgagattttcatctatctttaaagattcttaaaatatatctagtgagcacctgaagaattaactgtaagacttttctacaggaaaatgctttccaagtggtctaaggtaaatgggcaagatgtcctcatagagtctgagcatctcagacaccatgatttctctttctgcaagattttctaacctcctctccttttgtagcagtcactcaaaaactgcttgttagaaaatttaattaaatataaaatgatcgaaaattcttaagcaacatatatttcagctcttactcagtgttatcaaaatgcaaataatataaacaagtatttctgtcaaaacagtgttgcctttgcaaaaatcagatttagaaagcatatttttttaaagacctattatcttctaagaatttcataggtatgggctgcatataatggcaatttattatttataatttttctttaactcttttttttcaaatttaaacctgtgagtcatttttcaatgagtacagatattttcccagactttgatttacttgtgatgaaaatatgaattatttaaaaaaaactactttgatctctatttgaattcccggccattcaaagttccttgtcattttaaacaaagcaccatatgaagttcaggttaggttttaccaaattattttgagctaatcttattttattttgaaatttgataatcacatacacaaaagtaactttccaattgagggttagttgttctacgtgcaagcaaagtctcatttcaaatagacattattaaatgccatatagggaaagacctaagttgcttctaaggaatatgagattataggttgtttcaatatgttgagtgatttccttttttttctttaatctgtaaagaataaatgtgtaaattcgtgagagtgatatttttatgccttgaatgccattgtttacaatgaaatagaatcggccatttaaatattatattttccttgatagggttctgtattctaatcctgctggacccccttattactcttggtcaagtaacttctctaggtctgtttccccaaaggaagaaagttgaacttagaaaatgatttccaggatcctttccattctaacactccaaaatttcttccatgacttcagacaaggtgttattagaatctccttcaagactggttatgctaagaggcactacatactagactgaaaataaaaatgccatcagccaataaatgaagtcataattaagggtttacacatgcagtgtgctatcgaccaggaagtccaagctagagttcaggaaaatttacatagattttactgttaagagagattctgtgagaatgaacatgggtatatccctctcttttcagtaacttcacaaagctgacctatttgaagtagggtgatttaactcacaatccatgatactttgtcactatttcatttcagaagtaacaagagcagggccttctaaatagataatggttcagacaggatggaaactatcaacaactaaaaagccctccaaagtgctgggattacaggcatgaaccacgacacccagcacgttgggaggccaaggcgggcagatcacttgaggtcagtagttcaagaccaccctggccaacatagagtgaaacccgtcactactataaatacaaaaattagctgggtgtggtggtgcatgcctgtagtcccagctaacttgggaagctaaggcaggagaattgcttgaacccaggaggtggaggttgcagagagctgagatcatgccactacactcccctggggaacagagcaagactccatctcttaaaaaaaaaaaaagccctccaagtgaggtatgttttgatttatagattaattgtgctgatatccttccaaactccagtgcatcagaagaagtaaaatgaaaaagattacacaagtcaagaaaaaagtgaccgtgcttcctcagacacacaccccagatggggaagacagagttggaaagtgtccaatcaataaagaagagtgaattgtatccaaaccctatagtgacaacagcacaagtgaatcctccttttatgagtttagccactgtgaactaacatgtcacttggaagaccacctaacttattttttggtattgtggtttttctggttaaaaggccaatataaaaaaaaatgaatactaaggtaaggaatctttatttatcaattcataaattagaggtgttaatctgaagcacggtttaatttgaaactgttattttagattaaggcaattaactacagttttatacacacacagaaaaaaactgcctcacttatgcagaattatcagaagattatgtgtctcagctgaactcaaggattccctgcaggaattactattattattatttggatgcccaagagttctttagttagattcccatttctgctagagttccctcgattccccttcctttttccaatctaagcaggattactcttctctgtataaagcaggatgtagggactgattatacctggcctggctcacagtgaaaatgaggaagttggtacaggtgattggggatgcggctctgccctccactttccatccctagaatggagtttcagaaatcttctaaaaatatctaattattcttttaccatacctgatatgctttctccatccctgcctgtctaaattagtcactgtttgagatgctcatattctgactcttctgtgtttctctccttgtcttctagaactctcactcatctcaccctctttttaaatcaaataactgtgttaaataatttaataattcattcctcacagtctattattcatttgtaaacattgttttagtttgtaacaaatttgagagtttgtacaatcttttaggaactctaacaaacatttctcttgcaaaagggctcttaactatggtagttaagagcacaaggacactgaaatcagacttcctcgattaagatttagactttcatacttgttagttgtgtgaccttcctcaagaaacttacctgcctcaaacctcagtttctttgtctgaaacatgcagataataaaatgtctacctattttgtgaggattcctgtaaagctcttataatagcacaaaataacagctctggaaatattagtactataataataataataataaataataataataataattagattatcatcctctacagagcttaacacaaacctggatcatactacatatttgtaaccagtaaaagttactttctgaaaggcaatctatcactcctactacaaagcatgggtaggtttggcctttcagaactgcacctcttcatgtttgttaaaactattgcacctttaaatctcccttaggattattctatatacatccacatactgggcaacaaatcaaccagtatgttcacataaagagaagacagggaaggataattcagtagtaattgtttttccctaatgcttaactgaatcaagtttatatgattaaattatttacttcagaataaaccaagtacatcactgcttaccaacagcacctatggctaacagtgaattcaaagttatttaactttgatgtttagaaatctacaccattaaattgtaggcatacaatgtaagaggaacctctggttccagtagcccaaagaaattggattgtgtctgaatgaatttttttaaagacagcttttatggaaaatattcattaaaaaatgaaattcagggacttcttcatctttctctccccaaaacccaacaaattccaatcttatacaaagttacaatacacaactacagctgataatgagggatgaaattattgatgtcatttagtttgatgatcttgctcagataaatatcaagtaaattcaccagataacatttacttcctccagaatgtgttgaaaataagggaagaaaattatgtcattatatagacttattttgttttagttttgttttgaattacatagtcgttgcttctcctataggctaattgctttttcttcttttttcttttaatactcaaaaaagtcatcactgtatgcataacacctatggcatttaagtagaaataagcaagtaaaccatttagctcaactttagacccagtatctctttttgtttgactttcttttatagctaatatcaactgtccacacaaatctcaaatgtaaattacttacagactaataaagaagaggaacctaattccttcataatgatctatgagctgtttccctcccccaatcctacataaacaatagtagaatattgaatttaaagttgtgccgtttgactctggaacatcgggtcttcagcaaaggtgctttcatgctggatctgaaatgatgagaccatgaattaggaatgattctgatggcaacgatatttacctctttgagacagcccataaagttgttactgactggtgaccctggaaggtcggctgtgctgggactgcctccaacatagaaaaagtcatcagaccccagcatggtataatcttcttgcgtgtagcccgttgtggtaagaatcccatccactgatattgtcacctagataacaaagcacagggaaaggacacgctatactcagacctagatactgtaatcctgggatatgcctgttttgtgttttgcttttgtttttttgttttgttttgttttgcttttttctttttttctgtttgtttggtttttgtttttagacctatgacggaacccattttcatgtctgtttgaggtttattcttagattctattcaactagccctaagagatctaaactagttagagagttaactgattattgaactagtgtcagcatcatccctactgcaactcaaaagttattgagcagacacaaaaatggtgttagtaaaatgcttcctaggttagttttgctggtgtacatattagtaaggtttagttgtctgttattaactaatcacaacgtgcaccttgttaacataaaaggcgcaagctatttccagcaacatcactatttgcactattgagcagcaattgttcagcatgcaagtgcctaagtccatgccaaagggagagaaaaggcaaaacaaccagtagaagcggcacacgctgatgtgcacatgcaggaggtacagtacagttcagaaaaggaaagaaagaaaacagggagaaccaaaggaaaaacataaaaataaaaacaactgctttgtgatgacgtaaagatgagtgggtgtggcatctccagcattcccaaatcaagtttccatgccatgcatcatgaatggttagagactggctgagctgcggtcactcgggccagccaccattttgtcttatcccgtgttaaccacagctggatgcaaaacgttcgaaacgttaacgatgcccctacaggtgagttggaaaacagaagttgacaggaacaggtaaaaaataagaaggtcaacaacagatgaaaagaaggaggtcaaagtaagcagaagagtaccaaccgcagttcctcttttgttaatgatgtctacagttaaaagaaagaaagaaaacacacggcaaacccaaaataagaaacaattagaatgatatctaccgaacaatgtagtttgtttaccatagcgtgtccaatgcctgagtgctttgtggagaaggggggagaaaggaaattaaaaactgtgaacagaataacgatcgttacttaaaaaatatgatggtctctaccatgttagtacattttttgattcaggtaacggttagtagaatgaaacattccatgaatgacatgttagttattaagcatgttagtaacatagaaaaagggcaaaaaaattttacaagaaaaaagcagactaacaagtaggcctcccacagaggtaatatttttcctgctattattgttcataatttgctactagacagaaacagacacatgacaatgttccctttgtcttcctgagtacatctgagagacattggaaaagtctaaaagggattcaaaggcctaaagcgtttcagctgaccactgcagccctatgcccatacttgacccctcctccaccctggcccaccccagccccaggaaattagtaggaatcagttggcattgccctactactcaattttacagcatacaaggactcctcctcaacttcaaaacttccttcggtcatattgatggactttagggtcacagtttactgcaatgaaacaaagcaaagatcctgacacatagaatgagtagaatggatttgtgtttaatctgtcctgctacacatgcaccccggctgtataactacagtttcctttgagctaccaattcgcagtttggtttgtaacctgagcaaaggcaaatctagaaagtggactccttgagcccccacccttccttctgtgcttctctcaaatgagcctctggtttctttgtgcatatctgagagaaaaaattaaaaaaggaaaaccaaagagacagacttataggaaatccatggtctacagttatactgatggtggccaatcctctccaaaggcaggtggaagcatgcagggcccctcccatgtcaatgagggatctggaaggtctggggttctcaagaatctttcagttttatttgtttgccttagctagactaaatctacactcctaaagctcctttttctttctctagctcagatagtataaacctttcagaacaggaaagaaaaggttagacagttaacagctctgaaagagagggctgttttggtaaaggaaaaccagagacaatccggtcattctgcaactgttcagagaaacaacaaatatgttaaggatattagtttaagatcagcatgtacggcaataaaattagtcactgtcaacacttaacaaaatgatacactgtaatataaagtttcacataatacccaaaacttataatgttcaatataaaaggacaatctattcattttcattcgtatatatactgtaatcacgtattcattaaaaacatacagtatatgtagacccacagatttagtaaatagttgatattttcctagtatatagcatcttgaaaaagtttttttaaaaaaatacaattaaatagaaatgggcacctagaagattaactggcctttccagagtcatttggggtttaacttaaagcatctatgctaaaaataaaagtatcttcaaaaacagacccttcaggagatatgtaagcccctaaagaaatttttcccctcagggacttctcttgtccccattttggggttgggaggaggagggagtagggactgatacaatcccaaatcacaaacactattttttcgactacaaaaaaggaactgtgacttaatgaccccaatgtgcatgcttccaaatgatcaccatgaaaactacaatttaaaattaaacaaacaaaaaaaccaaaaacacaacaaaatcacacacatcacaggaagggcaggtcgcagggatatccttgcagcccttttggaaattttcatatggccctgtatcaaaatagcctttgggctcccagaactttctagatatgcccctgctcaagtatggcaggaagattcatctcagaagaagaaaaagctaatttgcaagtgactctgaggagccctgtatcatgttgttagagtatttaagtaccacacacacagctatagcgagaaacaaagccagttactctcttatccactgcgctgttacctgacgcagattcctggtgactttcacatcatgccaggcattatcattaaactttccattcacaggctccactagtgcttcaaaggcccctgatcccaaattaatgaccagagagacagctccatttttcagggcaagattgacataatcagccgatttcccagtgtgaagcatcagtccattcctctgaagggttttaaatgacagagttatttcatcactgctgctttgaatggggttttgagacaagtcgtagcagaagtattcagatcctttgaacgtggcaatatattcttcttttcctagaggaaaacagatgatacatacataagtaaacaaatacactatgcaaatcagcaggtcttaacagaaacaatagctaatcactccccaaattaacctgcttaattagatttcatgacatgaactctgtctcagtcaaacagtactgtacagggcagtattttttaaaaaattttattattattatactttaagttttagggtacatgtgcacaatgtgcaggtttgttacatatgtatacatgtgccatgttggtgtgctgcacccattaactcgtcatttagcataactcatcctaatgctatccctctcccctcccccaaccccacaacagtccccggtgtgtgtgatgttccccttcctgtgttcatgtgttctcattgttcaattcccacctatgagtgagaacatgtggtgtttggttttttgtccttgagatagtttgctgagaatgatggtttccagcttcatcacacgtatgtttattgccgcactattcacaatagcaaagacttggaaccaacccaaatgtccaacaatgatagactggattaagaaaatgtggcacatatacaccatggaatactaggtggcagtatgtttttaataaatctcaactattgggccatcaactgcagtagctaaagctgacattcttgaaaattcaattaatttttcagtatcactgcaagagctctgatcagagaaagtagttctgtgatatctccagggcatgaatcaggtaccataaatgcatattggatggttccactctgctgacaacaatggattccaagatgttttcaacattctctccatccaactgaggcattattttaattttcagtgaaacatttatgttcaaagatctttttcaatgaagagacaaacagttttatcattgagagaccatagaaaattatctggtaaggagaaagggaagaaaaaaagatagaatctggtctgggagtaaacagacctcctacagagcatgtgcattttttatctctggatggagggagtagtgatagaaagtctaatggagtcagctggattactgatctattccctggtgtagttaagcagatggtagggctggctgttatgacactggtaagaattctagcacatcgtcatggggatagcatgtaaatgaagtctcaacattttctacgtatcttattctttaccagatttaggagtaacaaggcggctctcacgagatgctagacagatcaaacagaaaggtggatatttggaaggaacagtcttctcccactgatgaggtgagttgaaccaaaggaagaatgtaagccataagaccccttgactttctaggcagtaatgatgctgtgccaagaaaaatgagacagcatggttgggaatcagcttctgataaactataaacatataattataaacggtactggagaaacttaatctgtcccactggcgacatactatcactattatgcccccgagagggttgatacatcagcaggtgttgcattctcccctgtaataggtttttaatctcaggactattttcatttgattgtcaaataactcacgtcctggaatcagagctcaaatcgctttcaacgcatcagtgccagatgatctgccttcctggatgtagaaaatggccatcagtggctacaggtagtcaaaccatagcaataaatatcacggtgagcacctacaggtattcaccaggaattgagccctggaatattagtcattgactactagcaaattattagccaagactatcagtcagaccaaataattctgagtaagtcataggaaagacctcccaatctgtaatagtgaatccctcccattcaaacgctcagaatattggctgagcacctcccaagtgttaagcccagtaccagttattagagataatgaagtgaacacaatggacttaattcctgtctcggaaagttatagtccaggtgtctgctcccctggtcagtccaacatggcaagtggttcaatattgggcacaagtacaactatatattactattatactgagaggaaaatgtgggtcaaaatatgagtttggattgtaggttggccactagctgtcactagaacaattatttgcttttcaaattttggtttctgaaaatggttagagataccaatctttcagaatgaatgtgaagatacaatgagataatgtctgtgcagacatctggtaaagttgatacgctggtgataaatagtcaatgtcttcctgcttgcctaattaatgtgataaatgtgataaatcatctaaaacaaacaacataaatcgtatgttattatgaaatctagaattttctctttaagataaaaaacaggacaaggattcccactgtcaacatttatattcaatgctacacttgacattgtagctaatgcaggaagacaagaaaagtatatgaacattgtaaagattataaatgaagaaaatcatgtgatataagcaaatatattgcacaaattgaaacactaaaataatctacagaaattatttggcttaataagagactttggaaagaatttagagttctgtgtactagagacaatcaatgtttcaacatatgtaaatagattcatagattcaatgaaatcctaatcaaaatctcaaaaaatttaaaaaaacaggtaaaaagctgattcttcacaatctatgagaaaaaaaaagagtcccaaatagccatgatatgccagagaaagaagatgaagtaagttgcctgcgtaaagatggacatttattacaaaattatagtgctgaagaaaatgcattaggataggtaaaatgaggagaataacgataatcaaacttaaaatattcttaagcatatatgaaaacaatttacactgtcaagcatttcagataagtgtgcaaaagatagattagtcaataaaggttactgggacaatcagttattcataagaaaaaagtgaaattggatctttacatcctttgttcacaaaaatcaattctacatggatgcccgatttaatttagagaggcaatctgtgaaaacttgtcagacaataaagtttgatatggaagaatggaaggacttctaaaattagcataaaggcactaataaatattgatacactcatctacattaaaattaacaatgctgggtcatcaataataccatagagtaagaagttaaataacaattttggagaaaatattttcacttcctattaatcaacaaaggattataatccagaatatgccaagcacctcagcgaatcaatacaaaaataaagacaaccaatgaagaacacacacaaaagaaatgtaatttcatggaaaaacagatatgtattgcttatgaataatgaacagatattcattcctattagtattcaggaaatggtaaaaatcaaactacattcagataccatttcatagccatgaaattgacataaaacgaaaagaaaagagaataattccacattttgccaaggctaccgaaagtcattcttatatactgctgatgctgataagataaaaattgaccaactgtaataagtttcttttggcattatgcaatcccatgggaatttcacatattacaaagaacttgggtctcagtccttagaaaatagttaaccaggatcagttaactaaacatttgccaattccttcaactcatttgtcattgcttattgttctgctcatttgatgataggtagtcaagtgggttctggttcatgtatgtgtgtgtgtgtgtgtgtgtgtgtgtgtgtgtgtgtgcgcatactaataattatatatgaaaacaatttatattgtctggcattgcaggtaagttagcaaaagatacagaggtcactaaaggttgctgggactattggttatctataagagaaaaatgaaattggatctttacatccttttgtttcccagaatcaattctacatgatgaaggatttaatttagagaggcaatctatgaaagcttttgtcagacacagacacacacacacacacacacacgagagatccacttatctgaatatggtatttgcaaaattttacattcccactgaataagtagatctctgagtcagcaggagccttaaagacaatcctgcagcccaacccattaatttacattattaagaaagcgaggctcatggagtttatatgaccctcaaattcataaaatgtgacagtaacagaagtgggactaggattcagactactaatccagatactgtctaacatgccacaacacctgtgtgtcagacagaagtgatatatagcattgtgaaagaaagaaaaaaagagaaaaaaaactgtttgtgaagatatgtcttagtaagaaaataataactgtgttttagtctacttagtttaaaagagcaggtaatatattaagaaagattccacttagataactaaattataaagttttggagcttgaagagttttggtccagtaagaaggctgtagaattttatccaagatatcttgtatcattccaaatctgcataactcagaataaatctcaacaaaggttttgtttgccagataatgtggcatacccaaggggttaaataataaacagtttgcaattcactatgtaataaactttgaagttatatgggtgttgatgtatttttaacactatgatattccccttacttaaaaatgaaaatatatcatttcttttgtattgtttaattccaaatttaagtaattcaaatttacattaaaggcaaccacatagttttggaaaaaattcagtctgtggaatatgcaattaccttaaaatgccataaatgggacataaatctaagcagggaaaatatttcttcctatgttctttttcatgaaagaacatatatactacatgaaaatacaaaaatcactttttcacaatatataagaatattatgtttcatctaatcatttgctaccttacaatctttgtaagtaagctttgtgctattctataaacaaatactaagcagcagagtgtttacatatgtgtttctgctgaacacttaaagaataagtctacgtccatttttaaatacaagtcccaaataacttttgcatttctactatgtgctaaaacaacgaaaatgaaaaagaaattagacccaaagccacgtaaatgtcaataaatacttatatctaggatacaaagagacctcttacaaatcaataacaacaacaacaaaaaacaaaaacgcaacacaagccaatgggaaaaaaatgataaagtagttgaacagacattaaagtataaaaggctatcttcaaagaaatgcaaagtaaaccataatgaaataacagcacactccacagaatgaataaaatgaaaaatacaaaaaaatccagtgtcagtgaggatgtggggcaactagaactctcatacattattggtaggaactattttgtgaaattgtttggcattctcttttaaagctgaacttgggcctaccctatgatccaccaattccactcataagcatatatccaacaaaaaatacacatatcatcagaatagcatactagaatgtttacagtgttaccctgcataaattatctaaaacttaacactactgaaataacaaccaataatagaatggataaatttcagtatagtcacacaatagaatattaaataacaatgtgaatctatgagctgcaactgcaacagaaatacagataaatctcacaataataatgtttagctaaaaaaaatgcctgacacaaaagagaacatagttctgattccatttatataaaaaatttaaaaacatgcataactagcctctgttgttgtaaatcaagacagtggctatgcttggtagagatggagaggggatagtagtgaggagaactcttggggtacaattaatgttgttcttgatttaagggttgcctatgggtgtgctaagcgtgtgaaaaattaatttacctggacatttatgctacatttatcagcataaatactatatttcaataaaatgtttgaataatctggatgattaagcataaaatgaatttgtctgatgaagtattttcttcctgattaataagatgatatgagaagacactattcctattaatgctactattaatagtaaaagctaaaataaagccaatagtaataatttcaattgtcactttttaaaacttttcaatgaatattaatatcctttaattaccatttgctcttaagagtaatctctcaagatttaaaaaatatatatatacgctgcttggtagtaattgtttgaagatccatatcttaaatgtgttgattaatggattgattcaagatgaaaagagcctctatttctagccacagcaatgttatgataaaattgggaaaaagtaatatttaaaaatttgaagcatctttccaatagtctacaacaattgattttatgttgccacacagttggaggaaaatatttaagagtctgccatgggatttcagtcccattccatatccgacacactataacttagaagaaaattcacagttcttgctcatctaattttctgagagtaagctcaactttaagatttttttgatataaaaacaaacttcttatagaaaaaaaagttaaccattactgaaccacttcattggatgttgtagaaggtgttcaatccttagatggtagattgaacaaatggattggtttcaacaccaagaatcactgatttctactttacgggaaaaaaaatgttaaacaaagataggttaaatgacttcctaagttcacacaaaaattgattctcaggacaatgctcctttgcattaccagtgcatagaatataatctcattaatttgacccaatgcctctgtatcttctaacttcactgaacttcttcaccaaataaataatctgcaaggaaattaccgtacatcttaaagacaaggatgcctgcgggcagaacgaagtcccactgtccccagttacatgaagaatgtcaagtcatttttgtatgccaaaaaactagccaatattattattcttgattatattgcttttcatacatataatcccaaatcacacaggttggaaggttttactatagttatatgattcaaagattatgttcaacataaaccagaaactaaaatcaatatatgaaaaaacaaatgaatgaaaaaagatatttgggtgagagccctgcttcatttatttttctattctagaagtcaaatacacaaaaatattgtgccaaaaacatccttgaccaagcagatgtacacattagaagtctgcattattaaaacaaataagccaggctgtctctgctataagataaaacaactttagaaaagcagaaaaggaatgtctgcttattgaaattcatatcaaattaaatcctcagtccttaagaaatttactattatcttatttgccacgaactgtgtaactgagaaattaaaacaataaattgattattacaagtaaaaatcacattactttcaagggagagtagttcactcattagattttctacgtaatatatgttgtaaaatattctaaaattaccaactatttttcaacatatgtaaattctgagtctaacttctcttgttctgcagcgagtaatcaagatttataaaatattcactcttcaagacttatctcacttaggtaaacctcgagaccaatccagaaataaattgccaagcttctatcaaataattcaaaaggagacccaggactcttgatgatacacttgaagtcactaaatatgaaaggtaagttagacttagacattatttagtccagtgccttcatttattagatgaacagtgtcagggcccaacagacaaaactatggtcacataactaactgaggaaaagtcagaatataatccttgccctcttgataacagtctcaggttcttcctaatttctagatattgccataaaatgagcttctaattcattaccaaaaactaaatgcagcttaaatttgaggatatttctgcaaaagaaaataggacatgttccaaaactctagtacgataattttccaatcttattgtgcaattgatttgcatttgttaaaataaccaaaggtgctgagaaccaaacaggccattctgtgtctggctggactgactagtcagttctacatataaaatgagacacacagggaaaggaatgaacaaatgatcctggaattcattaggtgtgcaacatttcaatttctgggactgactcagattcaagtacctacaatgtaatctataagaactagatgctgtatcttttaacctgaagaaaatcattaacacaatcaaaattaaaagtagcttcatgaatatggactttataaagattctctgcaagaaatttgaaaatttctgggtgccaattaatgattacttaataaataagtaaattataataatgttattatattcaaggagatgtataggtattttgtatttataaacagtcctcatttatgaaatggatatgaagtaaataaatttaactatgaaatcatcttattaccgacttggtcaaggcaatatattctgagcaatttatctatttaaccaaaccccaaagaatagccaattgcttctttctccctagaatcagactggggtggtctgtaactctaaaaatctataatttaatttatgcaaatattgtggccatcttgtaagctgttctaaattatagaatgtatttttttaatatacacagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaaactctgtattgtaacccgatccccaaggtgattctagtgtacattaaagtgtgagagtcttgttatgaatggattcttatagtgctgcaatttagaacatcttttaagaattataaagacaattttgtgtctcttgtatctgaaataagtattaaaggcaaaatatatattgatatcatggcactgttcttaaggaattaacatccagatgaattattttgcatcttttcattggaaataaaaagcccggggctgggtggcgggcgaaagaatcagagagctctgatcagtgtgtagatgtatcaatatctatttaatatgtactccagcagagagtccaggctttaaatcattggaagcaatctctcaatttttattctcaacatgtttcacctttaggcaatattacaataaaattctctgtgggtttgtaaacttagtgccactcttctggataaatgtaaagggtgtataactcctggtatattctaacaagtcatcattattggtgaatatacttaacaagtttcatgcaactgcatttacggttctccctagaaatgtctttgttcatacactgctgcaactgaaaactatcatgcattctggatgtaaactgattcaatgaaaacaaatgggcctgggctgtcacatttccacttactatagtcaagtgaacttggaacattttaaagttagtaacacttagaaatgcaagaaatatatactgctaactcaaagtatcctatgttttaaaaaagaatgacagttttttaaaagaaagaaaaaaaactaaaattatcttgatatccccagcacattaagtagaggagagggtaataaatatgtgataagtgtaatgagaaatcatgctggatgggaagaaatgtacttttgtaactccatccattcgtgtgcttcatagaaggcttgaccaaggctttttggtttattttgttttgttttttttttcagatggaatgctactttgttattaaaataatgcaaagaagtaggtcagtatacactaaaatcagtataaaataagaacacttgaattgttgcataccattcttcacagtaggagcacaagagaaggaacactgaaaacctatggcatatctttgatttcaacacagaaagagcatagaatccaaaggtttaacacatgcaaatcccctattctagatattagaaatacaacagtaaataaggctctcagggtctccactctcatcaaaccagtgatggagagataaccataagtgagtcaagtataagtgagttatatgtgaaactgagcaagcaaaagagtgcaatgagggtgtgcaataactgagcagggaagttgttttagatgattggggaagctttatgagacaatgatgattaaattgagatcttaatgctgaggaaccacttgtgggaagatctggacaaagaatagaaagaataggaaaaaatccagtgagcattgagcacagtgacactggggcaatgtgggaatacaatgaaatcagagctgtgggatggggctatgtcatgtaagtccttctaaattttgggcaaactctttgattttattcgatgcacaatgggaagctactagagttttatagttaggggaatgacatggtttgatttacatctcaaaaatataactctgtctattgtgtggaaaataaactctgcgtaggcatggaagtgacagcagtgagtccaacatttatgaagttatagaacataggagtacgggctatgaaattatacatatctgggttcaaatcccactcacatgagcagttgggtaaataatcaccttaaagtcttagttttcttgtcagtaaatgaagacaataatactaggatctattttatagggtagttgtaaggattaaacaatatatgcataataagctttttaaagactgtcaatccatgggatatatttgtggaatataaacagaatatttatgtatatatgttatatttcttcatctactgcttttaaccattaagttacttcttttccccatctcttaatatcttgggcagaatcactgaatttgtggtcacttttggtttttaaaagtttgggctaatttataagttaatcatgtcatcatttttagttgaagtggaggaggaagatgtagtatgcctctaggtgtcttaccatcaccgccccctcaagacctggcccttccagtttattgggaaggagctgatgaggggaagagaaaagagcagtggttattcatatagtcctctttctgtgggctgtacctgcttctctggttcacccttactgacctctgctgcccttcatgcagtagactcatgagtgctccatgtgacttcccaacagcagtcaacaacatgagagaaattcatctgtctcatcccccagctcatctcccagctctaaccttcacacaacaccccatagcatctggctgctctaatcccctggcccagctagtggccttcttgtgagtaataccggctaggtggctcaagccaaagactcaaagggatatctcctttactgatgcctgtgggcattctggctgcaccgaatgttgctggtacagattaaattcttcttttttttttttgatagagtctcgctctgtcacccaggctggagtgcagtggcgcgatctcagctcactgcaacctccacctcccgggttcacgccattctcctgcctcagcctcccaagtagctgggattacaggtgcccgccaccatgcctagctttttttttttttttctgtatttttagtagagacggggtttcaccatgttagccaggatggtctcgatctcctgagctcccgaccttgtgatctgcccgcctcggcctcccaatgtgctgggattacaggcgtgagccactgcgccgagccagattaaattcttcttgtcccctctttctaccctgccagtcctcttcttccctcctcagaaaggcatagggcaggccagcaagtctgatgcatacaaagtcatgcattgggaatgcagaacaccagctttcatttctttcccagcatacacaggctctacatgtgattctatagtttcttccctcaattacttttggtaaaaaaagctaacctcttcattaacaatatgttttacagagcctatgccttaaagactctgtgctgacctatccgtcactgcttaggtagataagggaggtgggaagtggggagttagaagtagttgaagggtcagtctttcggtcctgtagtaaatgctgaggaaggttaactggccagtttagggaggttccatttacaatgaaggctacttaaattcttttctttcagaaggttctaatcaacaattctatgagaaaaatttccattcaacatatggtggacaatcaattaatgttagatattatgatcattattattaaagtaaccactacatttaaaatcactactcagcaattttaaaaaatcagctttttaccaaatgttttattgcccagaatatcacgatgcccaacaccctcattctaggagcacttggttaattaaggctcattacataagaacgagattgaagtattgtaaatagaaaaaaaatacatgtttctattgatggtttattcttttaaacaagtttgtgcctgagtaacttacaaaataattttataaaatatttgctatttatttatttttttatttgctcagggaaacgcatcaggctaagaattacgagagtgaaacactggtttcttcttggacacttttcagctctgccctttaccaccctacttagcctcactgggcctcattttccctcctggcaaagtgacacagtcagactaagtgatctccaatgtttctttccattctaaaactctatggttctataacattctcgatttattgagccactgtttcactgattcattcaataaacatttattgaagcccaattctgtgccaaactcaattgctctcctgctgtcaaaatcaggcaacatgctagagttaaaatgtctttaaagatttctgatggctgctgcttttaaaaggaacttcccatagcaacccctacctctttgtgcttctagagctagctctcctattattctgtgaggacttacaaattcagaaagacaaaggaatatggaaaggcctggtattcacaacctactagatgtaaatttcctattcctaatcacctttcttccacaacccagaaaacaataccttcaatggatttgctagtgttacagattgtgtttgattatttgtccccaaatttaaagtacttcttcatataattgcaaatatacgcatagaaaataaaatattttaaaagaaagctaatattatatactataagtcttaatttgagattatacatatttatccaataaaagtatagaaggatcaatcaatactgactagtgtttccctatgggctccatggatagagcccataatttgaaattaggagccctaggttcaattcctcactttatggttggtgctatatgtccaagagcagtaaatgtagctgagtctgactttatttcaatataatgaacatagatattctgttatgctgcattttcagatttttaaaaaattaagatctttaatataaattatgaaactgttcttattaattatatactgggtcttccataacttcccgttaccccatctatcatacctgtattgaaaacatcattaatcaacattctctagctcagtatttttcatcccagattccctatctggtttgagtactgttttctcaagtatctgaagggtagtataaaaccagcatcattccagatgcataggagataagttatttcattaaataagacagactccttagggttttattcccgtcccaagttcaacagagttacagattaagtgcaaacacacagaatttatgagaaagacttgaggtaactcacagaatagaaggaattgctaaaccacgaattcttggagaggaagatactctgggtaaacccaaactcttgaactcacagttcctggtctcctctaggtttgcaccactcatataattgagctccagtgaacttgaggtaattcttttcaggttctgaattccccaaatcagaaaacttggatagctctacttgtgttagaagccaattcccagatcagtctttgtggctggaatagggatgaggggacaagattataaagcagggacatgccagagaatggctgtgaggggacagcctaatcattcattaacacctggtatggtccacaagttagtatttagatctagtatttaaaaaaaaaaattttcctaggatgatgaaattattaccatctcttttttagttttacctttgacataaatttagatcttaggatccaaggtaaataatgaatttcagctgaattgtgacaagctttatttcaattgtgcatctttatcagagatctaagctaaacacagaattataaactttatagttggaagagggagatccataacatttacgagactttctctggtgcacaggcgaagttgggatgaaaaactgggtctctagatcagttgactcaaaacagagatgatcatcagaatcacctggaaaactttctacaagagtatatttccaggaaccctacccacttccactttaacaatattggggtggatctcttgctaacatattattatttttttagtttctagttagttccaatgaccagtttattttaaaactcaatgttttgcagtttttgcttttaatttttgttaaagaaatgggccttctctcaccttattctccatgaaaataattcacatcccaacaaatagcacaaaatacacaataaaatagacacattataagagaagcaatcaaaaagcagagcacattgtcactacttagtttggaagcaatttcattggttagagaacattctggccaaactgaataacactacctcttgaatatgtagttataattcacaatacttccattcacttctcagagtgagcgttctctggtctcatggataggacgcattccacattcacaggctccaattgctttttttgttgttgttttcttttctacttgtgggtaaaccaaataccatattaaaacaaattatttctccttttaaagatcattttccttgacagtatatggcaaaaatatttgatatattttatagcccatgcttgaaataagttgtctcctccaccattaaccatatgatatgccttccctaccaacaattcacaaaactatacaagttaaagagatcttccattcaagggctttgaaaaatttcttcccagttacccaggacacatatacaatacctcagctttctaccctcaatacactcttctacttgtgataggaatagaaattcttctaaattgatttcataatccaccaatggttcaccatccaaactttggaaaacacaaacgttattcaacctttccattttatacattaaaaaaatgaaggtccagggaagttaatagacttggcaaagaccactcagcttatgaatgcattggactagaatttggctttatgaccctatatcctgtgttctttctatcacacttttatgcatttatcatttttttctttctttctttctttcttttttttttttttttgagacagattcttgctctgtcacccaggctggagtgcagtggcatgatctcagctcattgcaatctccgcctcctgggttcaagcgattctcctgcctcaggctcccaagtagctaggattacagactcccaccactaggcccagctagtttttgtattttcagtagagacagggtcttaccatgttggccaggctggtctcgaatgcctgacctcaagtgatctgcctgtctcagcctcccaaagtgctaagattataggtgtaagccaccatgcccggacacttttctgcatttttaatgccattttggatagatttaaatggacatctttacagtttcaggatggaaatattcattctgtaaaatacatgacagtctattttttcatcatgacattccatcctaatttgatccctatcctagatacctaattttataactccttgagaaaatatataaaattataccttcataactttcatataatcaaacaatattatcatttttctgttacaatatcaaagtgaagtaatcatcccaactacctcaccatatttgcactaattatgttagcctctcaacatcaaattttgttttttgcagtttcttttcatatgtattattataaaattctttgactcaaatgttcgaatattcctacttaaaaacagataatggattttattttgatagaattcccacaataggaatagactctatatcattttgtaataaaaattacattaaatacacatcacaatcttgacgagaagttaattattagcaaatgctaacaattaccaggcatctcaggctaaggtgatgtgagaaaatgtctagtattcataagttgtcaaattaacatcaaagcaatatcaactaaagagcattaaaaaatagcaatgccttggccccagaccccacctcaatgttctcttttaattatcaccataagacttgggcactgggagttttagaagcttctcaggtgattctaatatgtggaaatggtaaaaacgcagagtttagagagatatgacctaggcattcaatgtgtaatatctgtggctctataactgtataaactttgtgtaataatatcacaaaaccttatggttctttaaactaaaattatactttagatatgatctatgtataatattgccttaaatttgcatactgcttatgtaacttatcaggaaactggcatattttctcttataaaggagaaacacttaaatgcatttcttcctcccctttcccaattaatatatgcttagatgttacattatcagactgacctttgtaagcatctgattttaactctcaagctttctttgtaagggccaatatttatgtaaaaccacacaaatgaatatgcaatcccagaagaataaataactatgccaatattacatactgcctttgcaaaggaaatatcatctgagagtaatataggattgtatcttgcgactgacttagacaatcacatttgcccagatacagagaaatccctaattagctaaattcagttgttttcaattttttctaaatttatgatcgtagcctatctctaaaactcattgtacaaatatatatgctttaagtatttctggtgaaaccttatgtaaccattcaaagaaggcaactgtcgatattatattctaaagagaaggtcatggaagaaagtcttgggataaaataagtagataaagaaataaagacaaagaacaagagctagtcctgaaacagtttaagagaaaagtagacactccatccatcagtagcttttcctggataggctcatctttctttaacaagttgacacatttgcaaactgcaggctgaaattttaaacgtctaagctgcttttccttcttctaatagaaaaggtacaaaaaatggtttttgcttcctttactgctgtgccttaataaacatttggctcaaggttttaaccaagccaaatgttgactaaaagcctcctcataaaaggctttaatacatttttgcttgtgttttctttacatgtatttcaatttgatgacaaataatttcttccccatttccctcatttgctgctgcatgttggactaattaaaaagcaggctctttggaagctggaatgagagaaaatggaagagtgggcaggtgggtcaagattgaatgtccctggctctggcaatacataggattctcttcagtgaaacattctccatctagctcagattcaaggaaggcaccgaagaagcccttcagcctttcctacttcaggtcagagttctttttatatttggcatacaaccgagagacatcagaattctatacaaaatggaaagttttattcttcccagcaattccactgcattctgtggcctcttggtgctgtgggcagccttagcagatttgaggcatctcttagggcaaagcggttttgaggtattcttggcgactgggaagaataatttaacttctcttggaataatatcacattcagcagaaaagatctgctgtgctcaaggtcataaatcttggctctgtgaatattcagttattcagcagaacagccactccaagccttcagagcacttttggatgctgctgcaggtgtttcctgtagagaactccctgacatccactgagttcttgcatctgcctttacccttcttgatgctgtccattctgctctctgaacaaacatattctcttacacttatgcacatgtatgaaatcctagagatttccctgaatcaacatatgcatatagatatatgatggacagaataaagtatcaagggataaaatatatttttaattttgtatttcacttgaaaattgtaaggaccattttataatgtattgcttgcaaaataagtcatggaagccctgaaaaattaatcaattcactaatcaaagaaacatatattaaagacctactatgcatgaggcaccatgctaattgctttgaagaagacaaagttgaattagacagggatccagtttacaagatatttacaatgcaaagggggatacaagacatataaaaggctatggaacttaaaaagaagaaaaaacaattctaaagtattgagatacatttcattacaaggcaaatcttagataacatcttgaaagaggacacatttaaaatttaggagatttgaggaaaagatcctccagagtatgatataaaaatgagtgaaggttttgaggtgagaaataaaattaatgaaatttgactcgatctaaggtgacatcatgaagaataatggcaaatgaagttaataagtttgtttcaggccagcttgtaaaaagtccttgaaaaaagaaaaaggaattccttatatttttattagaatatccatcttaaagtgaatggtgaattattgattggcatggatttagggacaattgcatgtcatctttttctgttattagtattactgttttgaagaatgcaatctaccaaaattgaaggtaatagtttcaatgtaaaaatatgcagagttaagcgtttggaaagcactattcaggtttagtatataggaggaaatagggatgggaatggtctattactagacatttttattcttcctacttatcaaatagaccaatatgtgtggaggaaaagccttcttctaaaaagggtttgttttacactacctgtcaaagaggatattggttcactcaaggaaactaagttatattctatttaactgtgagatatattccaataaattgcagtaaacataatcttaaaatattataaagaggcctcagattgtttaaaaatactatattgaatatatgagaaataaaagctcaagatattctttaaagtatatcctatgtaaatgccaatttttctttacagaataaatctaactacaaatgcatacagggcctaaatatatttttatcttgattttgttccttttcttgtgtttaagagccctgactccagaatcacaagagacaaactgccacttcatcacttattagcgctgtttgtgtgggcaggctatttaaacattccaatcctttattttctcctcaataaattgtaaaaaaaagtaatgtttactcagaggttaatgagttgacacttataaaattattagcatggagcctggcctcagatatcattctcttctgtatacaatttttatgtgtttgttctttaaacttataaatcagttccatcagactttttacttcatggcaagctgcttttatttctaattaagaaaacattcctgactccaaaatttataaagactttttctctcttttcttcaagtatttctataacattgtaatgcatttagtgtttatccatatgaacggtatgatattggaatctaattttacttttccacatgtataatcagttcttccgatactgttaagtattgtatcctttatgtaattattaaatatcatatataacagataaaaaactctgtatgtacttacatcgatttctagactccattttctctaaacatcccttgtctgtttctgtgccagaactagactgttttaattatagttgtttcatagtaccttttggtatcatgctggtaacttccctaaactgttacttttctcaaaaaatttaggcttttataaacatttagcttgcatatcaattttacagtttgtcaagtccctaacctcctccccaaattgagactgtgaattgaattgccctcagtctataatttaaagtttgaatcatcctattcagaggcacaaagttgttggttttttttgtttgtttgttttttacttattttggttgtgctttgtacccttccctaaagtgttattattttctttatgtaaatcttacataaaaccagtattttttaacgttcaggtaagatttttatattcctaggatcttcatgtggaaaaaaaaaacttaatgatttaaacagctatattaacttgatatatgtaattatttgagagaaaatctagtcaataacttttgccttcccactccagacttctaccctgattatgttaggtaactgaattggaaagaaaaatatttattctttatattattttttctgatctgaaaaagatagcttgtttccaccagatacattcatattaatagccatcaagctatactactttcaaattatatttatgacaataaatgattcctacaaattttagagaagactatcaaaagcaaaagaaataaatacaaaaattaactgggaacaaataagcaacccctggaggattcatctctatgaccctacagtccgaaactaaagaataatacatcctgatggacggctatggaatgaaataaaattctctattaccagttcactagaagaatttttttcccccaggtttgatctctttatttagtttatcctccaggttaaaagaaaattattcactattactcaccaataactcagtaaataaaaattttgcaaattcagccatttcaacatgccagggaatatctaaaggtgtatatatacaaatatttatatataaattttgcatatgtatataaaagaaatatatatataatatatatgaatataaacattcaggtaggatatttatatttatatataaggatatataaataaaaaatgtatttatatttctttttcaaatgcacagctcttatatacatatttctttttcaaaagcatggctacataaatttcttcattttgatgttctgcttctcttcagtttgatcttgcatatcacagtgcatttataaaatctggaaagccatctaaagaatttcaaactttctgaatacaaaatgtctttttccaccagacaagagtcaccccagtcactaaacaaattgaccaatttcagagtatttcctgcttctacttgttactgatgcagcatctggctggaacagagtgcgactggatgcagaaaagttcatgattgcttgattgactgattttgatgttgaaaatcatgtaaaattcatatatattcaaaatgtgattcaaaatagatatccaaagacacatcccagaaaatcagtgtttttctataagctacattaaaagtttttctaaatcttcatttctaagaaaaaataaataatacaagaatgtatataaataagaatgctacctctggaattaatagcacctgcatctgtctacctctttagcaggctttagttttctttctataaatactcgtcatcacataaactataacgtatttatttatttctacatctcccatgaaaacgtgagctccatgaaggcagggacttttgttgttatggtagtcgtcatggtgattgtttaccactgcatcccagggactgggagagtgcctgtcatgtactaagcattcaacagatatctgttgaattaattattcataattacttaattcacaattttaacatgagcataagaactaagatcagaccaaataagccttttcaaaatattaatgaaattttatattattattatctactacccttttaaactttactgtgcttaaaagaaaaaatccagcttgattacagagctcaaagaatgctattgcctgaatgtaagatcgagaatagcttttctttacatgattcccagtctaaggagagaaagcagatagtaaatcacacattaaacaaatcattcaattacattcgtttaaagtgctgctacctaggaaggaaactgaaatgtgccttgagaacagatactcaactggcatgctggaagggcttccctagaaagggatggtttggtttctaggacttgaagaataaggtctaaatcaggtagaaaaggcagggaacattccaggcatccacaaagatatatagagaggctgagtccaggaagatcttgacaaactctagaaactgtgagactggtaatatactattaggttggtgcaaaagtaattgcagtttttgccatttcttttgcaccaacctaatagaaaagaatcagtacaaaacaaaaggccgctattctggtgtcagattttcttctcacactgaagccagctggagtccttagaactttcctgaacttttctgcatccagcagcactctgttccaggcagatgctgcatcagtaacaagtggaagcaggaaatactctgaaattggtcaatttgtttagtgactggggtgactcttgcctggtggaaaaagacattttgtattcagaaagtttaaaattctttagatagctttccaaattttacaaatgcactgtgatatgcaagatgaaactgaggagaaccagctctttggctgcagatctgagatctttctatgggaggacaaaaaggagctaaatcacattaatctattttccacactagtgacatgaactaggttcaattattcaactacggaaaagtcccctttttatgattcctcaaacggtgtaatttttcctgcctctgtactttcatgttgtctttttttttttttttttttttctctctgagctgttccactaggcacatatttctagaatcagctgaagttccaccatgattctctgtttggactatccttcctctgaactcctccaatattttatgcccattactatacaactcttgattgcatctgagtcccttgaggagacagggaggaacaggacaggagacagggaggaagaaggacagactatgcctgtgaatacagagtattttcctacagagaatatttctaatgaagatgtaaaagatccactcaaaactcaagcattatattgtttgagagggcaattttttttttttcaatttaggtggtctgttttatggtttcttctatggaatatctgtgcaacaggagatcctcttgaataattacccgctgaacaaactgtatctctcaaacacatctcaattttagacttgttgtttaggtcattccctggagagtgtcttgaagaagaaaaaaagcggaaacttacagatagtaggcccagggaaaatataaattattttatatccacttttgagggcctcatattttcttggcttaggtactcaggagacagatataaggcataaaatctttaacattattaaaaccaattcagaaaaatcccttaaccttccaacactaaagcagatagagaacatgaaaactatctatggaactgaaaatcagtgatcaatacatctatgaaaaatgttactattttataagacatccaaagaaatacacaggaaaacaaaatagaaatagcttacaacattcgacactgcttgtgtataatcacacaagcacgtggtatcctaactagtggaaatgcaaagtagcgcatactatggggaatataaattggcaactcatataaagacccaaagaaaagctttactcttgtcctcataattccacttccaagtaatacagcttaggaagaaagtcagggacaagaacaaaaatttgtataccaggatgttcattacagccttaaaattcaggaaagtttgtaaataattaaaatattacactattcaaaaacaagcaatttatgacacaacattaggatggaaaatttgtagtcagtaaaaatcatcttttcacattctaatgacagaagaagaaaaatactccttacattaagctaagcaaaataaatgtagggcatacaaattatactataaattgtactgtacatgtgtgtatatacatatatacacacatacaaataaaggaaacagaccaaaatgatatcatgtatttatttcctttaaacctttgtgtactttcccaattctctacaatgaatatttttatgaccaagaaaaagttaataatattaaataattaatttagactcatttcattatatgcatgaattattccacataaatagctccttgttacaatcaagccaaagaactgtcaaaccatattgggatctacagagactcaatcgccaacaacgacataaggcaaaacctcccacagagaccctcttctctttcacataacactgtattttttaacaatgtttaacagttggaaatgctgagaagccacagatgagatcattaggagaaagtattttccatcatgcttttgtcagggaaaatcccttagtagttctatttctgagttatatttttagccaggctgacaaaatttaaagcaaagtatataaaatgtgtatttgcaagcatctttctctaccaaatggaattcactttaactatcacactgataaagatcatttatcataggcttgtcttctgcatgaccctgtatttggagggtgtgagagactacaagacagaagtggtcaggacctcaaaagatggcacgtgagccgctgcttcaaaaaattaaccagacataccagaaaaatatgatgatgtttatggtctgataggcatctctgtgatctgtaatttatgtatcctatctctgtgcaaccaatggatttaatgggtcagcaagcttcaggaaaaccctaaatggatttgggttcagcaaacagccggtcatcacttctaccccatgcttctaccccacttctacccaccgtgctgaactgcgaagccaaggacttgcttaaactatcaaatccagtttcctcatagaacttttggcccttctatttgtaggtccatctttgcctttggttgctgacatcacattcccagggactgttttctcttgtataaacatatatccatgtaaatccttaaaattcatggcctttgggtttttccttgtcagtcaatctgaatgtccccttcctcagatcctaatagctctgagctggattaggttttccctgatttgcccagcagtgaattcagcttaatttaaaatccactctgcctgagagtttctatttttactttatgaacccataggactgatgaacaatagttagaattgtattcaaattttggatagtttgaattatgtattagttgggaggttcttctttcaaggaaaagaatacaaaattaggtacaagcatgtatacacacatacacacatacacacacacacacacacacacacacacacacacacaaagaaatcacaagtatttactgaatacgccagagctgttttctctgagatttctttaggcagttatctatagacattgtcatagaaatgcttccagattacagtgtggcttcctctccttgtggagaaaactctgtagctcccaaaacttcactaggggaggtgcaaatgagaaaccctagattttaaggtgaagagaatcaaacttacattttccatttgcagaaatgtgttcattagcttagtgagattggttggttttgcttcttattgtctgttaccccctctttgcttgagggtggatgtctgtttctgacaatgatttttgtgaccctgaagccatgtaaaatggaactagtaatacctactgtatcacttgattgttgagaagattaagtgaaatcggagtgaaatggattaatatatcattgtctgaaaattgttacactagaaggcaactccttagagcaagggaattttgttgacaaactagcactcttgctgggacatgatacagagttcaatgattaggggctgatttgcttgaggaatgtgaatgaatcatagatgctataattgcccttgttctgtccctaaatgaagaaaaacgaagcagctgtggtcatctacattctcactgtctaatagccacaagtggtctaaatccagactaaaatacaggggactctggttgcatttatatttatcccccagctgtttctgtctccctattttaccaattccaattcaaaatgctcttagccctgaagaatctgaactgcctcagttgtgcactgtcctctgggtttgcagatgccatagaaatgtctgttctgataataatgtactgagggcatcatgcttatttaacctctggtgaggtagttaggaaaatgcttctgatactgggtaagatcctgaataggaggcccatgctttgtgatgccagacctcttgctttttactgcctttatatacatgataaaacatgatttcagtcagagcaagtggtatatgactcctgacattgtgtgataacacagcacattgtttctgtggagaagtcaacacagttctggaaggatgactcgctttccggttttatgctctcttcccctgaatcctcataagaagctgctctgaagtttaaacatcgaataaaaatgcttccaaacaattaatgcgacagcaaacacaccaataaacctatcggcagcagcctcagtattttacctcagtctttaatgtcagcttgcttttttattccagaggtcagaaaaacaaatgctctgtgagctcattacgtgcatgcctaaacaagcagaaaagtaggtgcttttccaaatgccagacaatgaaatctagatttttctctttgtacttcactgtaattcgggtgatagaatacttgctaatacaagctattaaaacaaaccaacaaacagaaatcagtctctcatagcctattttaaaactccctccctgtgttcttaactgttgacttttaaaccaaaaatgccagtcaagaagtacaaagtgatctttagcactgtctagcttaaaatgttgatagttaatatttgaatataaaaaagtataaaaataaataatagacaactcattttagctaacactttggaattaactttgagtagtagaaaactacacaatataaacctgtttttcagtggtttctgctatcaagtgaattgatggattatagtaacctttgttacctggcactcagaatactacttttaagcacaggttcttttaataagaaactaattgatatccataatgtgacccaaataaattgtaaggtccttgaaattaagttctggaaaaaataagcaaattcttaggcttattttattttttctgtaattctttaaaaatgagtgatctacatgtcatacatgtatatggtaattctctcctgtatagaataccctctggccatcctgaaaaataaaattaactcttgagctttatgagattttctaaagaaaaagtatctctataaagaatgttagactgggcatggtggctcacacctgtaatcccagcactttgggaggccgaggcaagaggatcacttaagctcaggagctcaagaccagcctgggaaatatagtgagacctcatctctaccaaaaataacataacataacgtaacatgacatgacatgacatgacatgacatgacatgacataacatgacataacataacataacataaaatacactgggaggctgaggcaggagggaggattgcttgagcagaggagatggaggctgcagcgagctgtaaacatgcactgcactccggcctgaatgacacagtaaaactctatctcaaaaagaaagaaagaaagaatgttaacttgccgacacacatgctctcttccattctttttcctctccttacaccatcccttcttttttccattactcacaatgatgggattagtacagcttgtactggggctttggaactgtaataaacaaggagcaattttctggtcctaattaactcctgttaaaataagcactgcacaacaatagtctacccagagttgcactgaaaaaaaccacaacaatcctaacactctatgaataatgaaccctatttaaatgagcaggttattgtagggtcttaatgagctgctctgtggccacagggcacatactgcatcccagagtaatggagcattttcctgcagacacttgcaggctgggctagcagcagaacagcttcttccctggtaaaaccagagaggtagcatcaaaggtttgttatgtttccattttactttttcacacacctcttctgcaactgacatcagccatccccatccctttttgaaatgttgtcttccttcttttacctccaggcttctatattcaagcatcctcctcctttatatcttttctgaagtataatttacagaccataaaattcacttcgtttaagtatacaattcaatgagttttggtaaatttccagtgttatgcaaccatcattgcaatctaattttacaacattttcattgcaccaaaaagaaactttgtgcccattcgtagtcattccctcttcccacccccaggccaacctaagcaaacactaatctttttgtctgtataggtttgccttttttggacaattaatagggaaccacataatgtgtggacttttagcataacgtttctgaggctccatgtagcatatagcatgtggaacacaatactattccactgtatagatatactacattttgcttgctcactcatcagttgatgcacatctgtgctatttctacttcttgttattaagaatgctgctgctatgctgtgaacatctgtgaacgaatttttgtatagacacatgttttcatttctcttaggtaggtacctatgagtggaacagctgagtcatatgataaatctatgcttaacagtttaagaaactgccaaaagcttttccagagttttgcattactagcagcaatgtatgaaggttccatttatccatatatttactaacactggttattgttgatgttttccattatagccatcctagctggcgtgaagtgttatcttgtggttttaaccatttccctattggctaatgatgttgagcctctatcatttgtgtctgactgttgtttctgttttattttgttttcattcctcgttttagtattccttgacttttgtaatgtcccctttttcctgtatacctatttcctgatccacatggatcatgttgactcccactcatatgcaattaactaccatatcttaatgaatgctgctcatggctcattctcaatctatttatctccatgaagttactgataccatatgttaaaagaaaaactttagacaaaccaaatctagcagagtttatttgagaaaataaatgatttatgaatagggcagcagtctggaccaaaaatggttcagaatgctccactctaccacatgtgcagtctatattcatgcccatagaaaaggaagtaacatacagaaacaacctgattggctgcagtcaatgtttgccttatatagtcgtatttggcagctttcagtctcttaatggctggaggtttagttgctgtgattgattgagactcagttactttttacaagagtatatacttctagtttaggttatagcttgtaaatacaccaacttaggttacaattcactatgtctagagaaacttttaggcaactcttaaattatttatggaggcagttttggccaaacttaattcaatttcatacatatttctacttggaaaaaaggcaggaaaattgaatttttaatttacacacaaataatgaacagaagttcaaatgtaccttgatttaatgcataatataattgcgtgaagtattagtataccataatcgttcataaatatattgcttttacataagcatactgaccacatgatcagacttgcctgttctcttactgtcttacggacagtgtaggattcactaagctgcggtcatttcctctttagaacctagctgtgatcatcttctctgcctgcctcttactttgtttccttcattttcttttgtgacataatggctgtagctgaagcatacaggtagaatctcactatgccccctactttcttctcttttggccttttcatcttttttttttttttttctggttctccaagtccatttatgcatttattcattctttttctctttttttttatactttaagttttagggtacatgtgtacaacgtgcaggtttgttacatatgtatacatgtgccatgttggtgtgctgcacccattaactcgtcatttaacattaggtatatctcctaatgctatccctcccccctccccccaccccacaacaggccccagtgtgatgttccccttcctgtgtccatgtgttctcattgttcaattcccacctatgagtgagaacatgtggtgtttggtttttttgtccttgccatagtttgctgagaatgatggtttccagcttcatccatgtccctacaaaggacatgaaatcatcattttttagggctgcatagtattccatggtgtatatgtgccacattttcttaatctagtctatcattgttggacatttggcttggttccaagtctttgctatggtgagtagtgctgcaataaacatatgtgtgcatgtgtctttatagcagcatgatttataatcctttgggtacatacccagtaatgggatggctgggtcaaatggtatttctagttctagatccctgaggaatcgccacactgacttccacaatggttgaactagttaacagtcccatcaacagtgtaaaagtgttcctatttctccacatcctctccagcacctgttgtttcttgactttctaatgatcaccattctaactggtgtgagatggtatctcattgtgtttttgatttgcatttctctgatggccagtgatgatgagcattttctcatgtgtctgttggctgcataaatgtcttcttttgagaagtgtctgttcatatccttcaatctaatcagtagccaatatagtgattccattcaaaggttcaaacgatgcttaaaccaaaattattatccatttcacactctccaaccaagtgaacaagaggaaagaggagaacaaagcaaggaacaaaagaataaaaaaggtctaattaatttgcaacctggagaaaacatgtcagatcttgatgtaaaatagaaaagtctggaaaattgggattttccaatatgcagttatgtggccaattttagagatgcaataaactgagtgtgattaaatggtaaattggactgatcaggtgagccatacttttcttgtgaaaagtagcaagcatggaaaaaaaaaagatacagctctatttccctttacttttccatctgtatctttcatatttttcaaaattaaaaaaaacaccaaactatttttcaagtattaataaagaatcaggaagaacttcatttaaaacatttttgcctgcccttcaaaaaactctttcactgtttcaaggccattgcttctggaacccagatttgttctagcttacagcctaggaataagaatatatactttcctgtcaggatggcttttgagaaactctgagaataaaatctgacccagtccaatctgacaaggttgctgtgcttgtttgaatgtaaaatgattcacaaagtgaaccgaaagtttttgttaattgttaaaaagcctcagcgctgtggcttagtttaagagctacatctggcattttggtaggaacaaactacttatgaatgaggaatagttatattttttgtgttgttgtttttatttttcttttggggggggagggaagaaagaggacagaagagaactaggacttagtattttgaaaactgggacatcatcactggcctacccaccacataaacgtaactagtgtatatgattttaactttgtaatcgtgtacattgacacttctttttgatattctagatctatacaaagaaaaatactcaaagagatgcaggaaaataaataagaaaagaaattctctggccagcaattatttagcagtaaattgacatataaatgtggtgtaattaaactcaaatcacttttaaacctaattaccgatacaaagaaatgggaaagcatcgacctctaggcttcagaaagcttaggtaaaatcattacaaatctgtcagttgtaccatcaaaataaatctggaatctaagcacttcttatcattttcattgctgccaccctggtctgagttacccgcattttctgggacttctgaaataacttccaaactattgttcctcagacttaccccacctctcatacaccacttcaccccctgcccccaaacacacaaaagcaaagtgatcttttttaaacttaaagtctaatcatgccccttcttggctcaaaacccacccatgagaaattaaataggcttttaaagttacgtatcaattttaaaagtaacacttataattctatactctaaagagtacctgagtctgtactaggacatttgcttccagaagtcatgaaagtggtctgaagaagtcacaaataggagtttataaagttctagaagtatcaagtttctagattcttttcagtttttgctctgtttaaacattcacaccaactgaggtctgggggtgaaaggggaagttaatttatcccctaaataatatttattttgtatacaaaagaatggttaaatgtattcagtagtctaacctgctcttcttggctattcattcctgaatgacaggaattccgtttgtaccaccctcatcaccaccattaatttcatgatggactagctacttcacagccctcatgtccccaccactccattcaagctcaagggctactgaagcatagtagcagcttacaaagaaaaaaaaaaagacaaaacaaactcttagcaataatgttatgtcattcacactagagacaaaataacttcattattagagatgctatcattgaaattaattcactggttataaaaggaaggctatccaagaatatctgcagttttgatgccttggaaaataaaattaaatggaagagaaattaacaataataactcagaaataaacactattaatattttatgtaagttttccaccttccttgatatatgacataagcattttcttaactcaataaaaactctaaagaaacatagaaaacaataacaacaacttgtgtggtttctcgtctctctcagagtaaaagccaaaatcctgaggatagcccgtaactctatacaatctggtccaccatttcatctgtgggctcatcttcaatactaccctaaagcctccagttttgctttagccacatccatctccccattgactctttaataagccagacagttccctggattttggcatttcagtggctccttcctctgcctgctaaattcctctccaacatgttattcactgtgtgctctctcacctcttctaagtctttggtccactaccacctacaccttgcctttacatgccttgctttatttttctccataaaacttaactactgagtataccatagttaatcactcatgtttaaatattttttcgtccatctcctacagtagaatatgagtgacagaggacagggatcttcattttttgtttgtttggtatacccagggcccagaatgatgccatactcatgataagcagttccgtaaagagcgttattccctgtgacagaatgtcaggagtgaagttgtcaagtcctttttctagagaagtggtgggtgttcttgcttctcattaactaaggcacagcctggattgaagagtagacatgagataagagttctgtgttctgccatcaaaaagacaaaaaagaagtatacatcttttcaattcttttatgcttgaaattctcaccttcctttaaatcacaaggataatctgttgacccttacaacagctctgagctgttattatccacaactgagaaagaaaggaagaggctgtggtatttactgaggtcctaaatggcagaaccaggactagtaaaccatgttattaggtttctgcttctatatagtcacaatgaactgcagccacatctcccagaacaataaattagcaagtagacagaagtctttctttccaccctcaaaagaggtttttagcctttacaattagcttttcaataaagatacaagaataactatttcattgatgtgctctcagcagatcttagactttccattatttatttcctttgtttagttcaatgtgaaagtgcttggctttaatcttcatttcacttagttttatcaaaatataaaacccctacatttgcataggctatcccagggtccagaaagcattcacactttgtccatctgatacaccctcaaaacaacgctagctgaggtaaaagcaggtgggtgtatctttacctcagaaggatccttgacctgcccaatgcgacatcagtggtgagcctcagaaacagggcaaaaaaaaattgatctctttagtgtaaactcaatgtttttaatttacaggaaatgcattcactggtgtgtgtgtgtgtgtgtgtgtgtgtgtttgaggcaggggagcaattacataataggaagaaattatctaaattattcttatttcacatgtcttctagaaatataattgtcacttttgcactccacttccacttcctggcaatttttctgctgccataattcaaaaacagactctttggccgttccttcacattcctttcccttttgtctttacagcctcatcacttccttctaccgatcttcatttcctgcttttgagactttcccgctgcctcctcctgtcatcttcaggtcccaaatgcagttttgccagattccacatccaaaattaacatcatttcctctttggctacactagtaaaggtgcttccttttatccctccagatccatatgtagcccaagtttgaagaactttcttctccctttttagagttgtataagcttcctgagagctggctctacaatctccatactctccagcccacatcacagtacagcactgaaaacagtgccttttatactttgggtaggcataggtatttgagaaatgagccatgaactcaaaaagatagcttcagggaagtcatgagcaagggtgacggcaggaagcactgcttgcctttcttcaccacccaacttctgccctctggccctttttcagtcctccactttgctccccactggcatgccacacatgtgagacagcatgaggtatgactactgttccatcaagtagggaggatgctgaatgcatcaatgacacattgcctcaaggttccattccactataagtatataagcaattgttctttggccagtgcatgtttttatgcagtaaactagttctcattttgctggacatttattacaacatttacccattacaaagaacctcattatgtttaatatatatgaaaacacgttcatttgataggcctattacttgatccattttatttgggtatacaggataacacaggatattttccttcaataaaatagtgagaaatttttgatctaagaagcttcaatatcacttttttttttagtacgcaacacattggtatactgtctgggggcaatctatataaatggaatgaatcctacttaaaaatcatttgttgacataaattattgagaatttcatattttaaaaatattataaatttctttacatttagaaaccaaatatacttctataaatgccacacttatttggaatatatttctgtacagtgtaagttgaatattcatttatatttttctgcaaaaattagttgttcattctttaattcatatacattttagcttcctttttcttttttttttttcccaaatccacaacttttaaaaattttcaacaggacttccctttctgaaagttaatgccttgattaacatttcacaataaattataactatgatttatacttgatttttctttgatttcattctaaattaagtttctattttaatatgattagaggctttgaagaaacaatgggatctgggaaacatacttccgctttatattaaaaaacagatttatcattacaattgttccaagaggactggcctttttctattttattcattgatttatcccaacatctagaacagtgcttggtgttcagggggcactaaacaaatacatcaaatgcctcctatccactgcactttacccactggggacttggaaggtcaggagaggcccttactgtgccagacattatagtaagcaatgtcacataatctcatttaactatcataaatattctttgtggtaactttcaacatccccatttcacagatgaggaaatagatgcattgagaagttaaggttttcatgtaagataacagaggtaataaattgcaaggttagaataaatgccttgaagtctgtctgtctgcaaagtctaggctcttaacaacaccctaagttgcctgccttcacccaaaagtattgtaactagaaggaacattaattactcttcctctatctccacactgtatatgaatattcagactgactgagataaaattacttgcaaaaagaaatctttgcaagtcagtgccacaattaagtcacgacctagtaccattaatctgttttggtttttagaagggtggcattctcctaccttgaaacatcaaaactcatctaatgagaagagaccttgttcaagggtaatgtgtagcttgcagttagaacaggtgagaggcttgacagtagcaagaccgactgctggtttacagcaatgtgaatgtctggtgcttggactttccaggaagcaggccagtgccatatttctggctggctgtctctgacttgaatttagggtcctccaagatactggagcactacctcccagaacctcacgtagtccattcatcaatatatccaacaaatatatatatggtgtttcaaatatgtggtaggcactgatctcagatttggatatatggagataaagaaaacaaagtttctgaccttagaaaattcacaatcttattgtatgtgtaggtgcatgtctgcatatacatcttaaaatatcattgcaagttctttgtgtagtatgaaattgtaagggaaaggacatatctttcattctcatctaggttcatgactagaatcttacctcaagtatcaagtggttagtgttcattcttgcccatatatatatactagtatgtacttttactattcacattttacagagaaagaaactgagtttcagagacctccaggtgactggattagcttctcacagcaaatggtgacaattcaaggttgaaagaatctctggtctctttgataccaaagacaaagttctaatccaccacggaagaaaaggttcaggaaaaggttcacagaagaactcacgagatatgtctgtggtcctacttttagacgtgcatttttttgtggagattgcttcctcacctgagcctcagtttaacatgaactgttcaagcgtaacaacaaattaggtgcatgaatttctctttactttttcagaagccagttttattccatttagcaaacataaatagtgatttcctctgccacattgctcaactatagcttattaatggcttccacttttccttgcttgtgccttaagggtcctcagtaattacccaacagctgtttagacacatagccccagaggctggtatggtctcctatttgctacattaggaaaattctatggtacagcaacatgagtgacagcatcaatataccttcataaaatgatgaggttctatacagctagggtttccccttccttctaaaataactttactttttcatgtcatttagaacccccaaaaaaggattactacttctgatgcaccatctgaagactatcctggatacttttatattaattagaaactgaaatgcttgacatgcaaacgctgtggtagccgtctctccccaggcaggcctgttgttatattcatgaagtgcttcctgaaagcttcttagacttgcagaggctgggaagggaattgtttggtctgtccatcactgcaattcctcctatttgttatttgtattattccttaaggccttcactccctacagattctgtgacagtattgatattacaatgtacatagcatatatttttcaagagtctgagggtacatgtacaaagtctatttcaattcctctcaacaggcactgaaatgctataaactaaacaaaatgtccttaccacagcttgcataatgtagaaaagtatatcatctgcaaggaaaagctgcagattctattttgctttcagtattttgaacaccacacctgccctgctatattcagggctagatctttgcacagggagttagtggccacctacatggtatgttttgaaacatacagaaatggacatcttgctcaacacatacccccattaggtaccaaatgctccactttcctatcttcaaattctagccaagtatgaatggttaacatttcaagaaaatgatggtattgtccaaaaacaattcctacaaaacctatttcttctctaattaatatattagaagggtttagggtaagcttctccaaccagcaacctgtaggccgcaggaggcccaggacagctttgaatgcagcccaacacaaatttgtaaactttcttaaaacactatgagttttttttcttttgttttgttttgtttttgcgattttttttgttgttgttagtatattctctgtgtggcccaaggcgattcttcttccaatgtggtcaagggaagccaaaagattgggaatcccttgtttagggcatcaagtagtaaatcctgaacctctgggttctgaaacaatgagaattttgatcagggaaatttctgtatcagagagtaaggtccaacctaatggtagcttataaggaataagatgaggacactagcactgaaggtgtagatccaggacttcccaacttgagacagaataaaacttctctagagatgttgtaaaatcattgattcttagactctacccccagtgattctcatttatttgacctggcaagacatccagaaagcctaatttttaacaaacacacagatgattctgataaatcattaggatgcatggagcactatttgagaaatgatgcccagtaataataaaacaagatacaggtgatagaggccagagaagaaaacatgtccaagacatcttcatctgcttcgcagtgtttcccagggctattgtgctctttgacttaaaccgttcatcatgtccttttgctcattgaaacaccatccacatactatacatattttttctgcctccaaagaaattattttctctagaaaatcaccttgttccttccaactttgctgcttgttctcacatctctgtcttttagattcatgagttttgagaggattcttggttcttctgggaaattaaccttcggactctcctttgtgcttcttagacattggtttttgtttgagcttcagctctgttccctctgttttcagtttattgacctcctctccatgatctctggtaacaaactgcctattctaacctgaccctatggaacctttaaattggagactgaagtctaagttatctctttagataaatagaaaaaattagagaaaatgcaaaaacacatgtttggcattgtactggtttagaattggctaattctgtttgggttggactaatttcacaattacttgcatgcctttaggatacatgacaattaatgtagtaaaggtaatttcaattcattctgggttgcagaaaaatgtgaatctggaactttcaaatgcatatgcataattcacatatgaatcatccagaattcacaatctatgtgtgtcacagtatgcactacatccacttattgattctactgcaattttctgtatcccaaatacaattttgagcctaaagatttaagaatatttttattactttaacttttcttattttagttggctgaaaatacctagaacctatttcccaatagctgaaaccctgctttctgattctatgcatctgaatctcaatggcaccatctctaggaaaattgttacttaaatatttcaaatacaatctttataaagctcctactatggtcaggcacttgctcaggggctaggaacataatgctgaacaaacagatcctctaggagcttacagtctattatggcagacagacgacaaatgcacaattaaacaaaccaattatttaaatcatttatgaatgctaaaaggaatattaaaatttattgcagaaaaccttctgcattttccaaacagaatgcgtaactttccttctccctcttacaaaagaaaataattataagacaaactaaggaacaaacagcatgcttctctcttcaaagaaacttggctaagccaagtaattttctgctatagcagaaaatatttatcccaaatctctaacttaaaaataaacttttgagaattcaaagtttaaagcgtgtgtgtgtgtgtgtgtgtgtgtgtgtgtgtgtgtgtgtgtggcgtggcgggggcgggtgggtagaaggataggcattgggtttttttctctacattgatgatttaaaaaaaaaattcttctccaactttggctccagaattaccatgtggaaccaaaggcaaagcccttgattcgcttgaaaaatttagcaggaaagtatctgtagttaattttgggttacacaatgtccttcactgtctgggcatagaaaagctagctagctcatctcatccagaaactctgccatgagtttaaaaaccaaagcacatactttgatattcactctgaaccaagataaagctttaggttgacataataaaagatggagttaacattcctaaaaaaaaaaaaacaaaaactatgaagctgtaggatatatttcagtcttattttgcaataaaaatgacctaatgctatctatcaccttctttgcagaacaatacttcttaataaaaggcatagagatatttatccttcaaattaaaaaaaatcatgtaatttttggttctttcacatgtatgctttcagaagagaaaaaacaaatcatgttaaactttacagtatcaaatgtgataaactaaaagcataattaacttgttctcttaacataatatggttgttttgctagatcccagtatactactttttccacaggccacgtttttcctcagtatgcacaaatgaaaaagagattaaagaatttgtgtgacctacaataaggtcagcttctaattattatgctaattccatgtactagatttaatagatctactacttttctaccagttaataaaatagactctaaaacactatctactatctaagaagggtgccctctcataccttaaaatactctgtttgaatagctgtgaaggatagtaaaatgtcttactattctgttattgatcctgaattttaaacagataaatgccaaccagaattaacttatttcatgcagcaacatctcaactctttatgttttatttttgaaagagccatttttctgaaattcccctactagataaataatctgccgaatcaaataactgatctattggcaatcccctcaactgaccaaataggctacaatgagttaatcacgcaaaatgctcaccacttgaagtcagaaatccaaattttgtgctctcttcaaccgactctgcaaagtatttgagcttgtgacttatttgagaaagtaacaatttattaacaacacagcgtataaaatggtaggttttgctgtggttttggaggtcagtttatcaaagtgaggcccttctctaatcatatgcaagaattgaatcaactaaaaaacacatgtttggatggatcatataatttaaaatctggattatgcagtgtagaactgtgaaaaaaaggtgaaaacctgctttctattcttggttcaattaattaagtgtgtgtacctcccaccttttataagcatcttcttaagacaccgttgacattcagtaaacaacacatgttgaaaatatgtaatataaaatatcatagatgatattttatacatctatgaaactgcaaaataatcaaaggtaacaagcatacctatcaccccatacatttttcgagcctctttgtaacctcttgttcccttccaccgattctcctggtaggaggccaacatttatgtgttttctgtcactacagattagtttacaatttctagaatttaagtaattgagataataaagtaagtagacttttttgcctggtttctgtcactcaacataattattttgagattcatctatgatatgcacatcagttgttcattcgctctcattgctcagtagtatttcttgcatgtatatgccatattagtctatgcaagttctggtggtttccagtttttgtcttttacaattaaagctgtcacaaacattcaaaaacaagtcactacagtgaatttttctttcatttctcttaaacaattactggggagtataatggctagattatagggtaggtatatgtttagctttttagagatatatggtaggtataggtttaacttttttgagaacctcacaaattattttccaaataattattttccaaagaagttgtaccatttcacattcccatgaatggtatgtgagagtttcagttcttccacattttcgccaacacttggtaagggcatgacaataaacagagtgtttgcttcatgggaataaatgattgtattgggatgtttatatggctgcttcttactctgaagttccatcattcagaatagattatgcaggtaaaaaaatagtcaacagctttaaataccaattgtaattgttacaatattttagaactactaacccagtattctgggtcaaaccaggtagacagtatacattagttccaagttccagagcataaaataatgatgatgatgatgatgatgatgatgatgatgatgatgatgtgtgtgtgtgtgtgtgtgtgtgtgtggtgaagctcatttaaaaaactttattgattctaggattagagaacacacgcatggcgtggtgagagtatataaaagagaaatccagtgaaaaataactcattttgcttttaagtagctttacttgaatgaaatttgctttattaccatatacttcttcattcttcaaaagcaattgggatgctttactcatttatgaacttgtgcttttattctaaagatttaaaaaatttataaattgaaatataaagaatttacacaatttctttcatttttacagacttagtcaagtaaactgcacttttctttttctgatgatgcatcttaattgcatattatcaacatagtttgctattcagcagggacaatttcataattgctatcttcagagaagtaaaataatagagggcttcttctattaacatttagtaaagtgttacaaatagcacttggtgaatgaagggcttcaaattattagaaggacataatattggttacacatgttcacagaataagaaagatatttttagttcctttcagtatatcaatttctgtgaaataaatagcattctgcaagtaatgatatgttactgggcaagtaaagctatgttgttaatttataatgaccaggatagaatgtaatataaatgggatgagcaaaggaaattcgttggttcactgctgcatcaaatctgaactctgagttttctccttatatccatcctttaatgctcagctcaaaatagatctctaagaaacgttctctattgtttccctattacaaagtatattttccttctttaacatactgtatcccttcttatctttaccacctatatgtttctgtttttacccctggctttatattcctaagtattattgcatctttgtatctattctaactgcattaaaagttcccagagttttggagccatagtctgaagttggttaagccccagtgacaaagtttactagcatctttctcattacttacatttgtataatgctttatgtatttcagaaaattttcacatttgatattgtctatggcataacaaaatgccttaaaccaagtaagaattctatacatcactcatcaatgatggtttctcttgggttgtctttgtgtaataagatgctttttagaaacaatgggagctgtaaagtatttcgaatggtatttcaattctagcagtgtctaatgtctcaacgtctcctttctttttcaacaaagcctccattttactgctttccagggtcacacttgattatccattcagagcctcagtggcattttcacagatcatacactatatgatatgtgggacaataaaataaaatagtgaaataagagtgattatctcaaggtctccttacttaatcagtgttctttttttcaagcttaagggaatggctcaaagagtgaaaaatatagtcaacatgtgaaaaatttttgtttgcttctttacagtctacaagcttattaaatcattactgcaatatattctccagccaaatattggtatccataagttatatgaaaggaataattgcatatcatgcagcaggaagaagaaaatgcattgattatgggatttaagaagaaatactgctctgtaactatctgtacaattggtacaataggttgtgttttgctttaaactggacagttgtgctgtgatatcaatatttcttctcttggagtagcttagtacaaccagcggcaaacagtctcctcaattacttcaatgtgtcattcaaatatcatcattttggcgggcattctgatgtgtaaaagtttggaacgcatggatagcattaacagcatagggattcctcctcctcctggttacagagcatgtgtatcagttttgtgccttagagatacagcattatggaataggaatttcaggtgggaatttcataatcaaaggttatgattatggggtgagagaaatgaaggaggaggtaaatagaggaaaggtcagattcaaacccagatgcattgtgatatacaaaaagcataggctgtttttcagtgtcgaaataaaaatcgctgaggatggtgctggtcaggggatacaggccctccaggtgatgaagtttatgggatttgtgggaactggagagaagaaaatctacgcaggagaaatgggaggggaggagtggtggccatcaggaaattgagtgtagccagctggtctgaagaaagagtttactcaaagaaataacaaacaatgcatttggggatttaagctctgagcatgtagaaggcaaggctcagtcttactttagttcgaccccggtgacaggcatgggacctggaacatggtggagctcagtttattaagtgaggtagcaaaaaacagttgaaaaaactcggcaggattagggagactgagctttatctttttaagtctttgaaaagtcccagagaggttttggagtagaatataatttttcctgaaatactcattgcaatagaaataaatagcaatatcaaaaatacaaacagaaactatctttttgtataacattttaaactttacaagatgcttctataatcactatttattatcctcacttggagatacagcataactattaactaaccactgaactatttattgctaataaagtagacagtatagctaagcaagtttcaaaacaaattattttgggtgacacatatcacttgaataaaatactatataatattctaataatgatttttaaaaggtcctttttattcccatccatcattaaatttgtcataatcacatcccagattataaacaatgtaaattaatatggtaaccctcatatatatgtagagatctgagacaaaaattgtgatttttttacagaaatgcatgttggcttttccacagctactcaaaataaataaataaataaataaaaatagaaataaaaataaaaataaaaaaagataaatccaaaaacaacaacaaaaaaaacggaattaatcagacctcaaatttagaatagtaatctccaaaaaggctactgctagcataattttcaaggctaatccaaaaggagaacacaacatgaaccagtaattccaacacataatttttgttatagacaaaataaattttaggagtagttttatacatgtatagtccatattgtcacactgtattcaattatttttaatcctagctgcatatatttatctagggaaaatatgaatcttaagagcgttgcactatgtatctaatgaataaatacaggtcttttctcactctgctatattcctaaagattagttcaaggtgaaaaagcatcatacatgttccaaaagtttgccataaaatcagtaagaagctgttcacatttatatattaacaaagtaatcatttatcattaaaaaaaaactagtgaaaacttaacaagtgctcttccatatatttaatgctatttatttttattattttgctgagatataggtatggctttctgtttttattgtaacgtaaacaatattaagtataactttcttttaaaaaataattttagatttacagaagagctgcagtgttagtacagacagttaccatgtatgttcttcacccagtttgtcctaatgctaatctgttacattaccataggatagttattaaaagaaactaacatggattcaatattattcaccaaattacagactttatgtggacttcaccagtttttccatgaatcttcttattctgtacctggatccaatttaggatcgtacctcacatttagttgtcctgtctccctaattcccttggtgggagcactaaggaaacactgactcttttaaagagtatagatcagttattttgtagaatgtgctgctgtttaggtttgtctgatattttctcattattagattgaggttatgcatttatttaaagaatattccagaagcagtaagtccttctcagagcatgatgtctggaggtaaatgatattgcttggtgatctttgatcacttggtttagttggtgtccgctgtgttactccactgtaaaagttactatgtatcactttagagttaataaataccattggaaagacactttaagattatgtaaatatcttttctcttcttaaatttttacccactaattttagcatgtatctgtggagcttatctgctttaatggtatcttttttgtaattcaaaatgtgtaacttacataaatctttaaaaacatgacttctacaaagcttgtatctatttattttcttcttctggtttcctgacaatgcaaacaaatgttagagaatttatcttgagaacaacatttcccaagttgctatagaaaccaagtaatgaagaaaagactaataacttttctattctatatagtatataagaaatttaaaaaattattttagtgtttaatctgtttggctattttcacagaaaatacattttttttctgtgttgatagctaaaattcagattttccagtagctgaatatggcaaaattatatgatataattttatatacttcttgatttattttatattatcaatatcatgttcaaatcatttttctgataattataagtgatacatatacattacaccaaatttatttaatattcatccagtcagataaatcaatttttgcttattgcatgcactttttataactaaatatatactattgataggaaatggttggagtgtaatttgtagtataagaaagcatgctggccttgaggaaaagcttttttgtatttaaatgtaatgacacattttaagtacaacagtaaagaattaattattgaagtagagatttgtaaattcagcagtaaattttaaccatcaatatatattttgctattttgttaagctaacataatttaagcttctagtaagtatataatagttgtaactgcacataaaactttagagaacaatggaaattttccatcagtgtttatgatagggacaaacccaaaaagaaaatagaatgagcttattacgatttaaaattacctttctgtatcttctattgtcattacattttatttgatctttattagttttcaacttttaaataaactttttaaatattcaacttggtacctaacctaatgtaaaaactacatgtaaaaatcaatgagaacaaatttatggtgacccataatatttaacgattgctaaattgattctgaaaatatgtaaccataatttgctataataccattaatctctgttgactatttacagcatttcataggaacttaaataatttgattttttacacagcaattcaaaattttcttactggcttcttcattatgtatcatcagctttcagctataccaatgttaaaaaaaaaaagccacaaatcacagttagtccagggaaaatttcttgtgaattgtttttgtttgttttttaaagtggagtgtaattgctaaagttagtctaaaaccatgatttcattcaaatgtggctatgctttattctacagagaaaacttgccttggtcataaaatttatgtggtcaagaggtaacacatgcttgatgagcttgatttgcaattttaagttgtggttaaatccctagggaagcacagaattctttatagaggtcttagaacaacaaggctggaaatagtgttacaatcatccactctgatgttatggtcctccacccccatttcagttttcttatgagtaaaatgtgagtatcaatattttgcttagcaaggtttaaaaaaaagaggctaaatgaagacaaaatgatgttcagttgaatttcccagctctgttatagataaaatattatacacattttatgatacttaaagaaaactgattattttgaaatttattaaatatattttaaatggcaacattcagtgaaacttttccatgaggtccctgcaatgggagatctcttatgaaacattagttattaaatcaaacatgcttttgtgtgcaccactatgcatttataattcaaacatatctttacatttgcaaaacactatattgagatcacatctaatgttattcaaccatcattttgttctagcttactaaactggaaaataaactgtttacttaactggtatttatttaacctgaacatatctgcatatattacaaagcagacaataacagtgggcaatgtgatatttgaaaggagtggagaaaatgaagacggtggcaataattaaaactaaaagtagtttagagaagatgccagctctcagatttgcttatttatctctaaggatatatgtgtaaaaatgtatttctattttagcccaaaaattatctagcacaattttaattacaatttattatgtgagaaattatgatgcctttgatactatttaaaaagacatgtttagatctaattattttttctaccaatactagcaaaaagtgcttatttgctaaattatatatgtatttgaatgaaaataatatgaagccagagtcattaaagttataatttacagcaatgcctacagtacagtatttaaattgcttaattttttcctttcaggtagaaacaaatgtaaaaacccaatgattcccccattctatgcagaatacaagagaaaggtaatcttcagtactgctcataaaagatgtttacatttagcagtgtaggaatcatggctgggtgtgcaagattattaggatgcttcagggtggttgctttattttgttttattttgcaggaaattatgtaaccagcaaacagacagaaaaagtaatttgttgggaatatactagcatatgaaaaaaaggacccattcactaattcatccatctatctagccattcagcactgattaaacactttttatttatcagggtctattttacttagtaggaaaacaatgacatgtaagacatagactaccatcttcaaaagcttccaactacaccatggaatactatgcagccataaaaaaggatgacttcatgtcctttgcagggacacggatgaagctggaaaccatcattctcatcaaactcatcacccgcctgtcagggggtggggtgctgggggaggcatagcataatgagaaatacctaatgtaggtaactggttgatgggtgcagcaaaccaccatggcacgtgtatacctatgtaacaaacctgcacattctgcacatgtaccccagaacttaaagtataataaaaaaaaggaaagtaactcattaaaataatgtgtaataacagccttaggaaaagtgtttacaaggtatcatggcatttacagaagagtatggaactcttggtgatattgcctggaagggtaaagttagaatgaaagaaaagtcattctcgttagataacagagcctaaataagggcataagaaacataagttaaaaacaaactaacaaacaaaaactccaagtagtctggacatcagaagcatggaacagaagtggagcacggacagtagaggaaagcacaaccaatgactcaggcaggcagaaaccaaatcaaggaggccttctctccattcattcttaggccgtggagacctgggagtgatttttagacaggaatagcataatctcattggaagcttacagtattaagtatggaaaatagaaaggaagcaaataggaaacagagaggtgagttgagaggctactgcgatagttcaggtggaaaatggtatgtctaaaacagtagtagtgacatagagaagacgggtgacacctgagagtgtttgggagtagaaagggcagaactttgtgatcacttacacatggagatgagacagtggtaaaagttgaaaatgactcccaggtttttagcttgggtgaataatggtgtagtcaacacagggtgaaaataaaggaagaagaatatgttttggagcaaagataataagtttaattttaaatacatttaatttgaaatgaaaatagactagctatggaagaactaaatgaaaatagcccagtgatatggtttggatgtgtgtcccctccaaatctcaccttgaaatgtgacccctcaatgtaggagatggggcctagtgggaggtgcttgggtcatgagggcagatgatccctcagaaatggcttggtgttgttctctgtggcttaaaaagagcccgacacctcttccctctcgctcctgctctcaccatgtggcacactggctccccctgccttctgccatgagaaaaacctttctgaggcctcaccagaagccaagcagatgctggcatcatgcttcctgtacagcctgctgaagtgtgagccaaataaatctctttactttataaattacccagtctcaggtattgacttacagcaagacagaagagactaagaagcccagaaattctacagactataaatgctatttgtgaatcaatagattttaaattaattggcgatactgcttgcgtctaacgtgctcctcaagtattttgggctgctagtcaataatagaaacatagacagatttcgagaatgacttaattcattgtgttagactacaactgcttggaaagcatagtttaaattcatgctgtatcaggaaatcaactagacttggcttgctgtataaataagcagcacaattaggaagaaagaagcatttgcatttggccagtggagtgatgataaactagaagattccttttgggacaacagtgaaatatgttaaatcaagctattccaatgcaatgtaaacaaacaatatatatcatctcagaaattcaattaaaccatgaatcatcttgtcattaccgttactccagtttactgttaacatggcataaatgtattttaagctgttaaacaggggcatgctattctttgaggaatctgaattttatgaactgtcacaagagcaataataaagatggagagtatcagctaagaatatccataattaacaaatcaatatgttctagttatctgcagtgtggttagctccatcaagagcaagataaaggatcaagaatgagaataaagagtgaattaagcagcttaagatccagtcaaaaagacaaaatattcattaataataaaaaaatcagagtcaagtcctgttgcaatttgactcatgtaaaagttgaactcatgttcaaacgtaacctccaaagttgtaggtgggcctagtggtaggtgtttgggtcatgggggtggatccttcacgaataacttggtgccctcccagagctaatgattttacaggatatcttgttttttaaaagagtctgggacctcacccttctctctcttgctccctctctcaccatgtgacatgctgactcctcattcaccttctgtcatgattgtaagcttcctgaggcctcactagaagcagatgctggcaccatgcttgtataacctatagaaccacgagcaaaataaacctcttttatttataaataacccacccttaggtattcctttatagcaatgcaaacagactaacacaagtcccgaagaagaaggttagatagattagaagacagattagtggttaagaggataggttttagcgtagaatgtctgggattgattttcatttctcctccatactagctatgtgaaattgggatgactacttattctcttggaggctcaattttcttgtctgtacaatgtaatatttgtgtccacttaactagttgttatgaaaatataaaacgataatacatacaaactgcttcaggcagcaccatgcatatgctaaccattcagtaaatgttagctctaatgataacagtaattggtattattattataaaaatcaagaaccaaatcatcagaatatatataagcactaaagagttccaaagaaaggaaaggtcaattggtcctgagctctttgttgaggcttgaaaagccagataagctttctgaagtaaagagaaaataagctattttaagtctctgttacaattcattcattcattcagcattcattcatttattttaaaattacacataaaacattgattaatcatttgatggcaggtgctcaaggccatgaaggtggtaagtgtgaataaaataaaggtttgtttttgagaacagtgagatataaagtatatgggcattcacagataacagggcagagggtagatctaccattgttctcatcctactccttctttgctgccaagtaagtatgaactatataagccacaaaggggcatgacagcttgtgcatatccttcagtctttactcttttgaaacattattgttaaaaatctctgcctttagaaatagtaaattataggcaaagaaaaacacggagagcagccaatttgggacattcccaaagtgttttttgttctagctctgtgaagagtctctggtcagattttaatgagttttcaatggccaacataattgatattctcttccagaatttaactttggcatgtctgtgtgcaggctattgaaagactctgggataagtcagtggtattttaacgtgaggatacaaatttcttaagttggctttcctatttcttgacactgtctaagaaactctactgtatttcaatctcttttgccaactagagggatatttttgttagcactcagtttaaaaagcctaccattttgactaaatttactggcctaattcagttacacagctaatcaatttagttaattcagttggtttgtggacctttcattgaattaattgattttttttttacctcaactggctgagagactagactggacttctgggaatgtattctctaagcacatataaaagacaattgttttgtgttaaaccctagtatgtaggccatgacaattttcattaaagaagtccagatataaaacaaaattgtaaatggatattccctttctcaggtcagtatttggaaaagcaggtttcccacccctccatttccaaacccattcctacttcttcgtgcatgtggagagaaccacaagaggcatattagtgcttcctgcagtacaaatcaccacctacttttaaacgacatctcagaaattattttaaagtatgacaaatagaaacatgtattctagaaatcatatttctaaatattaaattttccttcattaaaaaaattctatcatcttagcattcaaaatatattttttaaaaaatatcaattgggtaagggtctgagatattacaagaataattttcttccatcctcccaatagttagtgacatttatttagaacattccactttcttttctgcccaatgcgtctgattttatcaagtcaccattctaaactaagcactgcatctggtgttttgtttggtaagacagatttgtggggcaagttcaccaacacattatgatcaagcattgtttagattaatataacacgaatacacaaggctgtattacaatttaaattttatttcacatgcaaaaaacttcccctttacagaatttagattaatcccatggtttgttattgactatctttagaaagaatcctattattccaaatgacaactttgtaaaaatgcagtgcagctataatggaaagtacaaaagttatattaagataactcctttctgagtacgtgtatattcattttacatgtttcaactagaatcaactcttacaagtctgccttcagccatctgtatcactgaccagcattggaaaaacctcattttcaatttctcggcaccgttgacatttggacctttaatgactcattaaccctttacagcctccttctccagatcttttcaatcacatatgatcatgtcgccaaactgagatatttttgactgttcgttgctagtgcagataatattctctcctcttccattctcccagctcagtgccagactggactgtatatgtatgagatgaggatgataaatgggagaggagagagaaagccaggcaagaggtgggggagtagagcaagatgattgagcagagcaaattagaacccataagttatattttactggttttagaccctaaagagatagagcttagaatgactcaaaagggaatttatgagactatggactgcacagtgaagcattagaaattctagggacagatgtacggtcagagttgggaaggaaggaattgtctacttgttacaaggtgcagtgccactctagagaccacagattggtagctcttggggcatgtacaggcacatgcttaacatggatcgggctacattgagattttcttcttggaagaagaagatgttactgtcagaagagtatgtggaaaagtagattcccaaggagaagattagtaatggggtagatactaaacaatgagatagataccaagtagggactccaggtgatgggataggttttgagcatggggagacatccctctggaaggattcttggagtatgggacaaaggctgaggtcctcccttattttgatgggcacaatcaagccagcagacaaacaggctactcagaatcaaagaagaacaccaagaagtaatgttgtctgtctttagcaaggagcaaggaagagagcataggcaaagaaaaatatctgaaaatgttttagctctcccagaatcaagattttagtgtggtttcattgcttccaaaaattacaaactttccaaacacactagagtaaagctcacacaccacatattaaaatcaatgagagatgatctgtgattactcactattgacatggatcattgatgacagtaagaccctgcaaaataaattcccttactggacttacaaaaacctcacaaaaatataaaagtaaataaaattatctttattctattaataaagaaaatgtatatgaagaaaatgcactttacaaagtataagtaatttgccctgaatgacatggttactgttagaaccatgacttggattcttaaaggtttaatatcctgtcctatatgctatgctacctctaaacatcacctcaagaattcagtagaggccaggtgcagtggctcacacctgtaatcccagcactttgggaggccaagatgggcagatcacttgagcccaggagttccagaccagcctgggaaacatggcaaaacctcgtctctacaaaaatacaaaaattagctgggcatagtggtgtgcgcctgtagtcctagcttggtgggggttggggtggggggatgtgctaaggtgggaggattgtttgagcctaggaggttgagcctgcagtgagctgtgattgcacctctgcactctagcctgggcaacagagcaaagaccctgtctcaaaaattgaatttaggaaaaacaacattacatctattactttttttaaatatacagatcactcactgaatatataattataatatatctgatgcctgtatgaattaacctaagtaaaaaataacactgtttcttctgaatttattttgatttttctttgaatcgaatttattacccaagccactctcaagcatcctacagagacctatgaaggatgagttcttatgtgacttagctttaaaattaaaaaagaaaaaagattttaaaatagcaagcaagcttttgcttttcttaagaagtcaagaaaatggactatagatataggtaaaatacagttaaagagcaacattgttataatgttgatacaaagtcaaacatatgaataaaaaaaatgtcaatcaactggatcctttcaaatatctccccaaacacctggaagatgacaaattttttagattgataacctttataatgtaaccaagaatattacacagcctttgtgagatagaaattgttttaatataggatagaaatgagcagatatcacaatggtttgccacaagtaaacgaatttccttctttggataactttaagtaaagctaagttcaagtgaaaaaaaaaaaagctaagcatgcagtggaaaaaaaggataatctgtttggattcaaggttatgctattcaattctcaaatcactgagcagcatttacagtaaaatgacactctcatttatctcccaggcaagcattgagacctgccttaagatgcaggaggttagtagacttcatagcacttaattttctaacactacaataataatagttaacttagtaaaaaaaaaattctgtgtcttcacataaagtgaatcaaaatatatctttgcatcactgcctactgtaacctcaaggaacttattcatctaccaacagccaagacattaaaaaacagagaagttggtctctcaggatagataccctattcacttaaggtggggcagataatgcacagactctaatgttggatctgtacactattggccccaccttaggtgaattaaaccaacaacatcaacagggaaaaatgtgcaaaaactgtgttgttctcactttatcagtctttccaatgtttaagaagcacagattatttgctcagaagactagaccaactggaaattgaatgatcttgatctcttttaagaaaaaaccatttgatctaaatcttcaaataaacaaaataatttgcaatctgtgtcttatgcttctattttgggagtcagaccaggcatgagctgagtagcccattctgtcttggaggacaggagcaaaagggactgaaatataaagtcacatgtgggcattaaagaacatcctggagtcccaggccatataaaagggcttgtaattagtattttagtaaatactaatgagaatgcatgtatcaacccacattagtaaatattaatctgaagtaatattctaggactatttattaattactttcaactcttcccccaaggtctagtaacccacaaaaagcttgaggaagaaaggaaatagaagctttgctttgttgaactatttgatactaataaatatactgggcagccatgccatttttataactaatcaaagcaagtggtttgatgttaaatcaataatgtttatacaaatttgacttattagatacagtgatagttacctcatggctggaaatcagcatagtaattaaaattgtgttctgatatttattagttctatgatctttggcatggcacttatctttctaagcctcatgctgtctcatctataaaacagaaactgataacaaaatccacctatcaaggattctgaggctcaaatgagatggtacagaaaacataaatgtgcctggcacagggtgacagccaataaatggcagctgttggccattaaagacaaggcccattaatttgtaagttagtgcctactacaaagagcatagattagaattcacacctggattaattaattttcatcttctatgtcctaaaactcattcctccttgcaaactgggtgagactatgtagatgccccagcaaattacccagacggaagatgatgagcaagtagcatctctttacttaaaaagaatcatattttctttccaagaaaatcttcataaaccttagcccatttacataaccaagccatctctcaattggtcttgtttgagtttactatcccatgtcttcttacttttttaaaagaggtaagaataggctttgaacacagaatctggtaatagtctcaaaattatggtgctaaatttccttggcttatcaacattaaataagggaaaggaaaatctactaggagcatcgtgacttggttgacacacatatgagcacgaaaggtagggtaatatttttaactatatttagcgatgttatagcttggggtcagttcagaagcagaaagggtaaaaacaaagcgagtaatggtgacatgcaatattgtcctcattatcagaagataaaaccatcatactctaatgggctgatacagattgcaatttttagtagctgatatttccaagggcctagcaagacagagtgcaacagtacgtgtcacattctaaagtctaggagggaaaccaaagtgatctcagtaacataggaaaaattttaaagatatagcttatatatacattctttagtggactcaatagctgtattaattatgagacatggggggaattatctcaatacagccttgcacataacacatttgtatgcaagttttacacatacatctatacctatatatgcatataggtctatacacaaatattctgtaactacacatatacttgttcattaatcaaccattgagggcctacaaagtacagtgagtgaaaatatatagaggaagcaacactgagctgctgtggacacagaccatacttatcttgaaggtctctatcctgcaatcctaacttcccagagcagactactaatatattacaaagtaatctactttgtaatctgttagttttattgctgacggtattttaattttctgctatttggcatgacgaaccacagaggatcagaggcaaactgttgctctcgcatggaagtggctcctatatgaagacacagtgatgatgacaagaagcaattgctctcttaataagggagaaggatttaaaatattagttacaggccaggcgcagtggcttaagcctgtaattccagcactttgggaggccgaggtgggcggatcacgaggtcaggagatcgagaccatcctggctaacacggtcaaaccccgtctctactaaaaatacaaaaaattagccgggcacagtggcgggctcctgtagtcctagctactcaggaggctgagacaggataatggtgtgaacccgggaggcagactgtgcagtgaaccaagatcaagccactgcactccagcctgggtgacagagcaagactccgtctcaaaaaaaaaaaaaaaatatatatatatatatatatgttataaatggtagatctaggaacttagaaagtacagtagtttagtgtgagggcaaacagctttacatacttcagctgccccaaaggactgactgtattacagcacagtacagtgactgatgttcacaatgatggctttgggttatcaaaaagaagttaactcacgttagcaagttcaatttaacaaggtacgatgtgtgtattattttcaaaatggtaaaaggagcaagaaaagttttcttgcataaaacagaaggcattagttatatggaatgctcacttctgtaaatacatcttccctaatggtatgagatagttagtatacatacccatccatccatctatgcatttcatctttggcaattttctgttcttttagttaagataggttaccgactactcctaccactgcaaatatcaccaaactacaatacagtatactaattactaaactagattaacactgatggctaactttattatttataattgtaatttcagatttcatatgaatgataaagaattctgtaaaattacattattaacatcttagagccaggtggctcatgcctgtaatcccagaagtttgggaggccaagtcagaggcaggtggattgcttgagtctaggagttccagacaagcctggacaacaagttgaaaccccgtcactacaaaaaaatacaaaaatagccgggcatggtggtgtatgcctgtagtcccagctactaggaggctaaggtgggaagatctcttgagtccaggaggtcaaaactgcagtaagctgtgatggtgtcactacactgcagcctgggtgacagagcaagatcctgtctcaaaaaatggaaaatacaataaatttaaaaaataaaatttgagaaaaattgaatgaagaaatatgtaataatgggtggtggtatctgtcttactgcaggtaagttgttcctcaactaactctttctgcctcgaaggtggccataaattgacacatactgataatcgctaagcaactgcatggattatttaatacccgtcaattgtagattatgacaaacataaagagatagtctttgccaaggtccccagtttagattgttaaggtaaaaccctgaaatcttactttccctttcaagtttcctatactttattttagataaagctaaattgacatgtttagttttcataaaattgtaagtttctttgcttacatattactaatacttgaagagtactgggaatatcatcctgtccttgttaacaaaagtgaacagaacatgaaccagagaatttgaacttggagatctagatgatagctacatcattaagaaataaaagtagtcaaatggaatattcagttgtttttcataatatgactttccaaacattattataaattcaattttggcttgtttctctcctaaagaggcatgagccagtttatatactaaaactacacatctcacttaaacaaaattattatttttattattatttcaattaactttctttcatcctaacttctaagatgctattttggttgttctctttgatccgcctgtttttcttttgctctgtaattgccatcacatagcaagatctagcccttagccttctacagtctctctaaaaattaagcatatcactaggtggatttaaagccaacacactcaggaatattcagtagttttgcatgtcactagtttcctgatctgaccttactgccatatcatctggatatcccacccttttcaaatgtaagacccaaattacaactattttttctcccacaaactagtttattgacatcaccattatctccattgctaaggcttgaaaacgagtcatctgtttctttccagtctttattttcatttggattcatcacttttttctttggaatctataatttctatccctttacctctcttctcaatatcctccaatgagtataggatcccttaagttcaggcacaaataacttcagcagtctctagtctcttctctcctcaaatccattttacaattaatttgtctaattttgtttcatcctgtcagtatcgtattgaaaatactaactgaataacttgtaccatgttcttattttgaacctaaaaggtgatgcatcatctttgcatcatcaaaccccaatgtctcatttgcacctggaaaatcatagcaaactggttttaatgtccctgtttccaatatcatcagagcctgcatacttgttgtagtttactttttttcctacactcaagtttaaccgcatcaaaaatatagatcttgcttctaaaggtaatcttgaaactagacaggctttctctaaagtataatttcaggggcttggagctacttacttcctctccctcctgaactgattctctttctgctgtctatggtgccacaactagaaatacatttctccaggtttaaagctgaaccctcataactttccaagtagccttctagcaaaaaacaaacaaagaaacaaacaaacaaaaaactagagttttcttttttttaatatatttaagttggcttttagaaactggatggcagagtgttttatttggcaaacatagtacatttttaaaaatgaagttattatccacatttacacgttaggtttcaaacaaaaacttagatttccagtttctcataaaaaacagttgacgttgcaaccagaaattgcagcaaattcctctcacactcctgagtctttctaaaaggggctactttggagggaaataataatattttagacagttgaaagggaactatgtcactagatacaagaccatgtcagcctctcttaggagaaaatcacctttcttgtttcaggccttctgcccatctgcaaaaacactactgcttgtcttctttaataaatggaagcaatttaaagaaaacaatctataaaatgctacataagaccacattaaaactacaagtaaaaattgacatccaacaaaaccctgctttcaaatacaatttcttagaaagaaccttgattctgctgtatccaccacatctcgagtctatctccagggaaagtacaatagcgttaaaggtaacgggtagagactgttgccaagtcaatgaagcaaagactttctctctagatgcatggaaatgcacggtgatgggttgattaggtcaaggcatcttttgtattatgcatgtaaatgggaattaatgtcctcagagtgccagtagctattttgttgaatttggtaaaaatgaaaccctgtgtttaagcttcaattctctaaagtttatgttgggaggaagatgcaaaactctttatacttccataattaggtattcctttgctgacttatcaattgcctcaacttaggactcaaagtgcttagcgtcaaattgaaagagaacacatcttttattagaattgcttttggtttgtttcctctgataacaaggtaatatctgcaaaccagtgaatattgacactatttacaaccaaattataggaaaaagtcagtagggtatttaaagatgggattagtaatacctcatttacctaggcatttcctgggaaggagcaattctggataactgaattttctctgtacctgaagcttatgcccatttaaacctaaatattagatagaaatcttcataaaatatattaactgctacattcctgtcttcctacatagatacttctaaacataatactatcttttttttctcctgatgattcaggggtcatctctgtgagcattcattactgtaccatgtggttatatatttctatgcatgctttatcatttttttctctcctccctcaacgtcaggctttcagctgtcactttggctgtcactgtgtctcttctcagcttcccctttgctgtttctaatctgtcgtgggctgggaaaccagataaccaagtttattaagaatgacatgctgaataaaagtcagtaagactcagagtgggcactaagaaataaaatgcatgactttaatgtgcagtttttgtgaaaactattttgaatatgcagaggctttttaaatttaattttagattgggcaaccgcgttagggttgaggttgttgtgagaatttgtagaatatgtccccattcagtttcaaagtatttctctgcaggagaccaaggcagttttgacaaacacgggcaagagaagctaagttttccctttggaagcagaggaatctggtagggaaacactcaaggacactcatgtgaggctttaggcaactgtggagatcaaactcttctctctgatcaccagatatcctcttcttcatatcgagatggagggcattgcctgaaagaacgaaaatttagcactaataggtaaaatgtatggattcctgttagaatctctcagaattttaccttctcctttatagtagaatgttggctaggtgagatagaggtaatctgggaagggaaaagtccagaagtcactgtttttcccatgtattaatctacccacttcacttccatctctttctggacaatgcacaaatcagaaccctaacccaacgtttcttttcctgagactaatgctgtccctgaggatagtctatggggtccccaagtgcttgtggcatcctgggcctccccatatcaatacatcaccaccacctgttgttaaaacataggctcatgtattcacttgcttttattcgaatgacttaatcttcatggcctagcaacaaatagaaccctccctacagagccctccttatataccttattattgcatactcactctttttatgtcctctctcagtgcttctctcagtgctcattttaaaagaatttcacctctctaaaacagagtggtgcaggactgggtgggtagaagaaattgatttgttttgcctgcccctgtagccacagaatccagttacagccaggtttttgctgcaatcagtaaggatttctcatgttctaacaaagatgaaagcaataggagatagcatccgttatcttctcagggactttcttttcagtatgacaatgggcattttttgttgttgtttttgtttaaagccaacttacatgctgtacagcaagggcctccatcttccaaacactctaaagagtaaaattagtctgaaatccagtagaagaatactgattataccatcagtccaaaatcttcagggccaccagaaagtgccatgggcttgcggctgctaatcacttagtttggtgctttctaacaaggtgttgtctttcaggttttttgttgcatcacactaagctatgcttgcttcctccgaacacatttaagtggattctttttccaatctggagacttataaaaataaatatacatacccctttactactaatagtagggttttctgcaattggatctaagttctgggagcatgagtcaggggaatcaatttattctattttaggatatgcattgagatccacctcaaaaccttttaaatcaagattcaattaaatttaatatatgtaagtttgttatattaaaaaaacaaattgaaacaaaatatcactggagagacacaagaaaactgtacagtcctgtggtccttattttatctcttctttcagaaatgttggaagccaaactaaaattacaggcttgaaaagaaaaccagttttagaattccatcgccctcaaagatttcaacaatcaaaacaaaaccagttttataattccatcaccctcaaagatttcaattatcaccactacaaatcaatataggtaatcacttgcatacaccaagacaattttactctaaatgccatgtctatatacataactggactccatcctttaaattctctgtataaaaagacccagctcaaagttacattctctttgaagctatctggatttcccagatagaagtctttggtctatatttttaatctaagtttagcatggttgcttggtcttgcactgtcatgtgttgtaccacatgatcactcaataagctttaggtagcaaaagagggagttctttccatctctgtgttctccaaaagtgtctagaagatagtccaatgtaggaaacaaattatatttaagactgtcatacactgctttgtctaaaaaaggagttattttgaaatgagaaaacaaaagctaacaacttccaactttataagcccatttgaggcttcccatcagcttgtttttttttgcttatttgtgtgtgtgtgtgtgtgtgtgtgtgtgtgtgtgtgtgtgtgtgtgtttgagacggagtctcgctcttgtcacccaggctgcagtgcaatggtgcgatctcggctcactgcaacctctgcctctggggctcaagcaattctcttacctcagccctgggagtaggtgggattacaggtgcccgccactatgcttggctaatttttgtatttttagtagagagaaagtttcatcatgttagcaaggctggtctagacctcttgacatcaggtgatccgcctgccttagcttgtattttgaataacaactctaaacagaatgccgtgatgtcaacatttcattttcacatcaaattttaattcaaacccaactttccaacctgtaaaatttgctggtaggctggccaataatatgtacataacctgaaatgcaaaatatgatgaaaagcatagtgttataaaatagaatattccagacattcataaatatggatttgatggcccatactatgaatgattcagcacgcagacctttgaaattgtgatagtcctctttatgtacagaatgaaaaccatccagaggcaacaaaatgtcgaattctctaatccatcatatcatgaagccatcacagccttgcacatgagatttggttggtgggaatagaaaaacatttgcaagtctctggatttctctggctctttactcagagatgtcacatgcatccatgggtttgagaataagtgtaattgaagtgaactgcaatgtgtctctaataagtggctttgagaacatatatttgtgtaggcatatagtacatatctgtactgaagcactcttatcctaagtgtcatcttgtagcacagacctgatcaaactccgggattcaaaatgataatttatttggtataaatgacacaagccaaagaagataaaatatgttaagtacttctcttgattttctcttctccaaacacacacagatattaaataaaccactcccctcccggttcttttcctttaaccatgagaatcactgacccactgtgctctcagtattatccatgtgaaatatctgccccctcatcgggtacaacagattaaatgatgattaagctgagtgttaaatttaggatgttgtttcacaaaacctccctaccttgtagtgacatttttttctaaagacattttcttgtaatactccaaaagttaatgactgaattttagatggaggcatgacgtgaatctcaaatgaccataatttctttataggcaaattatatacagagttttcaaagacgtgaagagagttatgcatcgttgattttataccctaagtgatgattagaagtaaaatttcttagcttaaaagtaaacagaaaaataaaggaggtatctgacatggggaaagaaaatctcaggaacatagaactgggcttgcatactgtatagtacttgaaaaaccgttaagtggaaatgtatgatctcagaatagtgtttttaggcttaactctctgcgataacaggttcagactgacctggtatctcataagacattttgatagcaattcaaataaatgagattttttaaacattgaagttaaagaaatttttaaaactcttcaaatgcttatttttttaggaaggataaaatggtcttattttcatctgtggaaacaatacacatgagcagctttattctgaaatgccattgcaaagatttgtaatgcttttctattgttttacgatcagagttgctgcttttgcagtgcagaacaatgctgcattatatagaatcggcagattgaaccaagaaaacaaaagggagcactgggcaaccatccgttccttttaggactcttgccctcgccacatatcaccagatctctttagttagtcagtcttcttgtggccataacaaccccgagggctgactcggggatgcttccatagaaaatctctcattcactttctctctctgaactaaaactgtagcccaacagctcccattccctattctaagatgaatactaagactcatctgtgaagtcctttcaaatatacacaatttagcttatacgtatatacattaaagccaactccatggtagttatattcatctgaaaatcctttagtttatatcctgcactgattcaggctgtcttggggagatacgtctgtgtgtgaaaacaaaaaaatggcaaatgaattgacttgaggttataaacaaagatccgattctatctaatccttgctaatttcccctccttcttttattttccaagtaagcctagttaacaaagaaattttacagaaaaaaaaatgccttggtaaatattatctgaataatcctctataagaaaagcaggctctatttcataaatggaataaaatgcctttgaatatgattagagattgcatcattatgtcatcctgttttgagcatcattccttttttattttctagtggtttctattttattgttactttgtgataacacactaacatgctatgtgttgtatgttagcagtaatattatgtgcttgtttttagattgttctggatttatcttttcaaggtcaaaacatttcagtctgcttaagaagctactctgtggagatttttttttcataacttctatttctttttaattcccagacatgtttaaaattctaatcagagtgtgaaagccacattcaaatatgatataacacagagaatcaaaatcaatcatctaccacaactttatccctattttatgatccatcaacaaaaagctatttttgtaatctcgttagatttgccagcaataatgacctaagattaaaaattggggagggcttttttttcattttctctttttccccttgggtagtatgattcactctgtgggtactgcacttaaacaagtattcacaccccctctgatctgttcttgtcagctttttcatgttagtacaacaggaaagcaccccatcaatcattgtttcttcatctatcagtcaaaatgttcattttgtgactattggtcctgcatcccaatctgtgacaatctatgagtgtatatttaatttaaaaagagcaatgtgggaagacacaacactttaagtgaagtttgtaaatgagaagagctaaattatcagttactgtgtcaatgttattgatgggtggactagaaaaatacctactggatgcaaagtcgagaaacttactgtaagccctaccccagtcccctaaacccattttgctgctgaatgctgacacttgaatagtttctgataggccaaggtttttcgtatcacaaggagaaagtagatttaaaaggcaaaaatccaaaggagagaatacaaaaggaaaaatatagatcctgtgggcagattttggtagagtaattaacagaaacagagtgcttaatgccaatatgctaaatactaaatgctaaccgaataactataggaggtagactgaggtgccaagattggagactggtgtggtaaaggccagctccacttgacagtaagagtcggatgttaaacaacttgccatagctgcctcctgacttcttggaggtgtttttttagaatataactgtggtcctttggtccactatacctagggacttttggacttcctcctgcctacaattgcgtgcaaaggtcaaataaactggcaaggaacaaaatgtgagaccacaaatgcaaaaatggcacaactgcactactgaaataaatacgttgaatcaatgaactctgatatttctgcattaaaatgcagcttgcaaccactaactgcaaaggaaaatatgaagggaaaataaagagatggtaactaggacctaatatctatattactaactcaacttcagaaagttggtatattttcaaaattgcagatatgtctgcaacctaaagtatacttcatagcatttaattaattaattaattttgaagtttattttagaggcagaatctcactctgttgtccaggctgaagtgcagtggtgcaaccgtagcttattgcagcctgaaactcctggcatcatgtcccccttttacctcagcctcctgagtatctggaactataggtatccactaccatggtcggctaattgtttttattttttgtagaaatagggtcttcctatgctgtccaggatggtctcaaactcccggcctcaagggattctcttgccttggcctgccaaagcactgggattataagtgtgagctaccacgtccagcccatagcattttattttgaggtttagggactaacgtgtgtatgatttagcaagtgatgtttaatggcattttaaaataatgggtaccaaatagaaacgtatgaattgttacttgaatataattaaactttgtaaattaatggattagactagaaagaaaagattccagaaatttgaggggaaaaggtaggttctagcactgtctcttacatttacatattctgtctgtttgggcatgttattttatctttttgcatcggtttccctcttaatgtatgggtgaatatataatagttggaattaaaccataaatcagtcaacttctaagctgtatactataaaaaacatttgatgtaaataataaaactccttggaatctgtccctctttgtgtctccataaccttctatatttgttagttgaaataattatttctaagtctgaggattgtccattcaaggttgaacactcaagaaaactgatttatctctgttcatctctacaaagtcagaatcgaagaagcatcatatcctttggttaaattcaaggtagggaaaagaaaatcaaaccaattctaccaaagaacaaatcaattgatttgattatgagtaggtggaggttacattctttatcttactgaatttgaggtaaaatcggttaatccttttatccccaatattcatatttaatccagaaaatgctctctggaacaaaagtaatcattacaaaataaaggctttattctacattttagcaatagtctttccttggcttataaaaaattaattgcggggtattctcttgattgggtactttagatcctggtgactgttctaactgatggggctgaaagacagttcccttatctcatagccaaatcacctccatgcaaattgatctgggagtgcctttagaataaacacagctggattctctgcagccatttatgggtccagtttcctaggcttaattttgatttataactactgaaattaaattagccatcttcactgcttaagggtggctttgatttcaccagtgcagtagggagactatttaccaacatattttatcagtaacatttcaacctgggtaagggggtggcggtggggggaaggcatcttatctttggtatttgtacttgagattccttcagaatattttaattgtattatttaccgacaaatgtgaggattagattgtcaaatcagactcacatgaattaaagatcttgcccagcatcaagctttgctaaataatttcaaggatataagctatcaagttcagataaggtgcatcatataacataaagtggtgtaccttatgtcatatgctccaggtagccctgcctcatagatcctgggttctattaactatgggtaatcccttagccagagacatcttgctagggacagagatatagtctcttattcatagtaagtaacattagtctatttccatttgacaaagagattagactaagtctttgctttcctctaggagcacaaattattgtacaaaacgagaaacaaaatttgagagattaaaatatgtgaaatatgttaatagttctaagaaggcttttatctagaacacggtaataaatgtcgacgtgctatagtaggaagagttgaagataaatggttagatatcgctttttatccatatgactttgtgcattagttttttgagcctcagttttactaatattccaaaggattagggaaataagcctaaccagagtgactctgatttttttttttttttttttgagatggagcttcgctctttcactcaggctggagtgcagtggcacaatcttggctcactgcaacctctgccctccagcttcaagcgattcttctgtctcagcctcccaagcagctgggattacaggcgcccaccaccatgcttggctaatttttgtatttttagcagagatggggtttcaccatgttgggcaggctggtcttgaactcctgacctcaggtgatccatccgcctcagcctccgaaagtgctaggattacaggcaagagccaccacacccagtcgactatggaaattttaaaagacagtacatatacgtgtgtgtgtgtgtgtgtgtgtgtgtgtgtgtgtgtgtatgtatacacatatgctatatacacacacacacacacgtatatcacagaactgaagaccataaaatgttctatacatatgaaaaaatgagaatttgaaatgtacataattcttcacacagatagctgacagtgttataaatctcctttcttataaataagaaaaacagtctcagaagtaagtaatattctgatggagagttagaaaagaaaacctgtcttacaactctttaaacatgcttctcctctaagctaaatcatagtttgctaaagaaggtcgtgataaggtagaagaaagacaagaaaagccaaggcaatggggtgaagcaggcggagaaaactgtttatgcctcttcttccaatgtctatttattttctttgtggttctgagcaactatttcttcttttatcttgcaactgtcaaagcagctctctgtagagaaaccagcaagcacacccattaaaaccaaagcatgaattttcgggtgaggatcagtgaggctctcttaagaatacctgaattttcacagagataaacatatttatttgatttaaatggtagaaagtgttaattactaagtttcatatactaccaggagtcatagagaagtcattttggagaccaagagtatattcctagaccatgtaatcacatcatttgagtagctgcttactgagtttattcacaatgaaagcctgatacataaattctttaaacagaaaccagtggcattgttaatttccacttttgtttccaaattgttgcttttgtctcattgagagcatattacttacttcaagcaccttaacaaacaaagctgggtcatacacaaacgtcctactgtaccagcaataagacaatatgaataccctgcaacctctcaacaaccagaagacaaagatgtatttggaaggggcagatgggaagtgaaaaagagaaataaaatatactttacagggaatattttgcacacgtaattctgagtgttatatttttagcttgtataaataaacttcattagtcttcattttgaatatacaggaaaagtttttttagaaaagactcattgtcacaagctgataaggtaagttaggacagtatatgattaatatgctacaatgatgtctaagagagaggatgctcattaaatttgtgtgtgacaaaagttggaaagagtgttaagaccttgaaatactggagcatctttcaaagtgaaacttgacaagttagagaaatggtcagatagagaaatggattttaatcagactgaaaggaaaattaatgtattggttttgtcagttgtaccttcatcttgaacgtaatgactgcctgttacttcctctgtggtttcatccgaacctaacgcgacactcccctgaaaggtctcctctctcccttccttgctcttctgtagcccatgcttcacttctcaactatggtgatgttttgaagatgtgaattagattacatcattcttttcttcaaatcctcaaataatatttagaatataattcaaatcctgggttgccatggtctacaaggcctcaaataaaataggttctgcccacatctttgtttcattttctttcttttctctgcctccaggttggcacttttgttcctttaactcttcaatttaccttggtgctttgtaccagctgttcccccaaagtagacagctctccatagctcttcacacggctgcacttcctgctactctcacttaaagtcactgccttgagccaatttcgttaatctggctctaaataacaacacaaccccatctacactacagttcatcctaataccagtctaattttcttcataacacctatcattatctgaaatcatcttagttgtttcactttagaatcctccttctctcatgagaaagtaaacattgtgcgggcagggtcatggtcttgtttgtcctgtacttcccacccgtacagcagtgctggcacttagtaggtgctcagtagatattcgttgacagtataagacagaagtcctcaaatgttgtccaaggacatttggtagtccctgagactttcgggagggccaagggccaaaatctttttcatcatctcacaaatatacaacggtgctgtctagaggccaaaggatatatgctatcacaaaagattgcctgcagaagtagttgtgagaatctagctctcttaagccaaacatcaaagagattgtcaataatgtaaaataagtcactcttctcacaaaattatcttagtgttggaatataattatttttcataaaagtacacaatttattttaacatgcaacatgcaatgtggtggctattttaaaatgaattaataaatatataaatgttttctcagtcaattctcaatagagtaaacactaatacatatacataacctatacaacaaacataaacttctcagaggttttcaatacatttaaaaagtaaaaagggatcttgaatccaaaaatgtgaaaaccactgaaacagaatctcatcaactagtctccattattccctagaaaacatccagtagaactttcttctccagttaaaattgccctcaaagaaggttttctctttcctgatatccatgcttttgctattcattgtttatgaaatgtctgtctgtttctctctttctcatttctccatgtttgaagtacactttaaagctgtccaaagtagtcttttccatgaaatttgactcatagctctaccacaaaaagttctctctatatatacctttagagcattaagaacctatactaccaattgacaatagtattgttaattatcttctcaaagtgcctgtaaatctctctaaaggcagaaacctctctaaagacagagactgtcagacagtcatggtgcagcctgtatgtaccatgcaggaaacacaaaatgatagcaggatctagcctccaacaaactcttttctcttaaaacctagtatgggatgataaagattaaatggaaacaaaagcattggttagctatccacccaaaaattaatattctggcaatattcacaccttataacttttgggattcaccacccaaggtagacagaatcctcaccaccaccagcaaagaagtccaaatcctaatttccagatcctgtgaatatgtccttaagacgtaattaatgttatagatctagaaacagaggaatgatccaggattatctgagtggatcaactcattgcatgagttcttcaaagcaggagctttgtttggagcaggagagaagtggcagaaggggaagtcagagacatctgaagcatgagagggacttcacttcccactgcttgaagacagaggaaggggcacctggaaagcatgaaatggaatgagggcagcctccaaccaaaatccaggccccctgctgacagccaacaaggaaactggaccttaggcccacaaccagaagggagtgaatttagtcaaaaaacccgaatggcttgaagcagacttagcctcagaacttccagaaaggaacatggccctgccaacaccttgcctttggcccaagcagaggacctaccctagacacatgatactcagacttctgacctacagaagtgtgaaataataaatgtagtctgttataagccattgttggctatttttacagcaaccataggaaagtaataaagcactcatggcatgttcaattccaatagcccttgcagcagacacacaaaaccaccaacttcctctaagctccaagtactgcactctgtccactcaccctgctgccttctttaacttacaaattatgcacacagtaggtatgtttgcataattaaaagataagtagaagaactaatagtctttaaaaaaaattgttcctttagttgttctgaatatatgtttgtcctttgataaaggactctttgcaaggtttccgtatgacactttattcttaaaatttttgagcagttaatttaaaagtgaatccaaatggatatccaaatctaaagtcatctaaactgttagtagtgtcaaatgagattgctccaccacaagctccatttggaaaagtaaccagcacctgacctacagctgagttccatgtaatttagttgtcaaagtgatggagcacaactcttccatttaatttctatgacatctgtatcaacttgactgtatcctttgctgggccaatggcaatttttctggacaagatatggtgtaaatggcagggccaaaacacaggagaaaaaaaatgtaggtgaaattttaaaaataagataaaagatcacatgtttcctaggcatccaaaatttaaaccatctatttgatgatattaaactcaaagttgctgtgaccttattgtattagtaataatagcaccaaggtaacaagtccttggaatctttctatagcatagactattaactaggctctaataaaataccctattttgttcccactgcatgtcacttttgtagggcatatcttggagttaagaaataaagattgaccatatttattgatttgctcattctctttagagaaaaatgtgaggataagttttttatttgatacctagaccaatagatttccaaagagctgggatcaagatttttttttttttttgagacgcccggctaatttttgtatttttagtagagacggggtttcaccgtgttagccaggatggtctcagtctcctgacctcgtgatctgcccgcctcggcctccgaaagtgctgggattacaggcgtgagcaactgcgcccggccagggatcaagatttttaaaatctcttaaattgtccgaagggtgcttcttccactacatcatagacagaaataaaatttagttctagttagacaccctgctctttgaaattaaaaaataactacattaaagtaggcctttccttccactgataaaatgttccaaagttatttatcacaccttgtctattacatttttgaacagataatatttctactatctaattttttaaagcataaaaatatacagagaaaagtttcaatctcatcatctctgtctcttatctgtccagttacctgcactcccacaaacccgtctaaaacaactattgtcattattattattatattgactcttccagagttgcttttggcatatacaaacagtattattattactgtattttatctcacacttttggtaacatactttacagacaattcttttcacagaaggctagcaagtcttacggccatttgacagattaaagcatcaaggctcaggaaaattaaaccttttgcctacatatatactgacacttgagagtcttgcatttttctgaatggtattctatttctatcataccttattacctctgttagcacatgattacctaccatcatttattattctctgtcagcgtcctgcatataaatccccatcacaagggactgaaaggatcttagaattcatttaatcttctactcattcagtatttgcatcacatggtaactcccattcctcttcaatgcttggatacctccagtaagttgtaagccctttaaggatgggagacattttctgctattgttttccctctgttataatttatcatctactcttttctctcttctatcaggataattataatggcataatcccttttatgtgacttcccagtcacagttagttttttactataagaataatttgtaaccagtccctcataggatctcagtgcttgtccattgttgctttttcgtatatttgataaatattcaatttagaataatcattggtaataacttctgtatctttacaaactaatgactgaaaataatcattataatgtaagactcctttaattgggtttccaaaaagattgtttcataggaaataagacctacaggtattcgaaggaaaaaataaaagcattacatggtcaggtaagtaggattattagatattcttagaaattcaccgtgtccattattatgtacaaagctcagagaagtggatataactttgtttaaaccagagttttctaaacatattttcacattgaactccttttccagataacatagatgagcatcctacaggccattttcatgaaccatactatggggaaaaacgttgcaaaagaccatttgtttttaaaaatgttgtaatgaaaaaaaaaaacaaaacaaaacctcatttgtattcagcatatgtaaaacacagaagagaaagcatatctgaaagaatgacaaatagctcagttctcttttccaagcttcacaaagctacatagttcatcttctcaatataactcaaagaagaacagagaaaattttctgtatgcacataaatgtattcatagcatttttttgaatttataatgccttggccgccacatctcagactgaagaattaaaaacaacagtatttcatacttttcttgatttttttaaacttctcttagccaaagaaatcatacattgctgtacttacattgtatgattatttgttattttagataactcctcagataaattcactaaattaaaacactgtatcgaatatgttttgcttttttgtctggacagtctttttattgcaacatataatgtaaaaagtaatatttattcattgtcactgttataattatttctctgattttaaaaacagtaacagacaagttttttttcccccaggattctccattatatctaactgaattcccctatcaggatgccctttttgttttgttctgcttccccctttataataggatataaacaagagacagaagttaaatctccagtgagagaaaagtaacacctaacgaacagacaaacaaacacaaaaactggtgacagtctcaacattctcaaatgttttgctcaagcactctattactgttagtattgctcatttcatttaattgtaaataaggtagattttgctgctaagcaaaatgatagaagctagatcttcctaaggacaaacagttataagaacatctgtacctgagggcaaaccaccagaaaaagcaagaaaaactcctaatagtgagacagaatgagggaaaggggagaaagactaaaatgtacctgccaagaaaatggcatatgtttaacagatccaggtaactcttttttgatgattgcagtaacagataaatgcagactgacctctgcaccaggtatttctagatatccagatggcactcaagggaagggagcaaccttagcttaaaagttttatttcagaaggtggtggagggttaagaagaaggaaaggtaaagatgtgtcaacatcatcttctacaaggcttgttcatatgttatagtccatttgagaaaggttcatttaaagtatgttttggtgatcaatggttgcccaaataggccctgcctcagtagagaaacccatggagtgccataaagggcatcaaggatagacccaacataaaagactacttacagtaatttaatagcaacttaattcagatcagagctgtgcaataatgaggaacggttaactatgaattgatgtttattgtatgttagaatttgagctaagaatttaacatggattatagattacccacttaattaatcctatagacaatcctgtgagattcattatactaactcattttccaggttagaaaattgaaacagactgaataagaaacttgcctaaagtcatatcgtttctacgtggtaaaggcaagattcatatccagagctgggcattttaagtttactgtagaataaaataaaataaaagcacaattcaaaatatattaaaatatatctaggggagccagctctgagtttaacttacatcacttctggtggattgaatggatttcagtggtcactcagctatattatatataagtaggaaattttctaggtatggaaatatataaactggatcagattctagaagacagctggtggccaatattatctttattattctctactgatagaatagtatgcatcctcttatatcaacagagaagaaagattataaaagattgatactaatccaaatatagtttttttaaattgtttccaagcttgtcctcttgctggttcacaattgggtcaagcacaatttttaaaaatatatattattcatctttaggcaaagtttccttacaattcttaaatcaaagggagtaggaagtttgcattacctaagaaaatagaaataaaagaaaaaatgaacatggaacagattactatttcaatatgctgcaggatatttgcaaaaatatttaaaagagagttacttttctaaagcattaatttagaagctaaaaatctgaaaattgaattgataaataatggtttcattttaagaaagatcttaaaatgttatatgagaaaattaggtcatatcactttttttttttaacattgttagtcttcaggatttttggcataatttatatgtgtaaatttatgtttttgtcttatattaatattttagggctctgtgtttcatttctttcattttactgctttccttgatctcattacttatgattaattagaatttttcaaaacctaacctggcacaaataaataccaatgaaagaaataagaaaatattggcccttctatcacaattaatgtagcatattaataatatataatattacaatttacaatagtttctaaatataaatttcctcatatttttctcacgaaaacctgtgagttaaataaggcaggaattattattgtcattttactgataaataaactgatctttcaagaagtaaaattacttgcctaaagttatgcagcttaataacttacgaataaaacatttgtttacaatatatacacagaaacacaaacacacacacacacacacacacacacacccatccccaggaactgccgatttctagcataaatctactgtaactcagaactgaattaataattatctagtttgctgataagttgacattttgacaaatgtgtctcagtataagaggaaaccatacaaagatgaatgtatttacaagtttatttgaatcataatacgaatgggcttaacttccaattctttattcaattggtccatattttatcaattttatttaaacaaataaatgggtacgattctattgctttcaatagataaaactgaatcagactgatggtatcaataattatgttaaacctatcaaagtatttgagggctttgtggtagaagttaaatgtgataatccacggaagcacttagcaagtgcctggtatacagtaagtgctccacaattatgtgagtaacatgctgctttataactaatcacaaagaagtgatctggcactatgaataagatatatcttgactttcataattttagattactggataatctcctgaccaatgcagttggattatttccaacctcccacatacaatgtttttcttgaataattcagtgggaaataaaggagataaatgaagtctcagaaaatcagttgcagcttcaacctcattttgacatttccttctaagtacttccatccacacaagtgaaatgctgttgctgcccccagagacaccgctgatgagcccatgcttgtcacctaattcaggaattgcccttatgttgattggcctatggcccatagtgcgaccacacataaaagatctgcacagacaggaatagtggtaataaacaaaaacaatcagaggctctcctacaaattctaattagagataaaggagtcagtaagtagtacaaagaaaagcacaaaaatcacatatggagaaaagaggcaaactgagtaaagttactcagcagtagactagtagaacagtgattcacaaactctgccatggatccccgtcaagcttccaagtgctaaacttcattctggtgtctactagacattgctatcatgaggttcttgttctctcttgagctcttaatcatgtagctattttacaaaaactatggttactgccttctttacatctttgtcaatccttcaaaagcatttccattatttaagtaatgtaagtgaactctcaacaaaacagtctactaactccagggtactttttgatacatatacctgctgggttatatagtcattgcctgttctgagtttgagaagacggttaagacaataatcacatcacgcatgagatacattctagtatattttatacaacaggttagcaaatacttctgttaatggcagggagactgttactttagtaaataacctgagcttattgataagggaaacttgatagcaattggagaattagaattagaattagaatctctaattctccaactggtaaatgactcctctaaatagtttattcaagatgaacattggctttacaagaaatcttcacagccaataaagtagacactagctgtggtttataaaagctgaaaacactattaaatatttcagttctctctgatagtgttatatttgactctacttagccaaacatgtcaatttcataagaaatctataaaatgttattgttaaatgggaatcttatcaatgaccggtgcatttttaatttcaatatgatagcagaaggcaaccaatataagtcatatgaaaagacatatttggattttttttttttttttgctacaaggcaagggtcatctgaaacatttcccatttcatattttgacaatttatccttcattgtttaacataaagccttctagttttccttgtttcataaaatttgaacaatcatgaggtggtagtagcccatttatctcatggtaaatttcaaatgaacttacacatggtttagatgggtttaaagtggcagctgtaatttttgttgggtatatgcagctgtctgtaatgattctggtcatacattttcattcaccttattgtctgaatattttctaaaggaaaataggtgtgtatgtatttgcttggcccaactttgatatgtcttgctggctttcatcacctttggaagaaattgcatttcccagtaagctgttccacagtggaatgataagtgatgaccatcctgtggattttcacagctgtacaaaagacattcaggtgcacttgtcttttgaatcagaacccagttagcccctcgcacatttacaaaattgcttttgggagagtcaaacctggatgacttccaagctagttaaaaataattctgaagaaaagtgcagtgctggttcttggcggtagaaatgtgagttatgttcagctgcagtagattcctttcaggcagttctgatacccatttcaacttccaaatttctggcagacgttatcttgtactttcagcttttttgtgataaacatattgaaaattcagtcaaacagctttttatcatttcaaaacttgagctcaaatttaatcctgctgccctgatgaagcctgggaagctgctagggcattttcattatatccagactggactgcagaactccttgccattcttcaggactctgacagcatcattcatttagaacaatgtgatcgatccagaagaagccagcagcaacaaactctgggtactcatacggaagagcatatcctatctagttgaaaaatgtttccgtcttcattcttagcctagagataaaatatcccatcatttggactttagatcctagaagatcttacagattttcctacagtatattaacagtgtttacatttaaatctcaatcgttagctacagatggataatctccaaccaacaatgttagagttgtctatcattaatacatttcctatttgtaaaaatgtggattgctaactgaacattttgtttcttataaagatttcaggtattatatagaagtaacctactaatctttgatatatgtaggaatagaatactcattagtgttttaggactaacctaagaaaattacgagttcctaagctggccaacactcaagattagaactgatataaatgaatctgaaagttaaagaacaatggagttgaaaaaagatttagaaattatctcatgtaacgattcctgatctaggttcttcaggcactcaaaaataaatggataagcaagtactagtggttcatgaactattttcaatacttataaaattatcatagaaactgtaactaaagagaatgcacaggttaactgaattgtcaattttagcagcatttgattggaattatatcacctctgtggcaaagcttggcatttcttcttattggccaattaactttctatgtaataagatttgttgttgctgctgggaacagggcttgagttttcactgctagagcctcgttagtaagataaaggacttaaagtacctggtaaaaggcaagctgcacagtttaagagaagtttcttgaccttgaattgttgtcctcaacaacaggcagggtacctaagttacacagagggaagacttattttcccataaaacagggtacccttacctaagacaacccaataaagtgtgatgggaaataggacctcacacaggaggagaaagcaaatctaaggtgtaaagtatcggtgggatctagtctgcttctctccattcctcattctagctgtgcatccttttcccactttttcttttcttgaaactactcatgtaaggagccagagcagggatccagggtgacagtgaagaaaccctaggctacagaagcctgaatcaagaccactgtgtgagcttccagccatagctcaatccaggcactcagatcaggaacaagcctgttggtgctttggccattggcattcactgaggagaacagggttctatgcagacatttgattgcctgctgatttctaacagggactgtcctctgttcatggctttccaagagccagcctttatgggagcctctcagaggtgacaaggtcagtatgggcccctcctcacagcactgatgcctcacagatggcatcagctcgtaccacaggcaaccacatgagcttacttgttgaggaatgagcttggtattggtggatggcacgtgatatttgcacacatttattcaacaaatacttattgaacacctgttatatgcttgctaggtactgagatgaaacccggaaccatacattgactctatctttatggggtttacattctagcaggaaaaatatattaagtgtacagttaccaaaaattaccaacaattatgataagtacagtgaaatagaaatacacagtgttatgagacattatagcaggaggatctaatctactctggagcatcagaaacggcttctcagaggaagtagcttgtgaagtttgacaagggtggccatataacctatcatccaaactgaatcacttcagagaaggtaccactttagaaagagggtgccattaacaagtacccacaggataacaggcaccaagaaggatttggttacctgagatatgacctgaaggaataaaatcaggaagaccaagaggaatctgaaaatacccgaaatctgcttctcatggctgggactgttgttttgaactgatcctggcagacttttggcccactgagtgaggactgttgttctatgcttaaggaatgaactattcattggttcaagtctaaaatgttagaactttggctcatattaaattacttgaccattcttagaaggaggccaacacttgacatatcagaacattcctctaagatcacaaggctatcaagaattcaattagaatgaaggtcctttattggcccagttccccagaaatgcattccagaagatatattttgagttgatacatgtaagactctactattactgctcaatgagtgagaaaagagatctagaggtatctgaattgttgactagaaagcatccaccagaacatgtgcaatgaataaacaagattttcctatataaagaaaggttgagagcagataaaattgttcgcttgcaactttacattgtgggtgaacagggagctttcaaaggagctgcagacttgtattaccactgaaggtaattcaactgtcgaccacacgccaggaaagaacctcttaaacagataataagtattcctgataactgccaaagggccttgatatttcagcaagctgcaaaagaaaataaatttaaaaactcacatcttactcaggtaatgcattaactccagatcactacagagaacatttcaattcccacttctataaatatacacctgttcttcatttgtgaggcacccctaacaacacacatacccacctctatgcacagagaggatcttataaacattattcttgctttccttgtacttgggtttgatttctctatttttcagcaagctattagatgtcattaatactccctataatttcaatagtttgttcttttggactaggttcaggcattgaagttaatgtcaaattgacattttttagcctaaacatacttttcccatctttgaataagttaagaataagcattaaaaagtgtcaaaaataaatgaactcgacatttagcttacatatagtaaaaaggtatatcaattatttgctggtaagtgagcacacagggcagagctgataaacatctaactttaagtttgcttctctgctttttttggcaaggaaagagaaaatctttatttgactacagttactttggttttcaacttttaaactagttttttgatatgccaaattcaacacatctttagaccttattaactacctttctgtttgcaactgtatctaacatgttaaattacaaccaggtgcagtaaaaccttaaaaaaatttacctctgtggcccccataatagaaaagaatatttactgactcttctgaacattggaataatgacaacaagcaaacagaattaatataaaatagaaacttctgtgtacttactggtcaagtcagcttaaaattaagctcttgcactcttaacccttaacccttaacaaccctgcgtagcaaacactagtctctactgcaaggctctatctaaaccagtggctgtcagttttggtaagtttaagcattggatggaatgtttattgaaaaaccacattcccaggacccacacccttaaggtctgaaacagccctcaggaatctgcactttcatctgtttaggtgactttgaaatgatagttcaggtactggactttttttttttttttttttttttgagacagagttttgctcttgttgtccaggctggagtgcaatggcacaatcttggctcactgcaacctccgcctcccaggttcaagtgattctcctgtctcagcctcctgagtagctgggattacaggcacatgttaccacacctgactaatttatgtatttttagtagagacaggttttcatcatattggtcagggtggtcttgaactcctgacctcagatgatccagtcacctcggcctcccaaagtgctgggattacaggcataagccaccgcacctgggctcaggtaatggactttgagtatcactgactgctatggttttaatatgtctccaaaactcatgcattagaaacttaaccccgaatgcaacagtgttgggaggtggggcatactgggaggtatttaggttatgaaggtggaactctcataaaggaattagtgcctctttataacgggcctctggaagtggtttctctcttttttgctcttctgccatgttgagtacataacattcatgcccttccactgccactgagtgaggcaagaagcccatcaccagacaccagacgccggcaccttgatcttggacgtgccagtccccagagctgtgagaaataattttctgttcatataaattacccagtttataatattttgtcacagcagcacaaaacagaccaggatcctgacctacattatttcaagtaggaaagataattgtattcttcttaatacttacatctagacacatgctaagtgctatatattatgttaaatcatttaatcttcacaaagatgccatttatgaaatattattgattacattttacagattcagagagtttaataaactgttcaacacattataaacatcaggttccaagtaagaggtgtcagttagattctaaagtcttccctttcctttccaatgctgtatctccgtatatcaaagcaacataattaattgctattttttaaaaaaaattgttcaagcacaaacttacattacaaaacctttcagattcttcagatttaataaataaaatcattcctttcaccaagctctcctgtatcagtgtaatagcagctcagactcttgcccagtggtcaacttctcagctaatcaaagatcttggtttaatgtaggccaaaccaggtcccctgtgtccttatatatccttttgcacttttcaggctttttagatacgttatctcattttattcttctaacggcactaatagatcacacaaaatagatgccatctttgtctgttaataccaaaaatcacaacagggttctcactttgctcctaattcagaagcatcatcatctcagccctttaactctcatatgcagaatttatttgagctgctcccctgccctgtgagcttggcagctttgtgtccctgtgtaacctcatgactgcagccttcatcccagggtgccaacctactcagccaaagatgacattaacagaggatctggctgaaatgccttgacattatttttctctgggaaaggtgtgtaattgcagaaaaactgctccccaattattcaaatttaaacattttatctgatggaaatgatatcatttacatattttgtttcccagtttaaaattgtggtttcatatcttttgtgcttgtatatctgagagttatattaaatttaaaatagctgagtgtattggctcactcctgtaatctcagcagtttgaaaggccaaggcaggaagatcacttgaggccaggattttgagaccagcctggtcaaaatgacaaaaccccatctctactaaaaatacaaaaaattattcaggcgtggtggcgcatgcctgtaatctcagctgcttgtgaggctgaagcactggaatgacttgaacctgggaagcagaggttgcagtgagccgagatagtacccctacactccagcctgagtgacagagtgagactctgtctcaaaaaaaaaaaagaaaaaaaaattacaatggctagccctggatccatttggtaacaatctcattctaatgtatatctttacacagggcaaattttaccagaagccttttaacgataacattttacgaattcaaaagagcctagatctggcaagtgcttggctggcagaagtgaaatgtatggtgtgttcaagaagcatcaattatggctgactgactggaccctgagttaaaagtcagcatggagagagaaaaaaataaatcatcctacgcctttcaaatacacattgtaatgtcccttctacttccacttgacaaatctataaggaaatataggttggggagcatgtgtatgtgtccaaatgtacttcgcaaacaaaaaaaaacagataaattattacatcattaattaacagtggtatttaccaaaacacataacatcttatgtcaatttaaagacctgttggtctattgaggagtagtttgtaactagctaagttcattgataagctaaaatcaaatgtcataggatcctggtcttctttgaaagattgcaatagaaatacaatgtgatgggatttttatatgtttattataacccagatgtacagtaaatcagagcattgctgaatttaaattataccatcacatcctcaacaacgatataaatattgaaggaacagagagataagcaagctatatgaccaatatctaacaataaataggtattaggcttttactttaaaaattaagggcaaattatttaaaatattagaaaaggtagcaagatacttgataaagaatagtgtgaactgacgtctgtcttccacatccctgcccattaccattcccagtagctaaatcaactttagtcaaggttaactaactcctttatatggccacacaggagtcccttggctatacaatttgcactttaatcctctggaagttgcaagaggccaaatgaaatcctcacattcagccagagggaggagagaagaaagccataattcagacctccctgtaatatattaagagaaatctgtcttttttttcagtgtcattgccttggaaggtaaccccttcttgaccctagcatttaaaagctaggttggtgcatgtccaacatcagggtcacagccatttttctgctactcagttcatcttggaactgaaagatagtttcttcccgccatcaatcattacccaaggtaagtgtcacagtatatgggtgcataaggtaaaaacagatgaatattaattggttcattttatagcaccaagtacaatgaacaaaaggcctggagctcagagttggaaactgaaagtttccaggaagaatcaaaatataccaaattctcaatagctatttccttatcttctgacgtgtgctaaattgtactaccaaatgtcaaatatgctgagtagccttggaaacaggctgcaattgtgaactgttagtctaccagagagtcaggatccctagctccatcaccagtatgagcaggataatgggcagatcattctgtttgctttcatctgttaaacataggtagtaacacctagtatatttacagcacagatacattagaataattcagtataaaaagtgtaaaatcagctggaaaaagttaaaagtgctatttaattataatgttatgatgacaaagaatgtgacccataacatccccaaagaaatttaggttaaatttaatatgtggactgtttactggtaaacatggtagaatcatgaataagccattattctatggaaaacaatgcaaaaatttatattaacttcttttactcaaagggtactctttctgtcatccactcaaatagtactgtctagccagaaatgagtttatttttaacactatacaggaaatagcacctcacatatatgtcagtttcagtcatgtggtcatgattaatagtcatcatctgataggcagggtggaatggtgatgtgaacatgggatttcgggttatccctggatccacatctgtattctggtgctttctagttgtgtgacattggggaaccttccactacttgaccttcagtttctattgcctgtgattgtaataaaaatgcttctcacagggttgctgtaaagattaaataagaaactggatgtaaaagtgatttgtaaactgtaaattgtttataaatattgttattatttctatatggatatagagggctcataaatatgccgtctatttctggaaatttaaataacttgtgtaagtttttgtctccaacctaatttcccagatatctttaaatacttctcacaatgaatttccattctactcactgaaagtgaagtcatcgtcccccatcttgtgcattcttgcctttttgcttagtttgcatgcaacactctctcttcctatatctacatgaaaaattcttgatgatcttctctatccatcctttaagtcccaactcaaatgccacttcctctctgaagccctcgctgattattagtttccatatattaatctccatatattgatctcttttctaatccttttgttgcttgaactctcaacgcacttctttttgctgccactcatttaccatttaccatatacacattctttttcacagttatcttttcaaacaaagtttatacatcttatctctaccattagaatacaaggtccttgagattaaagaacatgagttagacctttctagtcccaacaaatctagggaggtgtcttataagcagtagtaaatgtgtgtgatgactgatataaatgaagtaaatgaaaatgtaatgactaatataaaaattggcacaaacatctattccatgcaacaggaagatgttttcaaaaataatattacattccaaaatgattttccagtggcaatttgcatagtgtgccatttcagtgcacatgtttaacagaattagcagaagagagactgatataagacaacccattttaggatttagaaggctaccacagattaaaaactaaaccaatttctgttcacaggggagaaacatttaggaagccgcaatctacagtaactttgggaggaatctgtccattattgactaaattaaaacatgagtcattgaagaaaaagaataaactcaagcaactggctaagtaataatgaaaaataaaataataaaacttggctgaaaaaagataattacagtccacatttcaaataagaaattataaaataaaaacaaataaaacaaattaccttacataagcaagtgatccccatctgccagctcatttgctatgataatgagaacttgttgcattctagttacctaaattatcatatctacttccatctacatataaatatacatctcaatgtaatggaaaagaaatggtttattcaattactggatttccggagctaacaattgttacaatttagttaagtgtcagacaccatgctaggcatctttacaaacaatttatttttaatcctttcaatagtaatcttttgaactccttaactgcttatctcctttatcattaatttaacaataattcctataatattttatgatgtctcttctattagttgctagaactactattctgctctctttctgccatttgttcattcatttattcattatggctaaatacttatttattggctattacatgcaaagtaccatttttagctctaaacaaagagtagtggaaaaagtccattacccaatggagccttcatgttgttactcaattctgtgcactgtgtagtcaaactagattgttagtttcttggaagctatttatttaatttgatttctttgtatcctctggtgtctagtacagtaagtacttaattcaaattggcatgcaatacatatatgttacttcattttaacatgttttaaatattattggattaaatgacatttattcctctactttaaacattataataacactacatcaaattctaattatcaagggaggactcagaggaaagtctaataagccattattcatcacactacatgtacttcctggtaccccaaaagcttgtccccattgaaacacaattattaatgcagattgccaggttgggtttctgttctagttggaacaacatctgtgtttgtaatggccataatgtagctaactgtgaatttttaccatgattttcagtaacagaataaacattctcttgacatttctacacgacaagactatgaaggctatttttaaagtattttgataagatttggcatttgaaaatacgaactcaatttaatatgaaatggacgaatttcacttacaattatagttttaatctgagctgctataacaaaagtagctcaaactgggtgacttaaaccacaaacatttacttctcacagtacaggatgctgaagggtccaaggtcaaggtgccagcagatttcacatctggtgaaggcccacttccaggttcacaggtggcactctttttactgtgccattgcatggcagcagtgacaagggagacctctggggtctcttttgtaagagacccttttgtaaagggactcttttgtaagggaatcacattcatgagggtttcactctcatgatcgaatcacctactaaaggtctcacctgaatatacattgagggttaggatttccacaaatgaattgggaaggcggaataaacatttagtgcactacaacagtttatatgcccactgttctcttcacttttctcagccagacagaagctagggtaatatttttaattcctggtgtccataacgtcagcaattacccgatgttgttttcttcatcacgctttgaaaggcagcacagcataggttaaatgcatggtttttgagccatggtttcagataaaaaataggttcctctctttgggacttttatgagacttattttatacaaacacatataaacatgggtatgttgttatataaatcttgggcataagtgcatgagtatgggagcacaaaaaaaatttggcttagccacattaccgttaaagaaagttggatgtggatcgacacaaataacatgaaggctgggagctgggaagggaaggcatgtttgcagagtaaagaaagatgaagccattctgttctcaaaaatcaaacatgtaaactgtttacagttatatttaatcccccaaaacaacatagttattaatctgtatctgtttatatcacacataaagaaaccagaaacagaaagttttactaatgtactcaagttcatatgatgatttaattcaggatttgacaatgagtacaaagctagatggccaaccaaggacgctcactaattgcagtatgaggaaaataagagcccttctgcagagtttccagctcaaaagcttttaagagacaagccctttgtatgtgtataaagatgtgtgtttgcattcatgtgcctgcgtgtgtgtgaaataaaaatttcatacttgagagaactatggaaaatagcacagtaactcaacagagccattgacatttgatattcttccttccctcccttcctctctccctctcatcctccatctcttctcccttctttctttctttatcactaagctgattagataaaacagaccatttcaaacctctgctttaggatgcgttgcaaatatgttagtttgcatatataaaactaatatataaaagtaaatataaaaatatatttataaatatattcataaatacataatataaaagtaaatattaaaatcctacaacttccaccattgtgaatgcactaaaacacattcaaagaattaaaaatttggaggcttggaggtgtaagattagagacttgtaatctttatccttcaactatcacacatgtttgactatcatatttgagttgtcttcatccctcaactattattattttctgttcattaaacctcttaccataattccagtttaataatccatgcaatggtttgaatgtgggggaaaataatattgtttggtcagtatcatcagtatattcaagcaaaaaattaaaaaaaaaaacaagtatttctatttcaaaataaatatcttatttaaaataagtttcgttttccggctgggtgcggtggctcatggaacctgtaatcccagcactttgggaggccgaggcaagtggatcatgaggtcaggagttcgagaccagcctggccaacatagtgaaatcctgcctctactaaaaatacaaaaaattagccatgcatggtggcatacgcctgtaatcccagctacttgggaggctgaggcaggagaatcgcttgaaccggggaggcggaggttgcagtgagccaagatcacaccattgcactccagcccaggcgacagtgcaagactctgtctaaaaaaaacaaaaacaacaacaacaacaataacaacaatcatttttcattggatttattcttgattgggattattagcataaaagtatctgagaaattgcacataactcaatttctaggtctttatctctctcatcctgaaaggcttccttaggccaactttgcctacttaaatgctttccttatttcaagaccctgttcattcagtggctttcctgaagtctctctgtcatcccaaatacactgcttggagcaacagaaaaggtaaagctgagagagccatcaactatgcccacagtagccctcagacgtgtacaaatacacacagatacatgtttaaagaacaaattacaaaactggtcaatcattaaactcagggtaacacattttcagcctgcacaagatacctagatgtttggctcatgcctttgctgtagatctgtccagcaagtggtctgatttttggatcagaacatgcaatttctgtataactgacacacagatatatatattgtctttcaactttttttttttaaccacatcttgaaccttggaggagttacaatgggaaacttcattttcgaaactcccacaagtaaaatagtgcaaaattcatataaaaccagttacaacatgtctctttcagggtacctccctccctccaatgtaagctacaaatcagccacattaacaaaggtcgcgctgcatcttccagttaatttgaactctttccctatttgcttccatctgtgagcaaacaaaacatctccagtccttaaggggcgcctccccagcattagctgctacttttatgccatactgttggtatggtagctaggaaaaaaatgcagtgcctgaaacaggtatttgcattcctatctacatcaaagggctgaatttttctttcatgggacttagtgttttccagaacacaaaagatccatgcttagccacaatattacattttgcatttataaaccactcttcccagtttctctgagatctcctgcatgtccaaagacactcaagcacttcaccaaagagattctctgttcctgttatcaagtattttaatacaagataacaattacagtttagagaaatgctagaaaaatgcacggaaagctcccaggtgccacttaactctccttccttgctgcattccctctcccaccccatcactgaaacctgagccagccaattagatgaacagcttgtcactcctagatgcagtgcaatgtctgcatcttactgcagctgttaggactgacaattcaattccagtctgcaatcctacaacaaagactctctcgtctggttcctgggagtcagagattctccttgttcatctttgaacctcaaaaatatggatttatcctggagcactcagaaggcttaaatctgtataaatagatagaaacatggaaattgtgaccctagtttagccactagatgactcagctggagtggactcttcggcttccaaggacagctcacatagctgctctctcagaatataccttaaattcccaatcacagagcagggtgccctaagaaccattcaatttccctaggcctgtgaacagcagatttttgccttggcaggttggataatctacaacactctttcatatgtctgtcctgttataaaatcagctctagtttgtactgggctctagaaagcattagagctaagaacaggatcctgaagcatgtatttcagagataactaccctttactaacaacaaatatgtagcatacagattcctctgaggtgcagtaaccacttttgtatttatagttattaaaagaagggaaaacaagaaatcaagggccacctcatttctcatataatgtgttctcctttgtgcctgacagacagacgaggactacatgaagcatgaatcctcaggatacccagtcactaattttttaaagtggaatgagtcctaagtgtcaaggggttttaagtaaagtgaaaattaaagcagttaaaaggaagttatacttaccacttgctatttactggaccttgtggtatgttttttttcatacattattttattttacttcataaaacccaattaattttttcctcataaacatttgggatagatatttttactcatattttacaggtagagaaagttgatatacattaatatgggtgttagtatctgagagaggttaaacaacttcccgaaactagtgagtagcagagctgaaattaaaaacctcaactactacacaccagaattatttaacagagttgaattgtgatttttgcatttctcgggaaatgtcccttggtgaaaactctgagaagagaaaaatgtctgaatttcttctgcaggaggtctctaggctcccactgctctttaaaaatggtgatcataatataagggatatacgtccaatgaatctagtattccatagactctatcaatcttttgcccaatctttgctattcttcaaaattttctgaagctataatttgggcatctccctatcatttactgcattatttctaggctagatgttagtggcaaaataattaaaaaatatggaaccccaaaattgagggtcttcacagcaaaaggaggtgataaacatacaattccccataatacaattaattctgatatatcagcactatgagcagagtactaagagatcataaaggaagaagtaatagcaaattgaaaacaatctaaatcagcaataaaatattggtcaggttaattatgatatatccacacaatggaataccacatagccattaaaatcatattgcagcagaatatttaatgatttggggatacgtttcatatacattgtttagtagacaagcaggctgtaaaataaaagcaatataatttcatttaaaaatatattggaagagtgagaacactttagcaaatgttaataatggttatattaatataaaaaggttaccattattgcttctgctttttgcttttttatgttttgtatagtgaatatgcttttcttttgtaattagaaaaacattcaatacagtttaaaactcaaatcatgttaacaaagacttaacaacaacaaaaatcaatttgaaattctttcgaattggggaaagtaaaattcctaacacacttaagatttatttccacagatggcctcatgagctacaaatacctcactcataaatcgtcttgccttgaatttccactcagtgttctgatatcatgccagatgtgggatcttgccttggtccaactcctcctttgtaattttaaaggcctctcacacttgggatgctgagctagagtcattctcctgcttggtagcttttgagagtgaacagatcacttcgctgtgtattgtcattcagttagtagatgtttctggctgcttcttcaacccatacaatatacctttcctaccaagaaatgtgtgacttctattctctcagccttggtgtaaatccctgaaagtgttaaggagaaaaaaagagcaagaatcctccaagatctataattgcacaggccccaggaaagaagcataaagaaaacagtaactaaaaacaaatgcagaataagacctgaaatacaatatttgaccacagtctaaaagtaaaagcttagaaactggtcaaggatgtcatgtgtcttgtcggttttgaagaactattattcaaagctttccatttaattatggccaaaatgcccaggtctgtttttcttcaaaatccagtgttctgatgactagctacattacccatgcatcttgagatatgctactgggaaaagaggaagaacagtttaaattattgttatgtggaaagtcgggattattaacaaccaacgaatctaggaggaaagccaaaatctgtgaagaaggctttcaatgcctctgggccagctcatctgaattcaagaactggagaaagattttcacttataaagttacccagagggcctggggaagaggtgagtgtcttccagcagctgagcatagatcagtacctgagatcatttacaacctgcatggctgtggtcagaccctaatgcagcctgggctgcagacacaacgtggtcagggtaccaacaggagactcagtgaaaaaggagactgtttctggagaggcctctgaatgatcagctgcataccaaccactgtgttttcgggtttgtttgtgtgcgtgtgtgtgtttcctagtgtgcactgaaaaacatcctaatttatacatgctcatatatcaccagcttgttaattcaacactaaagcaaaaagatgacaggaatacaagttcttgcttcattttttctgttttctctctaatttgtttggtagatgaatggagcatgcacaacatttcagatgtttactcaaatacaagatccattgtgatgatctttattacttttgtaatactaaaacccacagttgtgcttaatcataagatcctctagggtgacactctctaaattaaactaccaagaatttatattttaagtcaagctgtctcctgggtcttaatagtatctgatccagaaaagaaaaaatgagtgttaatagcagggcatacagtactatataaggtgctttaatcatcctaatgaaggaaatgaagatgatgaaatattcctgggaaactttttcatatgcaatgaagcctgtgatgagaaggaacctttagaaatagttttattatttgggtaaatatttctagacttatattcccttattgatatactcaatatcagaaacttagatttattattagagatttttaatccatgattcaaaattgtaataattattttagttgtagctctttatataatgaaattaaactacctgatgcatattaatgaataaataaatgcacttagtcaatctgactagaaaaagatattaatcacgttgtatggctttatatggtaaaacattagctggctagctaaatattacatttttaacttggctgggagattatatataatatacaaaaaagaaaccaaaactatctagacagctaaagaagcaaacaatacacatgaacactattttaaaattgaggtaattaagaaaaaaagaatacatatgtgtgtgtgtgatgaggtattactcatccattcattcatttattaaaaaatatttattgggcaacctgcttgggtcccctttcatgccgtggaagctttcttcttttgctcttcacaataaatcttgctgctgctcactaaacaaaaaacaaacaaataaacaaaaaaactgttgaacacctgatacagggtaggcacgattctaggtggtaggattagaatagtgagcaaaaaagtcaaagtaactgcctttgtggagcttgcttcctgattatcaggttacgtaataattatccacacttggatttgcacattcagatttagattactgtaaatacaaagccaccatgtgtgtgaattagagtaatagaaagaaaatcagaaaatctggttttcaatattatctcgatgtgaccttggccttgtcatttaatctctgaaaaaccttttttttttaacctattaaatgtgttggttggtattatcaaaaataaagttctgtaattttgtgtttcctgatagaagaaaaatatgtttgggctcatgtttatagtgtttatatgtggaaagttttcaacaacttaaaaaaaaaaacccacaaaactctaattgcaatcaacagcaaactgagacaggtattgcagtacttaagtaaagtgatgggtagctcttggcaaagttcatgagaaaaatcaccacactgattacaggtattgtaaagggttgtcagaaacagcaagtaaattgcagagaaagagatccacaaatcctttccttaaaatcactactattatcacggtgttaactgggtaatttttccagcacaaggggcaaatgcatttttaaaaaacataatcagttaaatggtacacatagaaaatgcccttcttacaacagccaatctgaggttattctattaaataaaataagcaaaaacacaaaaataaaagcccacattacatataactacaaaagttatctgtttagaagatagactttattttttcagctttgtaaaacagacttaagaacagaatacagaaatctcagaaatcaagtctcatacagacctaagcaaacctcattaatattcaagataatatttgtaaaaataaactttgaattaatcatgtttgcattatctggtattttcattaaagaacaagagagcatggagttgactataaaatgaaatttgtttctagttgcttatgatttaaacaaaccagcgtcagattaaagagcttttactctcagtaccatagaagctttgtcttggggtgtcctgggcacagtttatgatctagagtcagtgtggatcatatttcccataaattacaatccatttgaggaaactgcttctttaacactgtgtcactgcttgtatacctagcgaggacctgttaatgtgattattctttgtactcttttactcgatcccttaacaacttttatttgtgctgtgattcatgttttcaaagtgctttgatttccattacgtggtttaatcctcaaacacttccttgaagtagataaggcagccatcaagttctctgagcctcagtttccttatttattatatggaaataatagtaataaccttagctgcgcgtggtggcgcccgcctgcaatcccagctacttggaggctgaggcacacataccttatcataaggtttttgtgaagattaaatgagataataatgataaggaggatgatagttacatttcttggtcatttgctatgtgctaaaaactattttaattgtgctacactgttaacttatttaattcttcattgtgaccctaaaaaacaggtgctattatttcctcattttatatttgagaaaactgagtcacagaaaggcaaaacaatttgcccaacgttacaaaaaagtgaccgatctagttaaataatgacagaagccacctagaattatattaacacttgaaataatattacttccctccattagtaaacacaatttcacatcaactaatgatttctacaagactccaatatagtcattttaaatccctaatggaaataagggtaacaaaaattattcagcatacattctatctattctaaataagttgctttgatcctgtacttaaagaaaaataaacaagtaactgaatcttaattcatcaatatcctatatatagtcataaatatcatttgttcaatttaaaagaaattagaatatggccagaaagagtcaggcaagaggactaaataaataagaagtattctaagtattttaaaatgccttttggagctcatggatttggaaggggttagaaaaagagagctgacatttgggaacctttataaaaaaaggtcttaaaaaaaatctatgaagcaagaattatcaagtatcttttaaaagatattgtttgtcaaaaacccttatacttaaagagatataattccttattggattatatttaattttttttccaaaagcaaaactgctacttatgaagtcatctgttaaacaatttatattttattctaagcaaaattccagttacaacatacatgctttgtgaagacacagtcaatgtgttaacactaaagtatcaatgcctaggctataattagtattcaataaatgcttcaattatgaaatatggaaacaagctcctgctagtctatcaacagttataaaatgcatcattacacacacacacacctacacatccttccgtatggctaaaaacaaattttaagttgtttttcttctgccaaaaactatcaaaaaatagatcatgatgatccccaaaagatcaatcactctttatattttaaaaatacatcttaaaaaaacctaacacctagatagtgattttcaagtacagggtacacatattgattaacataatgggaaaattaaagcatttataaagtgctctaaggactaatctactaagaagatttatgtttttaattaaacattttaccatggcaatatataagaagaagatcttggctccactgtcagacttaataaagctagcattgcatgaatcagaagaggagacaggggttttgaatagagaaaggtgggtagatgaggggaaagaatattgagttgggctgaaatcctcatcctgttaacaagtccctgaattactgtcagcgttattgttaagccacagggtatctctttacaaattagagaaaggttacactttatcaagacccattatttctatctgtggaaaactgtcacaacatacttattatggaaacagaatctgtatcattatttaactcccttaaacttaataatcaacagatcaacaatatccatgatgcaaatagcatactgttagatgtagtgacattgtgcactgtacaaacaagcatgcatgcctgattgtcatgtttgagacagagacttcttcatcttattatagacacttatatgactcataatgtccttctgctactaaaaaagagcctgaaaatttggcctacattgtttcagaaaactgagtcccagtcttctcagcatttccacttatcctaataagttaacttataataaggtaataatttgctttacctacttataagatagtctacttctgaggatgacaaaatttaaggactggctttctgagtttgaattgcacacaaagtattcaattgcttttccctacagatgcagaaaaccatcaaccatgtctatgtgtgtgtatgtgtatgtaaataaatttatggcttgttttcccttccatcttttcttgaaataatgttttgacattagtgtaccttaatacatcaatatgtttttggtttgattatgtttttcctgttactgaatgtcctttttggatatatgttagttcttagaaaggctggctatcacctagtgtctataacgttaagaaaatgcctgcctgttaaatatagagacataaagcaaaacaacagctgagcacttgcatcattgttctggagggcaacactgattacccactttagttctgactccaataatacaacttctatctattaactaaataagcagtattttatttaaatgaagactggtatgttttagaaaagtcatctcaggattatagagctagtgtatttaccaaattatccttttctctgacccaaagagtcttgagtgcatggtttatgacagtttgttgaacacactgtgctggaagtaattattatccattatttttagaagggtctaatatgctactgtgaaacctttttttcccctgcatcaaaagaataatattattttactactagtcatatattaaatttcaaaacttgataaagcattatgatccctctaaaatataatgatttataacttgttttcccctcaattttaagttgcattcttatattctatttcttttaatttctaataatcatattttcattgaaacgatctttgttttgattataaattctctaagaactggatgatctctataattgaattattatttccgaaattaggttgaatagctagagtttattctgtgtccctcaataaggtatacactttacaaagtttttctcatttgatccacagagcattttagtttgggtaaaataattatgctcattttgcagatgcaaagttaaaatctgcatagtaagttgtgcagtttcttaaaagatgagggaagtgtcacaatctgtagagctaggatgtgaacccaggaagcctaacttcagacctggggtcttagccacagtgcaagactatgctaaacggcttcagcaagggagcttttacgcatggtcttctgagggtagttgatatggcaattccaaatgatatgaaaaataatgaatcagtgctttccagctgtcctcaatgatttgctccacctgtcttcaggcctttcttttatccatcagcactcttcaccctctcagcacaaagaacagcctccctcggggactgggtagagttgctatctgacacccaaaattcacaccttgcttctttgcattctccctgacatctctattcatcagctcatctgtctgcttcagagtcacaattctcttcaggtttggtttcgaaagcgaggctcaaaatttctgttgttctctgaggctgtggatccctcacactcacaggatgcctcttttcgcatgacagagatgcctaagttcattatccacaggctgcttctgagtgagagagatttcatcctttctaaagaccttcttgactaaagtagttctctttacctttgtcatcttgcagccactctctcgacagatgaggcacccagcatgttctatttccatagcatttacatattattaatagaagcaggccagtatctaaaggatgacattgaagaagagttttttttcacattttaccacagggctctacaagaagatgatcttgccagtgttctcttgaaacaagtttcctttttctcaactcagagaaatgctttttatgtaacatttgtgaaagattcttatggtctactatttttttaaatttcctattgtcggcctgactggcactgtgaaatgacatcaatattgtcagattcaaccaagagtcattatagccacaataaaataccatgtctccagaaactatttatttaagtataaaaaggaatcaagcataactttaatgagatttctcagactgtgtgtctgcctgaaagaaatgtgttccctctgtccagtcaatgagaggatcagagctctttccagctttctctcattacctgcttgttgactagtgcagccttcaaaaagataaccaaagactccctacatctctcagatgctatgtaatttattgtgatgtaatgtattggtctataattatgtcttcattttttcgtccactttgactacaaaatcttcctttatctttcttgttttcttttttttttttttttttgagacggagtcttgctctgtcgcacaggctggagtgcagtggcgcgatctgggctaactgcaagctccgcctcccgggttcacgccattctcctgcctcagcctcccaagtagctgggactacaggcgcccgccaccacacccagctaatttttttgtatttttagtagagacagggtttcaccgcgttagccaggatggtctggatctcctgaccttgtcatccgcctgcctccgcctcccaaagtgctgggattacaggcgtgagccaccgcgcccggccttcccttatctttcttactgtgattgcatttactctgagacttttagctttatccttgactgtaactcaggcaaattactaattacaatcttctttaaacttctgatattgatttctggctttatttttctaatccatgctgtactctgatttaatagaaatttttaagaaacaccaatgaaattaaagtttggctattactttcacataatacatattattcttcttctataaaaacaaacataacaactcataaaaaatgacaagaaatggaaataaaacatagggatcaaactggaatgacttctaaaaatagctagagttactgatttactataaaaactaaacagaaagtttgcaagtcaaaaataagtttattctgattattcttttgtaagttcgctgttcgaaattttaaatgcacttatattcactaccacataccaggaaacatcttggtaaacagagatttttaaatcagagtcagaaaaaaatgttatccggcagatacagaaataaagtgagggatggagaggttgagttaccttattgagaccttggcaagaccaaaagcaccaatgatctagaatggtggctggtggttctcaaggtatagttaagggataatgtgcattagcatcaccataaatgtttattaaaactgcacaccctagaactcatctctgatctattgtgtcagactaagagtgaaacctggaaacctgcatttcaaagatacttcccaggtgactgtgcaacaaaattagagaatttttcatagctatcaatttatagataagcaatacagaattagaaagtgaaaataaagacgcaacccagtttgtacatttaaaattcttctcatccagttgcatgatttgcattaggcatgccttgttttcgtttggctgttgggataacgggcccagttatcttatatcttgtctatattctgttactgtcagagaaaaggcaaatttaagtcttatttgaaatgtgtgccttcatctgggtcataaaagttaggtgtgacctttaagtacttcatagagtcttaaaaatatgtcagtttcacatatatatgtacgtgaccaatgaacttaatatatatcacctttcaggctgaacataaaagcacatgtactttcttagtgtaaaatgaggtagaaaggtaaatattttaaaacataatttgttccccatatttttacatgcatgtgcctatacatatgaaaaaaattgtgtgttttcttcctagaataaagaaaaaaactaagtaaaaaggaaagaagtcatcaactgaatgaagggagagaaaataaattcctgggaatgtactgttcccaactcaatgttctcagccaacaattgagaatcataattactattaggataaaaatacttcaggccaggcctgaagttagtgatcagctgctaagaggaatagtagttatcaacatcatgagaataacagtagtaaccaagcaaagcaatgcggtctgtacttttcactgaatgaaacatcaggtatttagatcatgttttctttctataattttgcacttgttttcaattacagataattatgtacttacaatattgttttatatgttttatggaaggaaagaactcctcctagctttaaagtaaaatagagcaaaactgacttgaccccgattttcctttaaatccgtatctcaaagtattttaaatctgaagtaaagactacttgtgtcaatgcaacatatatttttgtagacctttgttccttgttgtccaccacttctatgtactatatccctctcacatctgcttttatatctatagcatccggcttgcttaagatccatgatatctcaaattaaactaagaaatagaggcagtgaagctgaatgtacaaaacagaaagtttgatcttagtagactttcttccagtacactgtgttctgttttgtgattcacacccaatgatttgtgtattgtaacaactagctcagattccaatgtggccaatactttcaaaccagacactattcctaaccaaaaatatggcaagtatcccaagaacagaattattaatgtaactgtcttgtcattcactgactgaaatatctaatgaggaaaaggcttctattaaatatactataaataagcatttaacatttggagctttaaatgacacaacagggaaacatttgtgtagactgaaatctatttttattgttgattgaatcagcagtttgtaaggctgccaggcaatggatcagtacacttatagaaaaattaaatttaattgtatttattcactgatgaatagaaaccaacccaagacaagtaaaaattgggaaatattttttttattgctcacatcatagcctgagccaaaactgtgttaaattatttaatttgtgtttctcttatattatagcaaatgggagaaaacaaaaaacaaccttcctaaggagtgctgcgtttgggatggcaaataagcattaagtgattaatgcccaatagtgaccaataaataatttagttatctctgcagactttctgttttcttgtaatattttgtttctttagatacataatacacttgcccttaataatgaaaaagtaaatacaaccataatttattatttttattgggctaccagaagtaactgttgtataaggacaccaatgtgggtggataattggcatgatcttccaaatttgcagattttagagaagattaatatttgataatacagtcttaataatggtcgaccattgaaaatgaggttaaaagcaatcaattttcaaaaagtttactcaatggtttataaagatatttctaagaaattgaacttaactagcaaagattatagttttaatctgtacgtaaaatgtattttttaaatcttctaactacctaaaaactctatttttttcacattcgtatattagcatgtatatgtgtgggaggtatagttctgagatgtttatgtttcatagttcatttgccttaactattagaagttattcttaaagtacttgaagccagaaggtctaaaccaggggtgattttgccccccaagggacatttgacaacatgtaaagacaattttggttgtcacaactaagggagggctattggcatccagtgagtagacgccaaggatactactaaccatcctataagacaaaggacaggcccctatgtcaaagaattctgaggccccacatgtctaccatgccaatcttcagaaaccccgtcctaaccttttaaatttgaccttattttcaagcaaatttcttagttcagaggaagcactcttttaaggtagcaacagaatggtgcatgctagtagtgcctctcttgcccagtgctgctggattggtactgaatttaaactagttaatgtgaatccaggaaaaacaagggcaggtcatcatttcaagataaaatgactaacatgaaactttaatagccctcagtgttgcaccgctttctttgtctttctatgacaataaacatcatatttatgattactttgtttttgttaggtgtgaagatagaattctaatgaaccatcaaatatcataaaaaggcagtgagaacaagcacctggctcaaaggtccactgcctgctcatataaggtcctaaattcactctggtagtctatataaaacaaatgagctgtagaaaaatgctttttctggcagtgtacctatgtaccttaaaacatttctcactaggaaaaaaaaaaaataaagcaaacatatacacataacccccccaaaacaacaaaaaaactctgtgttggctaaaatggcagacacattttaaagtatgcagagcatacatttcagtactaaattattgcaaataaataaatccagagaatgtaaaatgaaatatacaggacttcaacatatccaaatgtcaacgaacaacaagtagttgaaagaccagccttttaatatgcaccaagaccaattcttgggctacaatatacctgttcaaataaaacaaaatcaacttaatgtgaagcatgtgttgaaggtactctatccctttaactatctccacttggctgttagagtgaaatggtgttagactattctcattaacttttaaaagcttaaagaaaagccagaattttacacttctcagagctaataggcctttcgtttattgccaatcttaagtaaaaattcacaagtagaaagatgccaaaacatatttgtctctctggatacctttataatttttttttaatttcaccaaatcaatatttacatattttatattttaatttatacttttcatatgctaaaattatttttataatgcacttaatggcttacaaagattaacacaaatagcaaataaaaaataaatctaaaaatgtaatgaaacgtaccaagaacacaagaaaaagagaaaataagaacaatgagatggagacagaaagagaggcacacaatttacagtcctagagactcacttgtagaagccactgggaattttgaaaatgtcagattgtatctcaataaataactataaaatatgagctcagaatataccatatcccatatcctaagacactgcagtccctcattttggtaaaactattgtttgtcttttctttgccatgtcctgtctttaaaaataaatatcctattgtaatttaataactctctttatctcagctatgctacgtccctcaattagtcccatacccaaatggctcacaaacacacaacactcttttcttaggtccagatccacatattcacctacctatttgacatcttttgttatataacctcaagatatctccactgttattgatagctccctctgcttcattctataacctatacatctgccgtactgccaactttccatttttactaccttcatccaggtccaagacattatgatagcaactactgcaatagctttttaatgggctctcagacattcactccaaaatcccctaatctgtgaaagcaaatctggtcatattagctcttcataaaatattaaacagtttccctttgcaattttaaaataaaaacaaactctttaatatgaccaaaaagtattgacttggtcttgaaacaaaacaccatttcaatcacatttcaacccccctgcttcccgtatttcagctactatggaacttcatttccattctcccagctccattctaccataggacctttgaacatgctgtgtttcctctacataacatccttttttcctttacattaaacatcttgtcatctggttcaccccattcctctttctgaattcatcacaaatgtcatttctttagaaaagttttctcagatcccttcactaggcccaacctgcctaagggagtctcatagagctctgtggtcctccctcttcttcctgacatagatgcaattttgtgtgtgtttgtggaacgccctagtgagtgtctttacgcttcacaaggatagtgatatggcttggctgtgtccccacccaaatcttatcttgaattgcagctcccataattcccatctgttatagggcggacctggtgagagataattgaatcacgagggcggtttccaccatggaaactggttcttgtggtagtgaataagtctcacaagatctgatggttttataaggggagaaaccccttttgcttggttctcattctctcttgtctgctgccatgtaagacatgcctttcgccttctgccatgattgtgaggcctctccagacatgtggaactgttagtttgttaaactttttctttataaattacccagtcctgggtatgcctttatcaggagcgtgaaaacgaacaaatacagatatcaaagagggcagaaaccatgactttatttttgctcattactagaccctcaagtctaatgcccgttcttgacacttaatgcctgtccaacaaatacttgccaaatgaataaatggatattatagtggtatcttgaattaagaatgataaaagtcaaccaggcatggtggtgcatgcctgtaatcccagcactttgggaggctgaggtgggtgggtcacctgaggtaaggagtttgagaccaacctggccaacatgatgaaaccccatccctactaaaaatacaaaaaattagctgggcatggcagtgcgtgcctgtaatcccagctacttgggaggctgaggcagcctggacaacaagagcaaaactccatttcaaaaaaaaagataaataaaagttaactatttgagatgttggtgctaatttctgaaccagtgatatacactgtgtagaaaggcacataatggcataaaaggtcagtgtttgaaaattattaaaaggataacataatgccccaagaccaataataaattcttacatatagaactcttatggtactgtttatacacattgttttattactccagatactctatgggacagaggatattattctcctttttatcaagagaaaactgagcttaaaaaagttaagtaactttctcaaagtgttttaaaatgtaaatgatagagctgggatgtgaacccaggttgtagtcatttcaaagtccgtgacctctatgctgcatagcattagtagtgtctaaatttaggtgactatttgggggaggaggtcatgaattttttttaatgttaataatcttcattcatttaataattttggatgatcgccctctataacagagacttctacatttcatgtaaatataccagggtaaaactttgcaatttttaaaatcacagcattaactatacaatggggtcactcaatgaaaatcgtttatgaatatgaccgaagatttcattataaaaacacccaccaccagtagcccaaaaacattacaacaaggctcttgtgtggaaaaaaaagtatttctctttaagaaagacttttcttctttttttttaatcactggcacaaaaattttctcagaaaacactaaggaatatcaaccaatcaaagacacaaaggtttatcaaggaaggtttatggaaagcaaatgttctccaaatatgcaaatccaaaaaggaaggacaaggctgggtgaaccctgtctgcagatagcacagagtaactgagtaatcacagagtaattgtgactgtttcaagaactgtgtttcagatcatgttaacttgaggaacaataaataaatcttgctaattcagtgaaactgctggttttatgaagaacctattgtgggccaatattttataattcaatattagtgatacactgggcaaattttctcattaatgacactgcatcatcaaactgcataaatgctccactgaccctaactatttgctactgacctccacagtttgctggaagtagcagttgtgtatgtattccaaatttaaaaagcaaatttctatttcaaaggacagatctgtgactgcctttaaacaatacagactcatttaatatctaatttattcagaactgaaataatgtcacacaaaaagctctacttttgtttttcagtaacagtatggaagctgtgatttctgagcaataatagaagaatacttcagcctctcagccattacagtaagcagagaatgcaagagaatgcatgagttcttttgtggaaattggcagataatggcagcttttctgaaatctcccacttttttaaattggcaatccgataaaacctttaaatttggggagtgggaggaggaaatgtttcaataaccacatattaaaaataacttgctaaagaaaggccttgaggctctcggatatactaagaacaaacaatcaaatgtatcctgtacctgggaagacaaaagcctcacaatcacgatgttaaaaggcaagaaccttgggctccagaggttaaagggtagcatcctgatgccataattaggcaactggatgcatagcaagaagagttctggaggggcaattagaattgtcaccagatccatcctggatacatcactaagtgtctctaagccttagttttctgtctttggaacacttggtttggctcagtgctctattaggcctagcctggaattcaagattctaaactctcagcaggaattttacctacaaagaaatataaaactagactccacatttttgagtcctaattcagagacaatgttgataatttttatatcattgtatgtcacaaatctgtagatgtcaaaaattcttacaaatccttatgattatggattttctgacagtacagtagaaatcgaccaagggcactgggttcattgaggatattttattaatgagacttactttttgattaaaaagtatgtattaatattgatttcaacatacctccattatgcaatgtgactgaaaacagaaaatactagtcacaaagtgaaatgtaattctatttcttttaaatacttctgcacctatccatttaaaaatatttggatgaaccacaaaaaatgtctattatgcatcaattttttacctaagcaaacctgcaattttatacgttttaaactgaatgaacttgtttgtatgtgtgtataacatgaattaaaatgctaggtaattccaataatcaacaggatatcctgcattatcagaccttactaaataaaacaagcttttatcggctacttactctattgcattggtcttaactctattccataatggcacagtttaaatcaatgttttatttttatattatcattttcctaaatgcacatagcaggaggggaattttaacattgtcttcattattttataggaagtatcacagattatgtaagtatcttgtccaatggggataatatgaagataggctaaagtcttttggggcttaaaaacttagtacatcaaaaggaaatatgtggagttattcaggcatatgtcttttattgtcattgaaacataatagaatttggttacctttatggttattcaaatgctgaaaaaattatctgtgatttaaaaaaatcaactggcagcataagcactgtcatcagttgatgctgatttctctaagctccttagcctttatatcacttctactcgtacaagggatgctttgtatatttctcaggcaagtttctcattttattttgttttgtttttaaattctaagtagctttaaaaattgtgctattgttccatctattcttctttccaattttgttaggcatttagtgacagtgggctttggtggaaacttatccattgctcagaccagggacatgagtcttgattagccaagacattcctggtagaacccttctaatgcctgtgactggctcagaaaagggccaatgacactggaggaaaactgctggggaacttatgggaaaggttctcatttgaaacatacacccacccagcatcctagtttatctaaggatgcagttatatgaggatgcaatgaatgaaactactgcacccattttgtgatcacagtgcgacataactaagggcaaaagccaatatgctgaagatggcagagtgaagatgtccaggttctaaagaacctggagttgtcaaactacctgagctttggattttttgttgtgtgacctaataaactggtgtattttctccttaaagagaaagatcacatttctgtatgtgtgtttgactgtgtgaatatgtgtgcctgtgtacgtatataaaatggtcaataaaatgttaatgctgattttttaaatgagtttttttccagtatttctttactggcagaattaaagttggttataatctcccccactttttatgcatgttcctatatttagtgtaggagagttaaaaggacaaggaggaaggatgaggcaaaaagatggaataaaattttattttggaatcagaaattgattactaagaacagtgacttgaagcaattcacttttggagtatctgtcataatcaataactacccacagcttggttaatgaacgttatttttagttgaattactaacaaaggaaacaattagatatgatcaccaacattttcatgcattaatgccagtgcaaattaactcctaccactaaaattactccttctgtctgtcaaaatctgtgacggctatgacttactgcacgcagagcataattgtgtctccctgcctgcataaagctgacacataaaatcaatattaattaaaaaaagatcaaaattgtcctcattatcttatttggctgtctctccaaaatagggttaccatttatgacagaataaaacagagtctggacttaaatgattcctcctgccaaataataaatgatccttttattggttggatctattaataaatatctatttctctatggatgaagttatgcatagtgtaactttgaaaaaggacccaatgtctaactataaattcatctagactatctatgacactttgccatggatatatttttgttctacacatctgtattctctattctctcctctgcccaaatgctcctaatacaagaaaagaataatcatttatatcagaagttgaggatcactgtgccctgcagaatgtatataatttatttgacattttatcttttctattataatgaatacaattttaagttttattattattacacatttattttaatgaaaaatttgtgggttcctaaaatactgagagaaatatgtgagctcaggagatttctcatgttcatcaggaggttttgcaaatttgtgcctcagtttatgaggtttcatgatacttcttttcctttccactccattttcttcatgctggctttccacacagcaccttaatgaataaaatgacaattccagagaatgttaccatcactaggatgacttagtatggaaccctaaccctaatcatctcaaatcgattgacccccagaaacaaaaatcacagggttagtttcttctgttctttcctgctcccagtgatgccttacagacatctctgagaactgggagtctacatgatgtgagatattttcttattaccatcaaaactcattcaaacaatattcgctttaataagttggtgtttacttgccaacaaatatcaataactcacaaccacaaaaaataattaaaaaggaaaagaaaataaaagaaatataggtggtttatgaatattcaatcaatcactttaaaccacaggtaattttatcacttattttgtcccattttaacaatttatgctcaagatatagtaaaatgaagtaaagcttaaacctttgactaaatgtttcaaagagaaagaaatttaactttgagaattgcaatatttacatatatataaatgcaatatttacatatatatatatatactcttttttcttttctgcccttaaattgccacttatacatagagtacatcacttctgctatccaaatgatttggtttgctttacagaaacccaagtttggcactttgggaggccgaggcaggtggatcacaaagtcaggggctcaagaccatcaccctgtctctactaaaaataacaaaaattagcggggcatggtggcgggtgcctgtaattccagctacttgggaggctgaggcaggagaatcgtttgagcccgggaggcggaggttgcagtgagccaagatcacgccactacacttcagcctgggtgacagacggagactccgtctcaaaaaaaaaaaaaaaagaaaaaagaaacccaagtctatatgattataggcaaattatttaatttccatatctcaacgttctaattcatgaaataagcatcataatactactcacctaataggtcccttgagaggattgagtcctcaataaatggtaactgctactattaataaataataacatcggcagattctaacactcagtcatatagacaataacttcaggaaatattctccacaacattacttacttccacattttcacattaaaggtgaggaaaattgatttctgaagttcagtagatagacccaaaatcatcctccaattagctggtggcatagactgaacaagtgaagagacaatgttcaaggtcactagaacttgctgtagcacatgtgaaaattgtagcagaaataaaagtataagaaaagacagtggtttccaaaataacactgacattttcactatagagagatgacaacaaaattagaacatttaaatatttttaaaggatttgttttctcttctatgacaaaaatttgattttacttttgcattagtgaagcgatatgctttttgaacttgaggttaggtgggtccctacctcgtgtctttgttgctatcagtttgtacaactaaaatctaaatgcctcggtttccttctaggaattatgagctatgcacttaaaattcactgaaattttaaagtgggtatgctctactaacaaaattaataagaagatgttaattgagggtggcaaactaaatacaggaaactgctcagcatttttttgtcagaaaatatttcaaatgagacaattttgtgcctcaagagtttatgttagctgggaaatggagaagggaagttgggagaatatctgaagaaagggaacatttaatgaacattaaataataagacttaatgttaagcacttcccacatcaattttgttttccagaaatccaatgagaaaggtaatttgcagatgaaaagaaaatggaatgtcagttaatttgacaaatgtcaaagacatgtttaaaactttgaaacttatctaacagatttaaccatcacgtgatcttttaaaccctcactacagtcccatcttctccttttccttacttataaaacaaccctagatttccttttcagtgttaaatagtattctaccttgaaaagaagtaagacatgactactttatactgaatttattcaataaagaaagaatttgatcacacatttctgaataattactgctttgtgacaaaatgaaaattaatggaaacagaaagtttcctccttcatagaatcaccatttactcactagctttgaaactaattctagcccaagattgccctcaaaccaggtccaaacacaaactgtaatccttataaacaccataactatgcagggtggaattatcacccacactgagccttttctttcaagtgttatttctgatttcacatgtgttgagaacatttatatacaagacctgagctacacaattttaaatgttattacttgtaaaatataagctgtgtctttatagtcacatatctttataatgttacaagaaggaataataatataaacaccatcacagttaatttataataatttggtaaaaacaataatattttaataatgaagctaaggtaatatttgtaagcaaaggaaatccccaatgtggaacaaaaaagaatgaacagcaaagaggccatcaagacctcacaagtgctcatctccccagatataagtacttggtcaatatatgtaagaaaatattttctctctaatgataagaataaaaacattaattataacaagatataattaataatcagttactacttatcgagaatctattaaatctgaattattccattcatatttttaaagggcttgtatatatacatagtttttcatatgcgggtatatggacccatatacatataaatggtccttcatttattctattgaccttcggaaacttgttttccccattttatagatgatcaaattgaggtccaggctacttaagtgacttcactgaagcaaaatccaagtagagagatattacctgtttaattagttgacatgcactgagctttagattgtgaatatgtatattcataataataagattatggttacatgaaactgtaaaaaatgctgttcttttctagggaaataaacacatgtttagcacagaatgttaaaagtagcatggagtagtatgagataaaattaaacatttgctttcaaggttatggcaacaaatgaccacaaagagaaaaaatgataactgaatcataattttctgacaatctcttggtgtttctgtattcctcctttgtgcttcacatgctgccctctcagtgaaaagcaactataagcacatagtctccaactgagcatgcggctggaaggcatgcaccatcatggttaattaggcaggcttcagaattcagcaagtagggtgaatcttagctatatcacttcctagctaggcaaccttgggcaagcatttaatctctccaaatctctgttactcatctatacaataaagttgataatagtatctacatgaaatgactatagctagaattaaataaggccagggctatcacaatacttggtccatagtaagtgctcagtaaatcatgcttatttttatatttatatctgcccccccccaggactgaaaaaaaaccactttaactttttcctctagaggtattactgctaataagtgcctcccctcccctcccttcccttcctctcccttcccctcccctccccttccctccctttttctctttccattgagaaaaccaaatctaacatgaacatggcattttcctttctgtcttggtatagcctatcatttctggattcaccatatggttaatagatggtggtgagacatagtgtggtatattagttcattcccatgctgctgataaagacataagcaagactgggtaatttataaaggaaagaggtttaattgattcacagatcagcatgcctggggaggcctcagaaaacttacaatcatggtcgaaggggaagcaaacatgtccttcctcacatggcagcaggagacagaagaacgagaaccgattaaagggggaagccccttgtaaaatcatcagatctcatgagaacttactcaccatcatgagaatagcatgggggaactacccccatgattcaattacatcccactgggtccctttcatcacacgtggggattatgggaactacaattcaagatgaaatttgggtggggacatagctaaaccatatcaggtggaaattttaaaacagtaatcaagaagacagaacccttcctctcactgccaatgggacaactagcccagcctcttctgtgttcagatcatagcagcatctagcagtgacttgaagctagggaagctccatttcaatttctgagctaaaactttttctcctggcacccaaatttatatttctgaatcagttttgccgtagaaaaattgttatgcatggtggggaagttctaaagttgttgtacattattacctacctcaagaacattaaggattaaggaggcttccaagagctcactggtgtgaggggctggtgagcaagcgtactactgtatcaatgaaaagatgagggatgggcacaggggctcatgcctgtaatcctaaaactttgggagactcaggcaggaggactgcttgaggtcaggagtttgagaccagcctgggcaacataatgaaacctcatatctacaaaaaattttaaaaattggccaggcatagtggtgtctgcctgtggtcccagctacatggaagctgaggcagaaggatggcttaagcccaggagcttgaggctgcagtgagccatgattatgatactacactgcagcctgggcaacagagcaagaccctgtctcaaaacaacaacaacaacaacaacaacaacaacaacaacaaaaatgtggtctgattttcaagtacaattcacaaaggcacatttgaaacacaatccactcagagactgggggctgcttttccctttcttttcattggccactggccactagagggctgctgtgagtcatcccccttgtcagaggctcttaaggctcatagttctgaaattaggatgcatttcaagggcgggaccaaattctcctccacttctacagtatctgcagagtgtctagaaatgagaaggaccgtttcaagagctcataaatatcctgttgtggaagacagatgaatgctctgggttggaagcaaatttttttttaacacatacctagggaacttatgaacactctagttagcttcttcaatgtgtctgaagactgctcacactcctgttgacaagtaaagagggtgaactctaagaagtatatttaaatgcaaaaatgaacccagttcatgtgcttttcttgtactctctgtgttttagggtagattatcatgagtggtaaagaagatagagaccggcattagagggtggggcttagatacacactcatatacaacgggtcatttaggttgcacaaaaatcagaaagatggccacagatcagaagtggttttccactcaaaccactgacctctgggttgtctttctgaagaacttctttcctgttggttagagtttacttggtatgttcttgacccgtgagacaggaatgaggagatcagacaaatgggaggtcagaaaggaggaagagattattcccatgtggaatgaggtttcctaatttatagattcctctgtggatgtttggtggaaacaaacctctccccatttgcttaattttctcttgctcttcacacaacacagtcaaccatatgttagactcttgaaggttccatctctttccctggttttcttttaattctatttcctctcaccccaagccaatccagagggtggaattccaacttcgattcagacatcaaagccagtgtggccacacttgatctatctcatcttctttaatagacttaattcttctcaaggcaggtcaagattctattatctttggtaattttatctaattcattaatcaagaacaggattttctacatgagtaatatgagtaataataatatccatctatgtgctaatcttctaattattttacacatattacttcgtttcttctatgaacagcctatcaggaaaattgctggcaacattttagagatgaagatactgaagcacactgtggttgagcaacttgcccaaggctcgcaaccaggagaaggtgtatatgggatgtgatcaccaaaagtctgttttccatatcatcaacactgtcctagctgtggctaaacacctctacctctgctatgaccagcagtctctatttttgagctgcacctagcatgcaccagacatgataatgataatctcacaagcatcacttcccttagtattcaaaacaacatcatcagctgggtactgtccccacgtatagacgaagaaacagaggcttggcagagtttagtgcgatatcagaggtcacacctctagtaataacccaaccaagactgctgaatgtttctctgactgcaaaggctgtacttttacccagcaaatcatgttgctcctatagaaagactgcacccaaccgtccctggaaataccataggcctgttttagcacactgcgcagcactgataaggttaaatagaaactgtgattatgcatcactgcattgctaatatctctatgaataaaatgtcgatttgattttcatttaacctcaaaagaatctgattaccaaataaccattgaagaattattggcaattatgttctgtaattatggtgcctgttaatgtcattagcgtacagcctttcatatttagtactattaattaatccccataagcatagaaatttataatcaatataacaaaggctccatggtaaattataaatactcccgaaatccctccaacagtttacagggctccgtgggcttccttggttgggacacatttagtttgggggctgcaagaatctgtggtaattgatagcttttcacccggaatcggctatctcactaatgtgcctaattaggcaaatgcttaaaactggagtcccaactgccactgacaactataaattcctgtagggcaatcaaaataattaactgcttgagtcaagagacccacaaatcagatatacaacttttcaattctctgagcaatatactgcttcagataacaactactgtcagtgagtgtctggtttcggttttggaggagttgaatacagtaagtatgtctaatgttaaaagtccaaaaaagattcatgatagctctatctcacagatatgcaagataaacatgcatgctcacagtgatgctaggaatggatgctttgtaaagcactggtctaagaatatcatgtttttcaaaatctcccaatccatcctcagattttcttttacacattttctcaaactgaaacgtataagtctgttttatagaaaacctattttgtttttgtaattttaaacatctacattaatatacatcagattttttaaatggttacattcacatattttatctgaaacaactactgctataattgtctaaagatgcagcaagctgcctcagaagtggtacattctaataagatgtggcatgataatctattctgcattgttcagaattggactagttggtttctgaggccctgctctatgttagaatctaaaagtccgtgaatcccattcttttttcccacagagaaaagggattagaacttgctccctgttggcatcccacgccctttcctgattccattcttgttctggacaatttcccaggaattagtgcataaccctctacagctgctgggcctcagaaacaatttgggaggagaaaatagaggctcagaataaagaaaatatctattaaagcattattgcatcaaatataatggagaacatgttcatcttttaaaaattcaaaaggaagaatatgacacatttaggaggcatccaaaaatcacctttttcagataaataactgttagtggagaaataaaattaacttgcaatttggaagaattagtaggcagaattataatatttaagatctgaaaataacctcaaaggtcatttgaatccaatattccattttacaaatgagtaaggtgaaattcagaaagggtaaataacttatccaaggtcccaagtacattgatggctgaaatggaactggaaatggagatatcttaactaccccatcttccaccacccctaaactaaatggttaattaaatttaaaagcttattacagggtatgcttaaaggcacaacttcagattcgtggttttaaaataaaagattgtatcctaacatcgctgacaaccacagttagcatggattctcagtcttgtcaagatgcagaagtaagatatgcatagacattgggatgggagatcttatcaggtcctgtagttctattctacgagctttcagtaagttttatacaaactaaaacaataataataataatggatgataacgacaggagcctatactattttgaggctgaaacaactacatctcacataatttgtcacatagcattcagagccctcatctgacctgtagtcatttttttcatttctgttttggtggcttctatagctttttatttatttgtgtttgtatttttttgaattagttgtcagtagtcaaaaattaaaaaatgtcacagaaaacctgactacaattttcttacatgtagctcactagttgttaaaaagcagagaaataaaaaaggaagagaagagaaaagaagagaagaggaaagaaagaaaaccaaagaaagaacctaatgcaaatgatgagataatggatgcagcaaaccaacatgacacatgtatacatatgtaacaaacctgcatgttgtgcgcatgtaccctagagctgaaagtataataataataaaaaaagaaaaccaaagaattccttctgtgcttggctcagcagcgttggagttcctgactccactttaatgtttccttagtctagcaccaccaccaaagttcttatacaaatcattttaaccaccaccgaagtactgacacaagcattactagccgaagtggttgtagatttccttgaaattaaaaatatgtttcacctttgtagtttcaatgagaataagaaatgaatgtgcagaacgtcattcttaataactatgcttattataagaaaacataaagaatgcataatggagaatgcatatttcttcatgcatgatggttatgggaccagcccttctctgttttatttcctcttccttaataggtagctatgcaataagaacaaattttgaaaaaataagacaaaagaagatattctgatttaaaaggaggtggaggaagaggaggtagtgtcagtggcacaggtagtacctaaagtctacctgaagattctctccaggacatgggttacatgcataaattgggcctctgaaagccttaaactttatctagagatggcatataggctttggatttaacactttctgtgctctatttcatcacatttatagaactgttttcatagctttgaataagtatgagcttattacatgaatatttagtttattacatactactatatacagctgtgattgtgaacagatacacttctgctttttgttgaagataggactgagttagcaatgtctactgtattaaacagaaaaataattctctctggccacttccatattctcccagatcaggacctatacaaacactggggaaaacaaacttccaagtgatggcagcacaatcaagctgttttgtggaaggtataactgctttgcatggttataagcctgccagaaaacatgcaggaattcccaattcccagagcagaaacattgccagcatgtaactctggattccaccccatatgccatatttccagcccatcttcggtcagcacatagtctgtgctcctggggcgtgcaagactgtgaaaaggcctgcataactagctttcatgatgattcctgcattaaagagtaaaagcatctctgttcagctttcaaacagcctacttacccatggccaggaagaaggggaaattaatcatttaattaaattagtcattttccagactaaagataaacttggaatatgactcacttaagcaaaactttccacaggtgtcacttctccaggaagattaagagaagggcccaggtctcctattccagaaaactatttgagggttgaaacctcctccactgtgtatcacctagcacagtgcctagtgaacagtaagaatcaggaaagagttattggattgagtagctattgaattgaaatggaacccagtctgcccactctaaaacagtcactttgaacacagaatgtattaaggtgttatttcacgtgcaggctgttacaaatgttgactcaggctcaaacaaaccttttagcatttttacttttaatccaattgaatgattttacaaaatagggcaaggatataaattcaaataaattaacagtgggtaaaagagcatctagtcctcaaaaaaaaattctttggcctgcctatcatttatatttgtacaattattcctcttctctaaggttcacaacacttaggcttctgaagatggaaatacactgcacagggtattaacttctgccaatggaaataaaactgtaaatgatttggttttgtgattatttaacatataaacatgtgctcattgagaaaaatgatgtctggacaactgacattgtatttctgccaagtaccaagctaatgttcataaaattttactggagggaacccaatgctaactataggatttcaaactgctgatctggagagatgaatcgtgaagcaatctacgttgtatggctaatcagaattcccatccttacccatgctctgaaaagaacctaaaatttctatttggaggcaacttcagaaagctttcattaatttaaattttaaagcagatttcttcccattatgtgtattcaactgaaagcctatttaacacaacaccatgataaaagtgaaaaaaaaaaaaatgtcaggtttttccaaggcatccattttactttattccagaatccagaggcattgaaaatccagggctttctgcatttcttaggatgttttgaaaactaaaaagaactggtgataatttggtgatttcccgttctctgcaatttattttaaacatgtgaaatgaatgactctatgttccttaaagctgcccccaaattaagcaatgtaatagttgataattagatgcatttaattctaatttaatagccatctttatttggcatgctctttatataaatactactcaactgaatcctattaacacttacatggtttattacatttcatctgaggaaaaatgtacatattctaaaagctgcattatttaatcttggtgttaatttactggtatgcttaatgagtttacaggtttagtattatttaaactttgtgaaatatatgtaacttttctttattttacctttaatatttggagaaaaaaaggttctattagggttttcaatatggttataattgtagaatgaaaataagataaaattaaaattaaaaagcagaagtggtacagttctcataattttctacatgcactggagaggaacaggttttcaggaaatctcaaatgggaagtagatgtgttgagcatgttgaactaggaaggctcctagcaaaaacaaatgagatgctgtactgcctctccattacggccaacacagaaggagaaaagaaaatggcatcgtcatggcagtctacaaataactaatcactcccatgcacggttgattttcagtatggagtctggcaggaaaacctcagggactctgtcacccacttgcaggccagcttcacatgacacagtattattattagcagcaatattttgaccatttctagttatcttttctcttcttatctctcccctgaagttgatacaagaaaagattatctgaaaataaagaaaataaataccagaaaaggtttaagtaggaaaaactgcatgtttttaggaaatattctgagtgattagataggggaataaaaagtatgaaacgattatatcatgttctatgtagcctgacaaggtaatccctaagtgagagaattttttactgctgcaaatttgtgtgtgtaaagtgtgactgacaagccacaaacataaattggtaaaaccaaaaggaagtcatttagcagctcattattttacaattttctacatttcaataaattcatcatgacgatttttttttgggggggggcggaattcccaatggcattaatgtactagtttaatagaacaataaaataatattgcaggaaaacatatggctctgccaaaaatattaaactaatataccataaaaggaaaatgaataggtgattcattcactatccatttacaattatttaaattataaaaatgaaagcagcctcttcattttaaaagacaaaagaaaagtcatttagtagtttagtaatcaaacctatgtgagagatcagttatctggttagatattgatctcacttataaatgattttatattacactatgctcctagttcatgatacatatacacacatcctcttattatttattgaacataaatttatatcaaactggctttaagactcttgtaaatttgtgggagctccagttttactaaggcaaagtgagatgcagaatcaactccattttttccaaacaattgattccttatcttctaaaatgccacaattttcattatgccatacaaaatattacggaatgtaaattatcagtaaaatttccttagttatctatttcactgtgaaatatgaacacagcctgtattaataaccatgaattcaaagagaaaatgctttaaatatatatcaggctagcttaatctaagcatattgtttgctgtggttctttttcagaactgaatatcaagctacagtccactctgccgaaagcttccagctttccaaaaactgaaaaccttcgccagtaaatcacaactgttttaccatatgcctctctgttctgccaagcattaccagcttgttctacttttaagcaaatttcattatattatagctcagagcaatgctcattaaaaagtattactgaaaaatgtcaagttgtttttatatagaaactagaatttattttctactgaaaagtcagatatttattgaacacaagacatttttaaaacatagctttcatttcacaagttggttcaacttaatgattatctgaagtactttgggtcttgcaccagttaatgttcactagtatctcccattgatgtagattaaccattgcctttctagaatcaacttagactcagattagtggaaaattctcggtttcttcacctatattcatattctcattgatctgcctattctcctggctccccgccagagccttcttgagaactgctccactggacatactttaggggactgtaaacttcattatagcctattcattatagtataaatacagttcaaagaacactagcttagaaatctcaaccccaccgcttctaattgtgtgattctcaattaagtcagtaacctctcagagtcttcatttccttatttgtaaaatggaatgaaaacagcctgctctgctttttgaacctaattattgtgagcaaaaaagtcagcaatgcatgttccaacattatgtatcccatttaccatatgccaaacacaaaaccagaaagcttcattttaaagcaccaagctccttcccaaggaacagtttttccttctcttcagatagtaaaactcactggccataagagcctgtgatccacaaaagacaggatagatttttattacctgctgtaattaagtttagccttggattccaggcccaaagatttataaaatgttaggctttaaaccacaaaaccaaaaaatcaagccattcttgattcctctcaggagaaagaatgttttctaatcccatgaggaaatcccaatcagacatactcaaattggatcacactttacatttaaactaacaataagaacaacaatagaaataacaatcatcactaatccagatccagttgttctttaattgtaggccaaatcattctctgcagatcctgaagcttttcaaaaatgaagaccaatcctgaaggtgagctgaaaagtgttgtgagggttccttcactttaatctactgcatttttatgcagtgaaatcgggataatgtggaaatcaaggtcgcttttgatggaagagaggtgacaaaaagatatctagagggacagaaggaaagggaacaggagtaggatggccaagaacaggcctacttaatttgacttgctaatttcataaagagactctgagcagaattgcaggtggattatccacatacaatcctcaggcctttctctgcactttcctatgctacatggtctttccttcccacagggatctttctctggtattgtctatctccttagcaatgagagaatggaggctgttcaaatcacctgtcatgagactgtcaccctactctctaggtatggcttcacctaaaatacaattataaacatagaaacttccacctcacaagtatagtggtgatagcaaaactcagagcatagcaaagtgcattctagatgccaacatagaaattatgttcattcagtacattaaacagcatttgtttccaaagaactcaaacagaatgacaaagaaaccactaacacttcactagataagcaaatatagcactttcaatattatattaagagatgcttatcaagaacttgcaaatttccttaccctttgttctagcaatttgcatcagggaatctattctgcaaaaagcagcgactgcatttttttgcataaacgtgtgcattgcagaattatttagatggacagagctttagaaacaacctaaatatccaacaatagtaaaagagtaagtatattaagatatttacatacggaataggtggttgatttacaaagggctagtggaatagaaaaaatttctcatgttaagatccacatcaaaattttttttgtttacaatatgcacataaaagattaagttataaaatcaagatttaccaaagttgaaagcatacattttttcactctcttataagagcatatttgcatgttcctaaaagaatcaataaatatactcttataatccatacatgttgggtatttacgtgttaaaactgaaagtctaatcttgtgctgtctttgaaaaacggctgtgttgctgtggctaaagaatgctttacagaaaagaagcatggtatactaatgtgagaaaacgtgctttgtttttaaatgtgatggttttcttggtgacattttgaagtcaatcttttctctcttgaatgacagaatttctatattaagagagtatgtggagacaaatagtgcctctcagttgcgcaaagaagcatatttagtatccaactacagaattccacggaaattatagaatcttcagtccagatttaggtaccagagttaagtagaaatggttatagaaccagtcagtaagagtatagcatatacgcagaccgccacacagagagtgaggcatgtgcaagagaaaaaaagtaagagtgtaggaaacaaagagtgcaggaggaagaagagagcaaattggtaatgattctgtaaccagagaagcactggcatgagtgaataactcaactgtaaagaagtacagaatggatgatagatatcccaattaccctgacttaataattacacattctaatactcatatgaaaatatcccatggatccccaaaatatgtacaactatgatatatgaatacaaattaaaagtaagtacagaataagtcatatctatcatcacacatgcagtatctccctttttaaaaagttctcaataaaataccttaatcaaatgtggctcagtaatagtaacactgaatttagacaactttatcaattatcttatcactagaatggtgtacaagcgtgatagtctttgattgggcatgaccaggaaaaagttgagggttacaagactggtgaccctcaagagaggaggtaacatttgtcggccttacaattctcaatattgatgcatgctgtgaaagtgcaagacataagttattctcaatattgtgagaccatcaaatgttacctcctctcttgagggccaccagtcttgaggctctcttgagaacttccttccaatattagtccataggacctcctgacacattcacaagagaaacagagagcaagctgagtgacattatttttattctcttacttgagggaatatatgtaatttagaatggattagatagctctcctgcattgctttattgaagatatgtctggagtctgcagtcagaaattagtgaagtccttccttatccatctgaaaatttcaagtttctctaaaattaaaacaagaaatagaaatagtttaaccaacgcagagaccagacccaacacactaatgcaaatacccctttcctagactctactatggtcgattcacttttccttatggttcacttcatggcaaagctgtaattataatgcttagaaatgttgacctttacttaatgactgactctctcatgaccaagattaatgatttgaaagcccaaatgcagatgctaacaaaagataaaggtgtatctatcacttaatgcaatgaaattttattcattaaagaacaagaaacaaaggctgattatatcttccttcttataagctatttaaaaacaaacaaacaaacaaacaaacaaaatgatgtttcgctgtgttacgcaggctggacttaaactcctgggctcaagcaatccttctgcttcagcctcccaagtagctgggactaaaagtgcccaccaccattcccagcttataaactacttttaaatagcagtcattctggcttgttttcttgcatccagaaatgaattcgactggtggctcattgtttctttttccagagtaacatggtctcttttcctttggtccacacagatcctgtggatcaacttcatgtcagaaagcaaaaagtaaaaataacaccttggagagctctcactcatctattcgcaccaacctaatcacaatgctactgcttccaggatgaccaggtaatgagtgtggtctatccaacacgaggattctttccaaggcaatttggagcaaatcaactaggctaattggtaattcaagtttttatcccataaaatgactgtggcccaagggaatgtatcagaaacctgtgcacaagagtttgtattagagttgtttattaacatggggattatcttcaaaccaataataaaaagctataattgactctttgcaaatgcataaatatgggagcaacagtgtgcacaggttattactaaactggaaaagaattttaaacatttcttgtaataaataaatcacctttaatagtgacaaattgtagataaattgcataatgccaatgtatatttcaaggtaagaactaataatacatcaattcttttttgttcctttaagattagaactcataaaccccacagtgcactgggtacaaaatcccattgaaaactcagaaatgggactgatgggagaactgaactcagagacttccacaactcggaaatatgttcttaaaaagccatgtatctttttatcttgggcttctaggcaactagcacaggtcaagataactagcataaaaggaatcgggcactaattctgctaccatcttggtgtacgatctgacgcaagtcaatgaatcactatgcatctcaactcttagatctaaaagacagaataatcaagaattttataagactccaatgagacaatttataagaaaaagcattgaaaataatgcatgctgtgagagcgcaagacataagttattaaagggctgatatgtcaggaatatcagtaagtttcagaataaactgttacggtctattcttgatttggttaaggacatgagggtaaatatgcttatgctattccattttatggatagcagtggtgagaaccactgtggccaagaattttgtcaattaatctgcaaacttttctgaccaatgcttagcactatcaatctaactaagctgtgtgtgtgtgtgtgtgtgtgtgtgtgtgtgtgtgtgtgtgtgacttaatcaatacctaacaaagatccctggggtgaagatcactcctatattatacctagtaccaccagttatttggagggacaggtgttatccactgatcaaatcttaggaagctgcccctcggagaattacagctctggcacaagcagatcatagactcagtttacacttcaagaaactctatttagtggtgactgcacatagttcattttttaaaatctcgctgcacacagcctgatcctgtactactcaaacatgtcaattgttatgattcattattcttcaaaggcctcaagttggtactcaatattccactgggagcttggaaaacggatctgtcccttcactgagttattaggcaagtttcaacacatcttttcatcagtataagagtctacagaacctagcctctgtaaattcagagaaggggccttgtattttatggcacatggaaaggcgttagtcacacacaacttgttcccagtcataggcctctgttcaggctcctctcttctctaggttcccttagccttaccagcaaaatccctagacaaatcttatttcttctcagacccagacagagcctcagatcctgtatgaagactcctgcaatgaggggaaccatcttctccactggaatttgtacagctgttgtgaggctcctcttctctctcaatatcgccttttctactgccactcctttcttgttaaggtactagccactctaaccacaccttctctcattcctataaccaatcatttttaaaagtctggcagaatctctgatcccaacaccttcacagaaaaaaaaaagtaaaaacaaacaaagaaacaaacctgttatgcattataggagtgattttcaattgtgtgtatgtggggtgggtgtgtcttgatgggaacatgaaaactccgaggcagatgtggtaagcagatgggcggggcatgtgtaatgtgatgagtccttccagggtggccttatctaccttgcttatagccagcaccacaatctattcacattgtttgtgcctcagctcaggagcttcttattgctcactcaatacctcccaaatgattttctcacctacagtcttgttctctttaaccatgacccaaaccaaccaattaattctctaccttgcttgctgaatgacctgtgtaaatgcaggcctaattctgtcaagcccttcttaaatccttcagtgtctctctatcgccttgaaggctaagtcaaacttcccaacaaggttgagtaggctaccattcccgtttgggctttctagcccctttttgggtttattttattttttatatgcatttttttagagactgggtcttgctatattgtccagtgcagtggctattcacaggtgttatgatttggctgtgttcccacccaaatatcatcttgaattatacctcccataatcctcatgagtggtgggagggaccaggtgggaggtaattgaatcatgggggcgagtttttcctggccgttctcatgatagggaataagtctcatgagatgtgatggttttataaagggcagttcccctgcacacactctcttgcctgctgccatgtaagatgcgcctttgctcctcctttgtcttctgccatgattgtgaggcctcccagccatgtggaattgtgagttcattaagcctctttctctttataaattacccagacttgggtatttcttcatagcagtatgaaaacagactaatcaattttttgtgatggttaatattgagtgtcaacttgactggattgaaggatgtaaagtattgttcctgggtgtgtctgtgaggatgttgccaaaagagattaacatttgagtcagtggactgggaaaggcagactcaccctcaatctggaagggtaccatccagctaatcagctgccagcacagccaggataaaagcaggaagaggaacatgaaagaattagactggctgagtcttctggcctccatctttctcccatgctggatgcttcctgccctcaaacatcaaactccaaattcttcagcttttggactcttggacctacatcattggtttgccaagggctctcaggtcttcagccacagaatgaacgttgcactgttggcttccctgcttttgaggttttgggactcggactggcttccttgctcctcatcttgcagaaggcctattgagggagttcatcttgtgatcatgtgaatcaatactccttaataaactcatatatatatatatgtgtatacacacacacacacacacacacacacacacatctatcctattagtcctgtccatttagagaaccctaatacaacaggcatgatcatagcatgctacacagccttgaacttctggactcaagtgatcctcccatgtcagtctcttgagtagctgagactacaggctcatgccaccatgtccagctctaagaggtcatgtacttttttaaatttttttttcaacttttaatttttaattcaggggtcacatgtaaaggtttgttacttgggtatactttgtgatgctgaggtttagggtatgattgatcctgtcactcaggtagtaagcatagtgcccagtagataattttttcaactcttgccccattccctccctctccctctaatagtgccctgtgtctaccgttgtcatctttatgtccataggtacccaatgtttagcttccacttatgagtgggaacatacggtatttggttcactgttgctgcatttattcacttaggataatggcatccagctgtatcaatgttgctgcaaaaaacatgatttcattcattttcatggctgtgtagtaatccatgatatatatgcaccagattttctttaccaaagatactcttgatgggcacctaggttgcttccctgtctttgcaattgtgaatactgctgtgataaacatgccagttcatatgtctttttggtagaataatttattttcttttggatatatatcctttcctagcccagttttctaagtgtcagccagccctgcacgattacttgaagttctcaaagtggtgcaagcttcttgctttagagcatctatacagttgttgctcctggctgattcctgttgtcccttttataactaaataggctacttaccttttgttctttaagaccctcttcacgtatcacctcctcctccagggctctcttcatctctgaaggctttttaggagcctcccttcattttctttgaacattaatgataccacagtcctatctcaatctctcacacctgtctactctcccaagtttctgtaagaatcgactagttcctgtaattgacagctatatggtgttactattaattagtcccatttgattatatcatttcctgacagtcccaaacactctttggactgtggattttcaacatttgtatcagacagctggtcaggtctacctgctattttaccattgcttgcctgtaatttaatttatcttggcctcaattcctccatctgtaaaacaacaatgactattctactggtttatatggtgactaagtaagataatgcatatacaaaatacagcttaattaatgcctaatactagtaagagcttaattaatagtttctcttcttccccctccttcaaattattattattattattattatgctaggcacttaataaatacttgacacattgaattaattagctgagagctttttatatctaggaaccaaatttccacttctgctctccagccaacttgtggaaggtgaaaggaagatggtcagcatcaaaagattcctctttctagcacgtggcagagtattccacttttgccttgtaactgccattgaaggtgatatttcacctgataaagtcagttatgagatctcccatacagagtaatgaaaaagcctgtaacagctagtgatctgcctcccctgctgttgcctccaccgaataattttgccataaaaaataaaggggacatctccttttagtgaattatgacaaattttaactgacttatccctcttggaacttaggagtgtcctactttctcctccaatgacactcccactgagctgacatgtgacacatcctgggaatgcattagaactaaagagaaagttaagactgtgacacatccgttggccctttttttttttttgctaaaggaggaacatccctcctcccttgtctcctcagtccatagctctctgttctcaggatctttttaattctactggccgggaagacatttataggcaaaagcccctgtagagcaacatatccccctctctatcatatatacttctcaaatacctactacatgccagacactgtggctctggggacacactgatcagcaaacaaagcccctgcccttatatgattatagtggggcatgacataaagcaaatgtgttcctaaaaaattccaagttgaacaaatgacattcataccatactttgcgtatggtgcaaaccatatgtaccaataatacatgacatctaaggctgaattttaaaaataagtattcttgttagaggccagtcatcccttagcaactgactatttcagctctggctacagggaaggtgataatgagtaacacatattgaatacttaatatgtaccagatattctgctatctttttcaggtatttttacttgattatcacacatctaaattccccatgtggttatatgcttatcgttatacccattttgtagatgaggaaacagagcagttaaacaatttgctcagccatattgttagtaagtggccttgaaccctggcaatagagcacacgtgcacagacagagagattatgacacattgtctccaaaggtgcttcagaaaatcctaaggagggagtgaatgagtgaggatcatgaatgtgaaaatcaaatctacccacgcaacaaaggaccactaaattgccaaaatgctcaagagcatgatttactgtattcttcatttctgtgtaaataatgaaaataaatctctcggctcccaagaggagcacatctgtaatagttcctgctgaagatgttaaagatgtgtttatggaatttgcagaatcacttccttcaaagttcaatggtctataagttgctagtgttattgttgttaaaagaaactgaacgcttagtactttctgcttcaatctcaggttgagatttgtaaggaaaaccagatatcagaccagctcctatggaaactactctgtccaatcaaaagatatcctctttccatgaaactaacttaactacctcacaggatattcgaagcacaatacataatgtgaagggggaaaaccttactttccttctcctgttctagtacgctttaccagatgctcctgtggccaaaccctaattgttcacttcaaaacaaaaactacttaagcttctggaatgtaacacatctctaccaggttaaccattaagagacggagaggcagaggcagaggggaaacaggagctcctctcagacatcaggaagacaaatgcgaattgtccctacaaaagaaaaaagatcaccacctacgtgtttctctatcttctctcacttttctctgtttccttgtcatccctctttctgcccaggtaaagtggtggtggagaaggagaggaattccagctaaacagtgcgttggtatgaaccgtaggctagtgagccatgtgcatgctccagggacagggaaactgaagagagtgcactataggacaccaaatgcagatataatcaaggcttctttctacatgccgcaacatagtcaatttgaaaataagcatatccagaatggtaaagcacttgcgcagtaattcagccatgctccttctaagtatgaaaatctgaatatcaaagcacggtaaggagggaagcaggtgaaaaacaataataaaaacagtgagtcagcattttttgaagctatcagaagctcaacagagctgaatctattatgggataagaatggaaagatacaggtggaagaattgacatacagcagcaatatcttaaattaactccttgctattgaacacatgagaaactatagtgaaaagtctcagtgactgattggtttttatgcctagaagagaaagcaaattttgaaagtcctggccctttgcatttaggtccataattagacaattagagctcatgtactacaacaaagctctcaaacaatcatgaaacacagccacactcattttaaaagaagattcttaagagttaaagaagaccttttaaaaaatacattgctttcacatttcttccaagtagcatagaaatcagggaggaagaggaaaaggaggttttctatccatcagaggaacaggaatggattttggcatgcttggctaagcattctccccatgatttatggtctgaggtgtcacttacatggatgggatggggtgggagtggaaaaactgataacatgatctgataaacacctgtatcaaaagcacctgaattgcttgcaaaaatgtgtatttctcactgaattctgaaatactgaatctcagcagaaaactcaaagaatcttctaacaagctcctcagtgattggcaggagctttgagagaggcaagggctgagtaggtaggtggggaggtttgaggctgttgggcaaaacagggttgcatccctttccttagacaacaaacagggctgcaggatttaataaaattccacaatacttccagtgttaacaatggtgtatgctgggattaatcccacatgaaataatcacaaaatgataccagttagtatgatgcactgctatcctaccacagccgtgcaaattttaaggacagtcttttttggataaggtcccaccagtagataaactccacaaagtctggccaccagggagggtcaattaccaggactacattgtttctctagttcagatgtgcagaatataagggcagtgtgaagttcagcattacaaaaacagaaagcaatttagtaattagtgaaagtattacatggacaaaacaatagctgggagatttgtttaaaggaataaactaataactttgttcataccaacccatttcaaatatgggaaaataatttttaaacatttaaataaaactagaattaacgaaataccttggatacactggctagacaaaagattcctggtcctgactaacttgagaatttcggcaaataagtcagttaattacaaggagccccgtatgctgaatgcagttgcccaggaaatttgcttaggtcttgcttagtcaaatttgagagacagctcaactaccatacccatggggaaaattgtggacattcttggagtatatgccttaaataccatagttgaaaatgccttaggttgtgcagtggtagatgttttttaatgtactaatttaattgatttatacaataatatatctttattattgcacttagcaccttatattgcaattaataagttgtatattttctcccccttattgtctataaggtataaatttgactacaattgaattcattaattttaaaatctaaaaatgcccagtattttgtgtgatattatatatatcttttgtaaatgcttaccaaatcaatccgtccttctagatttttatttggtgaaaggaacttgtatcagacagtgaacactaatgtagtgaatcctagatttccgacagtgtgctaagggactgaggatgcaaatatgaatagaaaacagttcctgtccttgagaaggtcatagtcaagttgacctggaaatctctgtaagtattataatgcaatggtaaatacatttgctaaacaatagttctttaaagtacctaatttgctgaatacattcatatttccacatgttgagtttgttcaaattcacctaggcaatttatgttaccaatgcattttaatcctgggttatatagctaataaaaataaggacattattaattattttttaaattacattttaatatttaagtaatcctaattaagggcattaaacatgtaattaatgtttgtttcattataaacttgtctaagcatatagctgtacgctaaaaacaaatacaaattcagatttaccactgtgaatgctaaactttatcaaatagtacaactctggccgataatttatcatattctgcatttgttgatataaagacaaactgcaaaaacactaagtgtatttctaattataaataggatttctactcaggcctagggacagtgagtttttataaatgtgcaaccaaccccttttcccatgagtctgactgcagttctttctccatggctgataccaaggaagaaatgttgagactactctttgggattctctgcagtgtatttgctaaccatgtggaagaagtatgtgggatattttaatgaaaagggcagtaaagttagggataaagagacacaccttggtcaaaccaggtaataactaatatgactttagaaaagaaagcaacttgctctattgtgcaggctggagcgcagtggcatgatcacgactcactggagcctccatcacctgagctctagccatctttaaacctcaacctcctgagtagctaggactacaggtgtgcaccctgatgatttttttttttttaattttagtagagatgaggtctcactatgttgcagaggctggtcctgaactcctgagctcaagtgatctgcccatgtcggcctcccaaagcgctgggattataggctaattagggtttctatttcttttcttacaaaaggaaaacatttgactaggaagtctctcaagtcatttcttgctttaagtctatgattcagtggtcagcagtaatctcagagaagatgctatgtggaagggatagctggttgcagctgggtcaccgaaaatcaccacgaagttcatacccttagtaaaattattttacatattgatagctcacaactccctcaacctcacactctacatccactccccccatcaatttccatacatgcttttgggttatggagtatcagcaggcagtgacaaccaccacgaacaacaacaacaacaacaacacacacacacacacacacatacacacacacactctgaacttgaaaacgaaaacttcttgggattttcagggcatggtctcagctacccagcttcctgggaaataaagaaagtagcaagtgttaacacctcatttttacctatcaacagttacagaaaaacatgtaaattgttccttatacatcaatgtatgagtttttgacaatgctgggggataaagctattatttctgggttctgcttaagacacgctcctttgtcctccctaccactcagatatctatagttcatacagtaccaaaaacacctctttccacctagagggctcttaaaacctgcagttaagcaagagcaagccaaaacaagtctatagcatcacagatgggttatccaactcaatcacagacattcccctaatctccagcaaagaaacctgctgtctctctaatgcactaacatcatttccctagggcaaggtctgatttctctgagtatattattcatagaaatattatacattttgataaatgtaaatagaggataaactcagtcaaaaacaattcacaggttagaggaggtttaaaagagatgggagcgagaaatcactttttcctgtatttgttttcccaaggtttctcacccctctgcagaatgagattctaggtttagagacattaggaaaccagtaaccacgggacccgttgcctggaaacggcctgattacaacgaactcactaggctacaaggaaattctacctgatcctttaggaccatttgccaagcctcattatgatgataaagaaaatttatactttcataaagccttcaaaaattattgccatgaggttctgaaaaatctgagcatctgctttggggaagaaatgggaaattaacatgaccatctagtgtcaaaaactgacagcctagacaaaataaagaaaaattcgttcagcatcaggcgtagaattcagaaatcaaaaatccaaattcaatgctgaacaaataatgtttgggaattgtactgtctgccatgggggtgagaagccaaggcagccggaaaatcactaataaggggcatttgtattctgcagcagtagaacttcacttgtgcttccctgtacatctaagaagaactttcaatccaatgctgccattaacagctgctttgaaacatacgccatttggttttgttgcccttgacaggtgaacaagatttgtcagggaaataacattataataatattgcagaagtttaacaaattctaagaatgtctataaatgtttaagacaattagtaatcactctgagaaaacagagtctattttacactttagtgaaagaaatttttatagctaaatgactgtaggtatatatatttgtgtgtatatttgtacacgtacataattttatattttatatatatatatatgatagatgatagatagattttttcccctttcaagaacaacaggagttaccaaatgcatcagtgaattctggctccattaaaagttttcgttgttgttgttaatgatctacttacagttacattggactaaggtgcgtctcacagggagctcaaatgtgactttggacccatcttaatatggactttgccattaattaggtctatgattaatttttagatcatttatcataatttgctggagcataaaatgcaaatttcagtgaaatctaaccataattgcttacaattaaattttttatatctattgtaggaaataaattcagcatattcttttaaattttttattactatttttcaaacacttttttgaggcatgattcatgagtccattcttcatagataaatgctcaacattccagggccacagggattaatagagactggtagagagagagtaaagtaattagcttaaattttgccatagatgctatgggaagcaagccattttcactttaaagggactatttttccatacttcagatattcaatacatatccacagtactctcaaatatgattccagggtaaaatgtaaggcctctaagccctaggtttcaaggaatgtatcttaattacgtttgaaccctcagtacttatttcaggcctagcacacagtggatactcccaaatctctgctgaactgaaccaggccatagtatcatcagaggaagtgatattctactttagagctaactgagacagacagggaaataaaaaacggactgcagattgtactgaagagagtgcctggaaggatgatggtcatagattacatggagaaacaactaatgtcagaacaagaaatcttatgatcatcatttgacctctaccacccattccccatgccagtcactctatatattaccgtcaggattattctcccaaaacgcaaaatcataacactattcaactgcttgagaacttacaataaaaaaaaataaattattcattgcaattatctttgtcttcaagcaacttaacaatttggttgcctagatagaaataacacatgatactttttataaaataggaattgagagaaaagtcaggacagtgtgagctaaactgtcagtagaagctgcctaatgaaggagggactggaaccaggtctatttatttgaaagaataaatagtagaggaggaccattccaggacaggtaagaaacaagcaaaaacacagaggtgagaatttgaatagtacattagaatagatacaaagatacatttggagatgggttgcgggtaagaataccagttttggctggaatcttggaagtctgaggcattttccgtgaaggaagtatttaaaaggatgctacgagtttccaggaatattcatgaagtgctactggtgaaatagatagcatttgtgatgaacctagggacacactgattcattcatttggtaagtgtttttggaacacctgctatgtcctaaccactagagataaagcagtagacagaattcctgccctaataaaacttatcaggggtgagagtacacaaatgataacaaaacagataagttagtatataataaaaggtcaagtgccatagcaggtaagggtctaaagaatgggagaatgtattctaaaatattaaaactttaccgtctcccaaaatatctagtacagacatgggcatgcaatagaaataccaggtgactggagtactgcctgctgaatacaagtcctggggttatgggatacagattttctcctaataaaacctgaaacaatcaatcagaactctatgaggtctccgatgtgcttgcctaacacataaaaatgcctgggcgcaacccaacctcacctaaaatgggaggatatctgggataggctcctgcagcatacaaagttggatatattgcagggttttcgaaattctttccacattatctaggatgagctgctgataataaacaaaaagttttcattaaatatttgttagataatatgcctatgactgctaggtgctataaagattaaaataataaaagatggtcatggcattgcctttcttaaaaaaaaatcaaacataaaagtaaacttaaaagtcaggaaaagataagtacagtaatgacatcaaaatgagcttggttttacaaaaaaaaaattgtacaaaggagttcaggagctcctgtgatatatgaaacttgaaaaaaggaaggccacttatataaatgcttgtgttttcttgagtctttgagatatttaaattctatgggagcaagcattatgaatgtgattttcaaattacaacacctaatttgttctgacccatccttggtcactggttgaattttttatatctcaaatgccatcctcaaatatgggccaatgtccacacagaggtaactttccatgtaaaaaattggcaggaacaagtgagaaagggaggtgcttacactgccctttctgtaggacgtatttgcactgactgagttaatgtttatgggctgtagatattcattgagacatagtatggggtggctaaactcaatgccctacaaagagaaacaaaaggaggagcctcgtccatcatattgccaataaagagcagtaaaattacttgacaatataaagataatactttgctttcccactgtgcttggttcttgctaaaatgttattaatgaaaggaactattagatcccagtaacaagctgtcatacaactactttacctacctaatttcctttcccactcacccataatatttcctgtttctatacagcagtcatttggactctacaatatttcaatctgtctcatctccattattggtagcactactccccaatccacactcctgctctgtgcaaaactcctgtctcctcattaattctatttattcaactccttcaacctttgtccagagggtctcttttcagatcagacattctgttttgtttgttaatttatagcttttgacatttattattatcttccaatgagacacagaaagaatataagaagttaaatgttttcacaagcaaccctagattcctgtgtccctttgcgggggaggaaaatagaaagaaataaaagctgccagatagaaggcctgaaataaatgacctgcaccacccataggcaaattctacctctttgtaaagaatgtttcataggagggaatcaataagagctgaatatgaaacattggtgcagtgcactagctaagttcagtgaactcccaagctaatcctgtgttctcagaagctataagcgccaatctcttcacctttgctcagggggatgagctcaccacagaaactggcctgttttttgacctcaaaatccagttgggacagggttgggggatggcagaagcaatgaaagggaaggtttccaggccatttgttctaaactgaggtgtgctggcagaagcgaaggacaaggttgagtctccatggccctgagctgggtcacacagctggaatcacactttgctcaacacaaacgtctttcactttttcattcacccacaagcaacacaaggactgcaacagaacactgatgagaagaaacaggcccagcgccactggtcactgtcagtatctaggctacctagtaaagcaacccccacacgacccggatgctaaataaacgtttacatcagctcatgtttccctatgactagctgatcagtatatcgaattgaaatataataaacaccaaaaggaatgctggcaggaggctcagtattttcagtttttgtacaggttttttgaaaatcacatcacatttgttccctttaatgatactgttgtcttacagaaaaatactcattcacgtattaaaatttcatcaccatatctaaagcgacattcctttttaaaacaacaacaacaaaaactaaaccaaacttactaaaaagccccaaatgtctacactgaagcaactcaaatgaaatggtctaatcataaaattaaacacattacagatgagttgatttgagggcatttagtacatttgagtatactcgatatttcagtttctttaacctacattccctaaaagtaacactaaacagtggttctgtgtatatgacacagtaaaaatgcatatatttatttctgaggctgtatattagctgattgtgaatcacccttgaaagtatgttttataaaataatgttcatgcaaattctactaaatgtatggtatactttatacaaatattaaatatgaagggaactggtatataaataatcaattgactagactatgcatttaatatgtatttcatgacataatattagcttttataggaatcactacttgaaaaagcagaccattaaactgaatttgagtttcaatgactcaagttctagttccttttaaatgtgtctggacaatctggttgtatcacttgcttctcatccataaattttttcttaccatttatgaaatgcttgttatgataaaaattattataccacatatacatttctattcccatcccaatcaccaatcgaatttctaaactatatccctatgatctaaaataaaccaattaaacaataacaaacaaaactttatgcatctacttattcatactgattacatatattatttttcttgccttgtctttaccactagtatattaattcttaagcccaagaactttgcattcctactgctctactccatcctttgctttaagcacaaattagaaagaatgtaaaccaacactataatttgtctcatgatagctccaagatggtctgatttactgtgtggtaagaatatctcctatcctgcatttcaatctccatccaggccttcaaataatactgtctatcagttaatatacagcattcccagttgaatatgattctctaacagtagcagacagaattgttctctcggtatcctgtggggcctaagaggacagtcaaaatctcagcaacactgtattttccttgcttctgtgccattctaacaatttcttcccctgggaaagcctcatcttttccttagatttgtgtttctggactcactgatgaatttagattctattcaaatgtgctcgcactgctatgttctattatgatctggaaaataactattattgttagcaagcaaatgttagagtttttattccactaacacatgctttgagaatccctaagttcctgtttatgactttgcagataacaaacaaaactataaagagtgtaactacttattgggcctttaaagacacgagagataatttattagaggacacgctcagtgttctgtccaggtggttgctatcaattacaaacagaagtcttcccaaatattcacttaatgaataaattgaaaggaagatcaaaatgtttttcatccacagaaagacctttgccacagcattgatatgctggtacttttgtcttaacattttggtctcttataatctcttgtttaaaagtcaacttttttatgtaaatgtctctcagtttatccagggtgattcttttctgttggaatgagaagcattatctctaagcatgcatttatgtgttgtttaattgggtgtggtgtggttgttggctctgtgataagaaagcgtcacagtctccgacctctagatgcttaaaatctaagatgaagtaaatatcccaatatattactgtggacccaaagcataatgggccatttaaaatcattctatgaacaaatcgactgtcattttgacagtactgagaacaacatatatcccttcacatttcagcttgtgttggatcattaggcacaagtttgaacaattccagggaaaacttacaaacacattttgaaataaaatttggatgtaaaatatcaagacttaacagaaacattttacagaatgatttacttcacaaaattatgtggtccgtacttctttcaaataacatattttctgctggatttaagtaagcttaattgacatgttatcatttatatagaaaattaacatgtccctgatttgtcaggtacaacaagaatgtacaaaggaagggccacatatactgcaggaattttaagctattctcttatcttttatttcagagcattcataatttttaaatgttgcaataaccttttgaggcaatactggtgacttcttcatttgactaaaacatccttgcatatcaacaattgaacaattgaaacactttaacaaaatctaatgtgtatatatataatattatatgtattatatatgaaaagtatgcatgtcataccatacatatagtgagatatatatatatatatacacatacacacacacacacacacacacatacatacttatgccatcagagaacatttcatttagattagtatgaaaattcaaaaaggagttaagtctcatttttatggagctacacccacaaatcccccaggctacacttagttaaaactctgaaagaaattttattctgagattgagctcctgccacatcacactgtcaatatccaatattctgaagctacaagggccagtgcccaccgatcctagtcccatttaaggaaatgcaatgcaatctaatgccagttctcaaagcacgtaagtacatgctgaaatcaaagatttaagtgaccatttattttgtcttgtatctgcctgagaaaaccctttgccagccaattttctcctattagaattagctttcaaagttagaatgtcatttgcatgcttgcagacaaagctaacaatttcaaatcatgaaaatgtgtattctcagatggtgaatatttgcttttttaagtacagagagtagaaaccgagctagtcttactagattttatatattgcttaaattaacggccaaaaaaagcctccaaggggtaaattgcctttttgtaatattacctttaatttcttttagcaaatgggatatgaggtttaagtgggttgaagaaaatcaagtaaaatatttatggtatacaattttctatggtcatatgcctaaaagcaaacattttgtggttagtttactatgaatgtaccagggctagcaagggagtcttttgcaagacagttgatttttagaaacgcttacaggttgaaactacaagctcctaataacatttaacaatcagaattgctttggagaccagcctatgttggctaacgctggctacttaggctctgcaaagtttttgtaactattttggcaaccaagtaccataaaaccaagcattccattttacatccaatgtgtctgtgctggcattaagtaataccaggagagtattttaaaggttcaaggtcaaatacttgatattccattgagtaaaatataaaagaaaatactgcacatcatctaaatatcctaaaaggctaagttctaaccagtataagtccacaagggacagaaaagtagcatgatgaaataaaaaagaacactggactgagaattaggccttgggcaaatcaaatccattctgagtctagcttctccacttcttcaaagagggtaataatactggcttcactgacctctttggataaaagcctgcatgtagaaatgcttaaaaatgtagacaatttaatacaaatattagataatactatcatttccatttctcctgataatcatgcagcaggtctctgaacaagacctgtgtactgtgttattcataacataacttgagaagaggtggtagtttttacacacctcctcccccccttttttctttacacttgatcagcttcagagatacagtcagttactaaactcctcagacacttttagcagcatcagaagcagctgccacttgcaaacctgtcagattccacagggactaaggatgtaaaaacaatgagtcattacaggtgtgtctgcctttttcattaaaagacaaaatgaaaagaagatgaaattcacccaactcagtgtttttaaggcagaaagtaaagagatcaaccaggaaatactttattcctttaattcatatgacagacattcaaatataacatagtaattgtttttaaatagactgttactgtgctgggtgctcccccagactacgaaaaagagtgctatctaacttcaaggaacacactgttcgagaataacaatatggggcataatggtagcatacaattaattctaattccaggtagaaccttggtgagacaagaggtagtaagaaggccactggaatgaacaaaaggaaggtggcaggatccttaaaaggtttaatgaaagagacagagatgacatttgagataattttgaatgattcctgggatcctggtaggagaaatatcaatgaagacagaaactagaaagagggatatgttcaaaattgagaagtctaagttgtttcaagaatatcctgctacagtttccctgtctacccaaatgtgcatatgtttgtgcaagctgctgatgttcgtttgttacaaaggtgacatgaataacctaaatttataaaacatctttaaaactggcaaataatacagaatctctatggattacaaataaaacatttactatacatgtaatcatgttttagaaattaaaaataaattaaaatatgcaaaacaaagattacatataatcccaccacccagggctattttgatttatgccttgccaagactatgtctctgtacctatatacatctacattttttttcttcttcttttaattatactttaagttctgggatacatgtgcagaacatgcaggtgtgttacctaggcatacttgtgccacagtggtttgctgcacccattaccctgtcatctatattaggtatttctcctaatggtatccctcccctagcacccctcaccctgacaggttctagtgtgtgatgttcccctccctgtgtccatgtgttctcactgtgcaactcccacttatgagaacatgaagtgtctggttttctgttcatgtgttagtttgctgagaatgatggtttttcagtttaatccatgtccctgcaaaatacatgaactcatcttttttatggctgcatagtattccatggtatatatgtgccacattttctttatccagtctaccactgatgggcatttgggttggttacaagtctttgccattgtgaacagtgcagcaataaaaatatgtgtggcagggcgtggtggctcacgcctgtaatcctagcactttgggaggccaaggcgggtggatcaccaggtcaggagaccgagaccatcctggttaacatggtgaaaccccatctctactaaaaatacaaaaaattagctgggcgtggtggcgggtgcctgtagtcccagctacttgggaggctgaggcaggagaatggcgtgaacctgggaggtggagcttgcagtgagctgagatcgcgccactgcactccagcctgggtgacagagccggactccgtcgcaaaaataaaataaaataaaataaaacaaaacaaaataaaataaaataaaataaaataaacatgtgtgcatatgtctttacagtagaatgatttataaacccttgggtatatacccagtaatgggattgctggatcaaatggtatttctgattctagatccctgaggaaccaccacactgtcttccacaatgtttaaaataatttacactcccaccaacagtgtaaaagtgttcctatttctccacatcctctccagcatctgttgtttcctgactttttaatgatctccattctaactggcgtgagatggtatctcattgtggttttgatttgtatttctctaatgaccagcgatgattagctttttttcatatgtttgttggccatataaatgtcttcttttgataagtgtccgtttatatcctacacccacttttcttgtaaatttgtttaagttccttgtagattctaggtattagccctttgtcagatggatagacggcaaaaattttctcctttctatacagattgctttgtaatgtggttttttcacttactagtatgtttgaataacttttcatgacattaaatatacaaaatacaacataaaatttacaatataattttaatggttccctgatgtactattgtatatgttgcccatcagtttattttatgagtctatattatttcttatccagtttacctttattttcttgtataaacaataatggcatggtcatccttttaaattaatcattatttcagctctgaatatttatttaattctaggattccagttactgggctcttctaaactgtcttccaaagagttatactgattttcattcttcactaatgggttagccttggtctactcatgttctttttaatgttgaatatttaagttctaatttttcttactactaatatttgaaaatatttttctttgaatattaattatgttgaacatttaaaaatttgtttattaaccacttttttatatgatatgaaatgactaatctccattaaaatgttacaagtctgttttgtgtgttttgttcatctttgcttttccggtaaccatcctctgggtatctttctcttaattaattgtaacctcctatgcatactacactaggacacattcttaggtttaggtgtttatccacacttagtgccatagactataaagggtctgagattttatactacttaaaaggtaacaagttaacctgctgcagttttatgaatgctagcacaaaattccagaatcctaggccagagatgaagttcattacttgtagcaaaagcagcagccagagtatcagcaattttttgtgctggttccataaacctcattttcctcaaggaaatgcaaagacagccatttggtaactgcacttacactgggttgtgttataagagaactctgagctcagagaacccaaatattttataatgggcagtaaatctgactgccctttgcttcagagagaaacattatatttattatactgaagaatatatgcatggagggaaaccctatatctgtgttccaaggccattcaggatacaaacattccttgaaatgaaagtctggggaaaaaaaaaaaaggacgtcaatgtcttgccaggcaaacatgcagaaatgcaaatgacacataggaaattatctccaagcgcttagccctgaacatgtagaagagaataaaagattttgtgaaggaaggaaggagagtgattcaaaggcattcagcactcaaacttggttccaaacttagccttacctgtgaaacctcacgacaacagtaacacaccagccaaataaaaacgtagcttctggtcaagctgatttctaaaaaccagactttctaaagaggttatataaatagtgacttttcactttataaagcaattctctacagaatctttaaatatcaagttattctggtatgattggaaagtaaattcatctaaaaatatttatgcctttttattcagcatattagttaatagagtatgctcaggatgaaactgcctcaattcggatctggctctgtgtgctggttgagttattcagcatgcttcagttccctctgctgtaaactggggatactgatggctattaactccatcctcacagaactagtaaaaggtgcttttgtcactgcatgatacataggaaacattcaacaaatgttagttgttattaattgtattactatcaccgaaaaataagtcattcagttgatatattttcttctgctcttttcctctatgtttacaattaactacaaaatgttttcttttcttgaatgacagggtagatgctaaacaaaagatttaccaaaatctaactctaataataaatgggttaaggtttcactcaaattataggttatttccaaaattaggagaagggaaaatatttttttaaaaaaaggatgatacactttgggaggccgaggaaggcggatcacttgaggtcaggagtttgagaccatcctggccaacctggtgaaatcccatctctactaaaaatacaaaaaattagccaggtgtggtggctcatgcttgtagtcccagctactcgggaggctgaggcaggagaatcacttgaacctgggaaaaggggttgcagtgagccgagatcatgccactgcactccagcctgggtgacacaacgagactctgtctcaaacaaacaaacaaacaaacagcaaaagaaaaggatgatgaattcctaaagctggattgtagcacctgcgataacttctttatttctatacttttgtatagtgtgctaacaaagaacccaaaaataagaaaaaagaaaaaagttgtataacatttaaaggtctgtaacatactattcacttaacacaaacaacctatgaagctcagggatagagtattcaaatatttgtggggggcagcagagggctgcatggcattcctctccagaatgtaatcattatttctgggttatggctggttctaaacctaacagtagtgactcatccttttccagagattctgaagtagatggaaaatgcatacttgaagaaaaggtggtgaacaaagagagagaaagactaataaatggtggctctattgcaaaggcaaagctgttgaacaaagtgggggaaatgagagaactctgtgcaaactaactcatagcattttttaaagcttcattatgtttctgagacttgcgctctgataatgtgtaaagaaccattttttcccctttcaccaccgccccattctgttatctgttacgtctatttcatatttgagacagatgaattttggaaaagttatgtaatttggtcaagatcatgcatgtagtaaacaatacatttaggattgaattctagtttaaaaaatcagtttttgtgttattttcactgtagtaatatagcatcagctgaacttgaattccagccaagtgcttgttctcctaaagcctacatcgcaatctactgaaataattcttggccaacccaagcatcaaataaagaataacctcaccttctggtgctcagccagcatggggattctgttaaattgtgggtgtagctgatattcttggttacctggggatccttctgctaattttggaacatatttggcttttcttaagctctcggtctgtgactttttaaactattcagctgtatcctggctatgtccatgtcctcagagaataaaacaaaatcatagatcagggtattctttttattttgtcctggacactctcattccccagataaatcacaggcacagtcataaatctatggaaaagaacagtacaatttccactggaaaggcattctctatcttttccacattgtatccactattcacagtgaattgctactaagaacatttttctctctagtactctagctacataaaacacttggtaatatacatactagtttattgttcttcacaggcaaacatagtgctacttttccaagtgtgggaataactcattctgaaccactggtcccccaaaggcatatccatatcccttaccttggctttgacaggaattataggagtaatgtaactattatttggtaagaaagctgatagtaaaccgtgtcttctccttattcctgaccctgcgcttatactttgcctagcctcatatttaaagaataccttccacttttctcaaagctacaagtaacaaatattcaacacttcacagagtcaggtccagcaatcttctgctgaggtctaaaaccttgcaaaattctggaaaatggtatccaggtaatattgtggttttgttagttaaaagtatatctgagtatatgtgtgaatgtgtatgggtgggtatgtatgtgtgagacagattggaagtttcttcaataaatatattactttgagtaatatcaggaattgtgctaggcactagggttataaaatatatcataaatgaatcgagtccttaaggaactttgcttgttacacttttatcaaagggtcagatggagaaaaaatgcttttactatgccatcctgagtactcggatataaatgtgcacagggtcctgtgggagcagagagaagggtgatttggtttccagggacaagttgtcttgaaggagatggcagtagaagcaatgaatgcataggagtgaccctggagaagaagaatgtggaggatgttgcaggtagaggaaaagaaaagcatgaaaaaacatggtgagtatgaaaaaacatgaaaattcattattattaattaaagtttgggaagggagtggtagagttaaggctcgacagatattatgatgaagacattatgtaagaccatatggacataatcggaagcttaaaatttaacctgtaggtaatgaggaatcatcaaaaggctttatggctaagtgtggcaaaacagtttgccattgaggcaagctggtcaaggatgaaatggggttaagatcctaggcagggaacaaattagggagctaatgaaagagacagtttccagaagatatgatgaggacctggacaagggtgatggtaatagtgaggacaggaagatccatagtgggggcactgtatacacaatgagatcctctctccaggggcgtctgaaagggatatccatgtgagggttatagatacgaattggaataaactgtatcctccccaaaactcacttattgaagccctaactcccaatgtgactgtttttggagactgggactttaaagttgtaattagagttaaatgaggttataattatgacaccctaatcccacagaatgtgcctttccaagaagaggaagagacactggagctttctctctctgaggacatacagagaaaagaccatgtgaggacacagtgagaaggtggacatcagtaagccaggaaaagcggcctagccagaaactgaccatgctggtacctcgatcgtggattccaccctctagaactctgagaaaatacactttttttttttttttttttttttgagacggagtctcattctgtcgcccccgctggagtgcagtggcacaatctcagctcactgcaagctccgtctcccaagttcacgccattctcctgcctcagcctcccgagtagctgggactacaggcacctgccaccacgcctgggtaattttttgtattttcagtagagacggggtttcaccctgttagccagaatggtcttgattccctgacctcatggtccgcccgccttggcctcccaaagtgctgggattacaggcatgagccaccgtgcccagccccacacttctgtattttaagccactcagttggtgatactttgttatggcagacccggctgactaatacagagggttttgttgatagaagtaaaccctaaaaaacacataaagagaagcaaaagcactgagagaaagtctgaagaagcagaaagccaggagcagacaggtgagtagagcaggagcttctgcttggtagttttgcaggatgaagcagaagtcacgtgggttccctgtagaagggagttctaaagcatgtaatgatggatttctgtttctgaggaggctattctagagttgtgattggatcagccaaactgttgtccaactactattatatcctgaatctattttcattcctgaagtctgtgtggtagccaagtttgtttcttgtttgccttgcttgccaatgtggtataacagccacgcccccaccctcctctggcatcaactggaataggccttttcacttgcactctaaaactgccaaacatcaagagtgggaggaagagatgtcaggatgagcagaatgcaaataatgactgcagactccagaaatcttgggatgagatgttaactatccaagattttatttaaaaaatatgaactgtaatacatatataaaatatgaatattttagccatccacattataataccagaaaacctcttgtgcacataatgagggccatctatgtacgacaggaagtgtggcatgatgccgtctctaaatgaagaggggctctttttaaaaaggcaccaaaaaatctgtttttattcctctttatagcaaattggcttagtttaaatgccagtctataaaaggcttcatccacactctcagtacctaccagttgtgaagaaaagaatgaaggaaaccactgcgtgcactttttttctcagcacctgccaacacagggcttgggttttcggacggaatttcataaatggaacaaatgaagactaatgatcctttctttatctctaagccattatagcgccatcaagtggaagacaagattataggatttagacagtccttgcagaggaactggtaagtagattattcttctacctgcttaaggatagtttcaattttgatccgagacacatctgtgtgtgtctgtgtgtgacacagagagaaaccgtgtggcagttcctcccttttgtcttctacattaatgcattccacctgtgcttttaacatccagatgctatcatattttaattatactgattaatgcccgcataagaattacaaatggtaaaccaaccttccctcaaattagcttagtcaatctgtttaaaggcagcacagtgaaatagaacaccaagctaataacatataaaaaaatggaaaattcttcatttgtttctgtttgagttcttttaattaaaggtgacaaaacagccctttactatcagtgcagcaaatgcaatatgcaaagatgaatgcatttacagctgtagcttgcattgctgttttagcattactaacactgttgggaaaacatctgtgaaaaataagatgacagggaattctcatgataaaactggaaagagatgtcaaaagaaatattgccatctccatctttggagagcttcgtgaagaggatcattgtgtgctctagttgctctgaccggagattccaactctaccctgaaatatcttacagcatctttaaatatctctctgatgggtctctggcaaaacaaaacaaaacaagaaaacaggcagggcgctgtggctcatgcctgtaatcccaacactttgggaggccgaggtgagtggatcacctgatgtcaggagttcgagaccagccttgactatgtggtgaaacccccatctctactaaaaatacaataaattagccaagcatgttggcgggcgcctgtaatcccagctattcgggatggtgggacaggagaatcgcttgaacccaggaggtagaggttgcagtgagccgagatcacaccattgaagcctgggcaacaagaccgaaactccatctaaaaaaagacaaaaaacaaaacaaaacaacaacaacaacaacaacaacaaaaacaagaaaacagaaaatcctttaacctaagttaccaagtaatttaaggtgaaataattttctccttggccacttcttgaagaaaagaaatatgaaacatgtattaaaaaaaaaaaaaaatcagggctttataacaaccctgaaaagaccaggaaccatgagttagttgtttttcctgagtaaggacattgtgcagccgagaggtaaggactgcttttggcactggtgacctgccctgaggctttttcagtccatgattgccaattcttccatctaaaaatggagatctcaccacttctcagcatgtcataaggattaaatggcataatataaatgaaagcatcttgaaaatttttgtatattgacctattgtgagtctgcagagataaatatcccaaaatatttttgtgctccaaaatatgagaaggtaaatacggctttacaattccagttttctatcttgcctgctttattatcttcccctcgccaccttttttttttttgagacttgctctgtcgcccaggctggagtgtagtggcgcgatcttggctcactgtgagctccgcctcctgggttcacgccattctcctgcttctgcctcctgagcagctgggactacaggcacccgccaccatgcctggttaattttttttgtatttttagtagagatggggtttcaccatgttagccaagatggtctcaatctcctgacctcgtgatccgccgcctcggcctcctaaagtgctgggattacaggcatgagccaccgcgcccggcctccccactggttttaagcactttaccaagagctttctgttgagactgcatcaatgtcatgtaacaattccacacaaaacttgtttccatgagtctgacgcttctggacaaggacaaggtcatcagttttgggtgataacttctgtaatatcataagactattgtttctaaggtacctactagtggcaaatgtgtgcatgtgcgtgtgagagagagagacagagagagagagagagaaagagagagacagaaaccctttcgagaaggcctccttaaatcagggataaggttatttctgagaataagataaaaacctaaagataccagtgatggcaagcttaactgtgtgcctaatatgcaccagaactaaaccttagaaaacaaaactgaataaagcatatccctacctataaggagattacaatgtcaaagggtaaaatggataattaaacacagtaattatcacataagcactatgataagggtaaccgaggcattgagtgatcatggaaggtttctcaataaaggtgctacctcgtgtaactccttgatggatgacagggagatggaaaaacatgaggagtaggacagtaagaatgcaaggagcaggaaatggattgggggagaaaagggagaccaggaaaagggatggctaatgtaaggcccgtaggtccaaacaaaccaaaacaaaggcatattaaggaatttcatatattccagaatggccaaggattttaagtgtaattttacattgtgtatacattttcatatttctactatatgcatatagacagctacatctttatatacctactgcttggacccaaaacctgattcatggctgtcagttcttccacatataggcaacaagaaaagggcaaatacaacatgcctgcaatgctcaaacggcttccttctgttaaatgcaatcatgaaatgatacggcttaacataaactcattgaagcttcatctttcaagcacaatgtaaagattctagctctattcaatctcagctacagggcaatcacaactgtaactaactcctacgtctttcatcttttgacaatgaaattaaaatattgcttcatgctatagtaggaaagaacactctaaaataaataatcccaaagttgaaataaaactgaaaataacagcagtgtctttctgagacagtggggcagcaatgttaatgaacggaagctttgctacaaactgaacaaacacgcattgattttgaaggtatacggaaagacgactcagataagctatagacatcagaaatttaagaatcaaagccaaaatgagacaatttagacaaggggcataactatttttttttaaaggtgggggatatgcagagaaagtaaagatgaaagttagcattcacttgagatactcaattacagaaaagtcatggaaatcaaacatgcaagatgtttaatgcacagagtgagatgaagaaggatcatttttaaaccttaaattctccctgctcttagtttggataaagaggaattcctcaagtcctacgttttcaaaattatgtctcttaaagaattagtagctttgcaaatcaaagcaggattggctcttatcatctcagtttatctctgtcagtgctcctggtggtggtgacatgctggcctctcatatttctgtaagcctggccctttggattttcccacagtatcagcctaaaaggccaaggagttgtaaacctgcttttaactctccttattccctcccaccacacacacacacacacacacacacacaaacagggtctacctgtcccatggcttccgaattatgaaatgtgccccattcagttcttgcaactcttcccacttatccactctgttcatcctctctggggaatccaatcttgacccaaagagaccaagtaatctttaaaatcagaaactgctttaataactcattagagatagatgaccatctcttatatcacttgagtctttcctttcctcaggcatttctagattttgggtcaccaaaacaacccaacagccatccactcactcctctctacataaacataaataaaatcaaaaccaaaaataaaagcagccaggtgtggtggcaggtacctgtaaccccagctactcaggaggctgaggcaggagaattgcttgaacctgggagagagaggttgcagagatattatttctagagattactatattatcctctgagaaaacacacctgcttgtcctttggaagcaaaaccatagtgtaaaatgcaggttgagtattccttatctgaaattcttgggataagaagtgtttcaaatttttggtttttttggatttcagaatatttgcctatacataatgttcacatgggaaatctgggcatgagcagaaaagatatatcacaaatgaggatgactgggagggttttcttccccctaaagaatgctgaataaactgtgtattgtgtgcttgtattttgaccgcaactcatcacattaggtcaagtgtgggattttccacttttggcatcaagtgggtgctcaaatctttggattttggagcacttcagatttcagattttcagattagggatgctcaacctgtactagtagctgatttttaaggtttcctttgttggtaatttttatggaaagaagaaaatctcaacagatgaaataaacagcaactaaaagtggatttatgttgtttttttttttcagcaataagtaaatgcaatcaaaatgttttttttttttaaaaaaaaagactgtcaaaagtaacacatgtaactaagagtgaaatctttggagagttagactttatagctccaagtgaatgtaaatgctttactaacagtggaattggaaattggataagttcccttgagatagaaatagtcaaaatgctacaggagattccaaactgcttgctacaaaaaaaaaaaaaaaaaaatccttagctttgactataagtagatctctagttcttctccatacaggagatatgtggtcttccatcccagggagaataatggttaggtttctcaactctcataacagaatgtcaacatcaccatctgctcatctggctttcaaaggatgcatatgggctcatcttctcgcccagaatctcctcttgctttggggcttttcccttcagtttggtctttagtatgtactcctaagtttgccaaatgcacactggagatcacagaagactttgctgaagaacagcccagtaatgagttgaattcttatctattcagaggtttccgtgaaaaaattcctctgcagcgtattcaaattgtatagccgcaattatactccctggctgtggtaatttaaacgttattttaaaattaaggcctttgttaataaatactgtttgcttaaaggttaaaaggtagaattatacccttcacaccaaattgcagtctccatgggtccttatctgcttgtattaattcaaagagaagattctgggtgtcatctgccacttagagcctgaagtaaacctctaaaagcatacatttctgttgttgtttccattctacatgggcttaaagtatgctttagaaacatacatcacaactgagatgtgcgtgggcattatgaatagttaagcaggagtgcagaaagcaatatggacagaagaaacaaaataatttcctaacatataaataaattcaaaacctacttgaaatgtagtatatcggaagaacattagtcagggtctctataactaattagctttgcgactttgggtaagacataatctctctggatatttatgtaaagctagaattatgtacgagaaaactacagtttagaaggaaagaaagtaattacaaagtaaagacattgaacataaatcttgaattttaccattaattgaataatggaaagaaaatacagactatattattaacttttatttgtctattttctctataaaattttcaatccatgatttagagatcatgtccatcttgatcaccactttatctctggtgtctagtacagtgcagactgaccatttaatatattttgaaggaaagaccaaatgagttttaaacatattatctaatactataatactcttatggtctcattcttcagttatttgctaatataatagatgcatttgtatcctctgtaatataaaaataggaagggatggtattggttgtagttgaatatttaatgggagaaagttaagcctcaaataagaaatttcctgaaatattaccaatgagaaaatgggtataaaaccttccattttaccaaaaacagaactttttttttatcacaagagaagggtaaacggttaattaaaagcaaattagatgaaataagatgatacaaagaaggtatcccatttaatgaacatgttagatactttagagaatttatttaaatttctgaacaactctaaaaaataaatccaatattagttttaaataagaataaattaaaacatagaaaagttaagtgacttatccaaagtaacataagctgtaagcagaagaattgagatttgagcactgatattactggttctaatgtcagttctttttacagtatccatttcacattaattgatagtctaccaactaccagatgtttcactgagcactctttaggaaggaagggaaattaaatattggcattagttaacgagagacatttctttccaccgagtgtaagtaataggatgaagatacattttgagatgatatgatttatccagaagaaaaagcaaagtttgttagaggtctccaatctatgataaaagcattgtgtaaaatacaagaaaagtaaatttcttaagagtaatgttagatgaaagcccatcatagttaatggtataagtaaaactgcattaattgtcaatggtatgaaaatgttcagataaatcatgccaggataaaacagagggcttataaacaagtcttccagttgggtggtcatcaaaaatgtatgaatatccactgagttaaaactacttactctttggctttgccatcttcatgtttagtgaagggaagcagggcgatttttggtgtaacgttccgcttaaccttcactaaagggttaatcaagaaccattactctaaaaactcaaaacaattctgcaagcctttataatgcctagtttatcccttaattttattatcatgggaattaacagaaaatcctcccaatacaaaataaagtgtgttctttcaaagatatacagaaagaggcagctgaagagatgtttcttcctcacattagccttgggcagggtaaacagaagataaaaatccaaagggacatactgagtaagaatagccattgaatgataggaagaaaacctaaattccttggtcttgtggacaaaatagaaacaggaatgcaaaaagagcctggaacccccagaggaccctcagcatgagcagcagaattatccacaatgattctcatgcatttgtactttttttaatcagcaaaatttagcagcttatatttcaatgagagacagcaatgttttcactggggggcaattctgaaccacaggggacatttgacaatgtttgtagacatttttgtttgttacaagtggagtggtggttgctttgggtatctattaaaaataggtagaagcagggaagccgttaaacaccctaaaattcacaggacattccaccacagcaaagaattaactagcccagaatgccaatagttctgaggctgtgaaaccttggagtagaaggagaatcagcatcaaaccctttttcataggcatttttcaggtttctttgttacatccgactgaaacaggcttgactagcaaatttcaagagtgaccttgtttcaaggtgcatcatttgtcggcatcaaattcacatcctctttcttatttaaaatctaccattagttatttctccctcaaaaggcttctacaatttaacagtgaggacatgttatggctgtgaaatagatgtccctatcatactgctttagatgggaaaagaaacattctgcagtgtttataagtcataaagaattctaaatatctcccactcaacacattcaggcaaaatgatggtataatttctgtgctgggtagcactctttcataccattatgtgtcgtgtgaaccaactgtaggtaatgcactatcttcctttaatcaaatctgcattgtaatttctataaaaaaaatcaattaaacacaaggagcaattacttattttttatcacagcataatttactttcccagaacagcagcatgaaaatgtgaagaaagatctcatctacctcagtgtatttaaagtatgcatatttttaaataaatgcgaatggaacactgtcaaataagcaatatattatctctatataattccccatttacatcaactttatggatgggtaatatggcttaatagcaaaagcttaagatatctttttgaaacacaattttttcatagtcaatattatggctgaaaacatttttcagactcttacagtgaaaatataattagacaacaatttgctcatcaacctcatcaaatcactttcataaatgacctacttaggtgtcaaataaacctaaaagaactatattttttccaagccttacaaatccatccttgtttacatttccctacctatctctgtgcattactatcaaggaattttgttaactacatgcttagtagttagtaggagatcatggagctaatctagcatccttacatctgggacctgtagtcttttcagtgaaatctattttacactgagcatcaggagttttttaactttatgtagataagatttacctggagggtttggtaagtaggtttggagagcccccacatttacattttaacaaggtctcatgtgatgctgacgcttgacccataggtctggaaactacccaagaatttaaaagacccaattttcttcatgattcagtaatctgtatgtgctcttaaccactgtgtcagcggcatcagtttattttttctcccttacttttatgttatcaacctctgtgctcatcagttaaactaaaagatcaatccactccaacctggaagattgcattttctttccttcttttcttgcctcttcctgctcctccctttcctttctttctcctcctctttcttctctccctctttctctctctttcacccccttcctcactccccaattccctccctcccatataattctgtaactctgatctctttcaaatccagatgtaaatctcactttggctgtgaaatcatctctgatttaccccagttgatacacaattctcctccatgtggaactgctcagtacttatgaactcacttttattagacttgtttgtactccttgcttcattaattagtaaattaaagcctttgtgtatccctatggtgcatggtcttaattatattattatactatttgttacatgcattttttttttcctttttataacaatgcctgctggaatgattggctcacaatcagtgcataataaatattattagcccaataatgtactgagtcaggggctgcaaagcagtatttcatcacgcaatgacccaaggttcacaagaaatctaattagtgcttcaactaaagccaccagtcaagtctgggggaaactggctccaaatcacaatgctgctttagtttcctcagtagctgctgatattatcctattaatgggggaactttatggaagaattattaaataggcttggtctggttgctaggctgtctgcgtgactataacagggattctcagaagccatgttaagcatgttcaaatactcctaaaatggctgctggtgatagagaaagtagaattctccaaagttaatttttatacttctttaaaagcctggtttgctctaaaggaactcataaatgagacatattttaaccacttcatcatatttgttggatcactctgttctgaacataagcaattttggaatgaaggccttctggccacacgggtaatatatgtgttgcaaaaagtgggacaccatgagaggtatggaatgaatgaacccgctctctctctctccttctctctacttcaccactcccaccccaacggccccatctaagatctggatgactaatggaaggttaattctctgaggcctaaaggaaaatttcacactttctcagtagttcaaaagtttggctttcccctaagtgataacatacaaatggagtaacagcagaactctcaacattaaggagtttctgtgaaggtgccaaggcatttatttaaaagttgctaatcagatttcaaggcccaaagtcccggctccctcacattagtgatcagatttgttaactttaatttttcataacaatcccataaatttatgtgtttatgagttttttagtattttagtccatttgggctgctacagcaaaacaccttcagttggataatttataaacaagagaaatttattgttctcagttttggaaactaggaaatccaagatcaaggcaccagcaaagtttggggtctggtaagagtccagtctctccttcaaagatggtgccttgttgctgcattcccagaagggaggacactgtgtcctcacatggcagaagggcaagacagctcccttcttttataagagcacgaatcctattttataagtgcagagccctcatgacttaataactttccgaaagtccccatctcttaatactatcacattaggtattaggttccagtatatgaattttggaacaatattcagatcatagcaattagtttatttttaaatttttttcctgattggttcataattagatttattgttatatggaagctgaggctacagacttttttcctctgtatcatagacaagatattagaaatgcagcaacggcatttgcaaccaatatccaggtgtagacagtagttctcaatcactggagatattgctccccaggagacatttgaaaatgtcttatgacacacttgattgtcacaaagatggaggggaggaggaactctacagcatctagtgagtacaggccaagcatgatctcaaacattttaaaaacacagaacagcattcccaaacaaaaaatcatccagcccaaaacgtaaatcatgccaatactgaaaaacacggagctagatcatgggtagactttggagacaggttaatgtagactcttctacatattatctatgcaaactcgggaacactaattaaccctaacacctcaatatcctatccataaccagggtttagaaattattccagcgcaatctctggaaaggaccgaatgatgtaatttatgcaaggtacctatttcaatgtcagatacagagcaagcactcaataaatggtagccctggcatatcacaggcactccataaatgttagcttcccattagttcaaatatattttgaccagaagcttctcctagagaaactgtcattctaagacaaactaacttcagtgaaaatgtccagaagttcccagtgtaagctaaaagaacagttgtcttgtacacaaatatttaggtgatcaggcttctctgctcacataactcaactatttaaatatatatttgatatttgttatttgaggcgggctggtagaaattgtatgctaaaagtagatatttcctatgattctgtagaatatttaccaggagaaggaaagagaatgcttaattattaggaataatcatccaataaactgttcacttgaaagaaaggaataaggagaatatgggggaaattctagttatatataatcacttaggaaactccaatagcagtaaaagcattggttaatatagttgttatgatctcgaaaatgcagaccctcaaaatcccaaatcaatattttcctcaatagtcaaaaagcagaatttgtttaaaaattattttgtataattagaaaaagcttctacctttcttaaccagaaattgctttttaagtctgctttttcaagtattagagtactcataaatatttcagaaaagccattcagtttcagcaccacatgaaaaaggaatgataactttatatgtgtatctctgattcaggacacattttctgaaccacccatcatattccatggacccttaaaattctctggttcagcaagttaacactgcccacttcaccttaacaaagaaaataagaaagctttaggaggcaaatttaaagaaggagaacattctccctgcaatataaagaccatggaggctatacgctgattgatatttctgtacaaatgggtaaagaaatatcagaaatgggtacagaaatatcagctactctactaaagtcaatgccgtgtctcaaatgctgcaaaattacagcagtctgtatcaattctcttttgagcaatagtttacaaagccattcaaaaactgtttaaatttttattaaattcaaattttaacctttaatatcagcagattagaagatcttgctaaaaaataatttgagaagcattttctacataggcacttgagttattggcagcaattgctgaaaagttagcatttttatttctctgttgttataatgtgtctaaatattaggttggtgcaaaagtaattgcagtttttaccattgaaagtaatgacaaaaaattcaactacttttgcaccagcctaataatttggtataagctgtctatctatatgtgtatctaccatctatctcagtatcctctttcttgttggacatgaaaaaaataatataagctaaatttcctctgttcatttatatatgccgtgggatgatactgcattggtaaatgaattcatcggtcaatggatgagttatttgtgtactttgttccatgaagacatattaagtttcacctaaatctttcactatgtttggattccagtacaaagtagtttttgagatttgagaaaggacaacaatttaattcctatacagatggtgaaattgaaaggcagaagaaacacctgcattttggagagatggagatgagccacaaagtagagagtcagagtgtgtgagaactgtccaataaagccacccaaaatctgaggtgggctgggggatgtgttcagcacatagtacagacaatcccctaattacagttgttcagcttaggattctgcgaccttatgatggtaagaaagtgatacatattcactagaaaccgtacgtcgagtacccacataaccattctgtttctcactttcagtacagtattcaataaattacatgagacagtcaacactttattattataaaataggctttgtattagatgaatttgctcaactgtagcctaatgtgcgtgctctgatcatgtttagtctaggccaagctatgatgttcagtaagttaggtgtattaaatgcatttttcactgggctgtaactccatggtaagtcaagaagcatctgtatttgtttagaaaatacttggattcaatttccaactctaatcttgtgacactttaagacatcctcaattacaaacacacatacacacacacacacgagagagacagagacagagaaacacacatgataatttttttaaaaattaaatgtacttaaatttaaaagatgctgtgcacataatttgtggaaataaatgagagaaatggtttcacaaaacaaatgttgaagaactgtagttatgcaaaaagccaaaagtcagtatttcgtgacatactctttggcctctaagcaggaataacgcactgttttaatcttgtcattttatccattttattttgacccattgcttatactgagttcaaaggtattttgactttataatttttctattttcaatttcattgctgatttgtcaggaaatctctgaggagcccagttttctcctttaactaatagagataagaggatcactcttcccgtctcaaatcatcctctattcacaccaggttaagcctcactatctatatttacattgcactttgcatttttttctatggtacgtttcataatttgaaaacattatttttgtactaatttatctatgagcgattataggacatgttgtaggaaccatgggtgttttgctaacagatgtaggccaagtcaatgagttgctactgcctaactcagtgtagtcacctatggaatagctataaaatgaataaattaataatgaattttttttttaagacaaagtttcactcttgttgcccagaatggagcacaatggcgcgatctcggctcactgcaacctccacctcccgggttcaggcaattctcctgcctcagcctcctgagtagttggaattacaggcatgcaccaccacgcctagctaatttttgcatttttagtagagacggggtttcaccatgttggtcagcctgttctcgaactcctgactttaggtgatccatccgccccagcctcacaaagtgctgggattacaggcgtgagccagcatgcctggccaataatgggattttaatagcacttgttacaaaaatcttcatttttaatgacatttggaactattttttaattcttaaattgtctaacattttatagtaaactttattttacgtcactttctaatgtacgcaagcataacttcagaatttactgagattttttgaatgacttctattaaactaatttaattgcataattttctacgtagcaaagttatttttttccaatttttaaatttctctgattctttaaaattagcattatcaattattttttatgcaagtttataagaagcaactgattcactaatcaggcttatttatgtcaaagtttctaattatttccaatatagtgaggtttttagcttaatttttattagcatttctacaaaactcaatttttctgagtcaaatcactcagattctatttttttgttcaggataaaaatgtacctatgacaagtagtattgggttttataaaaccataatttatatctgatgattatgtcaatctgcaatatgtattgtgaatcactttatttcttggagaaaggaacagggtaaaagtttcagactctgtgaatatctcttagagaaaaaaatatcatagttacataatgatgcaggatctgtggatataataaggtctaaatggcaggactaaatgcgaggactaaagcattctatgcttccacattatacctatgacacaagctttgatatttaaaaataaacaaaaacaaacccagatactcccaaaatatgcacaaaaaacttcagcttttataagaaaaaaagcaaatatcagtttatataataggtttcctaaatgttttgtgagaatctagtttttgtataatatttatatttgtattttcattatttcaaggctgggtttgatgtattggaagcaagggcacagatttggtaaagcagtgaatgcttccaaagacaaaaatttatttctgatataacttttgaagcaatgtgaattttcttctatcaagtttccttaaatcgaaatcaaactataacaatatcttggtttctatgggttctctgtcatgtgcatcctcaagtatatgtgaccaaaggtttttaagccataatatcactattatatcatcacctacctaccataagaatgctaaaaattgtcctctttgagattttgatagtttaatatttctgtgtggaaaaaaaatcaaacccaacaaaagaaaataatatatgataaagaattacaaggccttctatcccaccacttgttataggtttaatggtgtggccctcaaaaggatacactgatgtcctaaccctcagtgcctcagaatgtgaacttatttgaaaatagggtcttggctgggtgcagtggctcatgcatgcaatcccagcactttgggaggccgaggcagggggatcacctgaggtcaggagtttaagatcagcctagcaaatacggtgaaaccacgtctcaactaaaaatacaaaaattagtggagcatggtggtgggtgcctgtaatcccagctacttgggaggctgaggcaggagaatcacttgcaccctggaggcagaggttgcagtgagctgagatcgcaccattgtactccagcctgggcaacaagagtgaatctctgagaaagagaaatggaaggaaggaaggaaggaaggaaggaaggaaggaaggaaggaaggaaggaaggaaggaaggaaggaaggagagagacagagagaaagagagagagaaaagaaggaaagaaagaggaaagaaaagaaagaagggagggaggagggagggaaggaaggaaagaaaatagaaaatagggtctttttagaggtaaaatcaagttaaaatgaggtcattcatgtgggccctaatccaatatgattttttgctctgactaaaagaagaaattgggacaaagagatagacacacacagagggaggaggatgtgaaaatacgcagagaaaccatgtgaagacagagaactggagaaatgcatctgtaagtcaagaaatgcggaagactgcctgcacaccaccagatactaggaagacacaaggaacgatttctctgcagatttcagaagcagagtgaccctgccaacatcttgatttcagatttttagcctctacaactatgaaatgatagtttcttttgctgtaagtcacccagcttttggtactttttgtggtagccctaaacaacaaattcaactctttttccagtattaacagtagtaaaattaaaacaaggataataagaaaagaaaatctacttttctgcttactcttataaaatctgcctagcactcatttctgctgatttgattacatttacatacaattttaattaaagaactactaataaatgtttcaattacaggaaaaaatacacttaatgaagaaattgtctatgatgatgatctgagaagccttttcagaaaatgttgttgatatatttatttttcttttctactattacagagaagactggaggagaaactaattccaagcccccatacatgatcaactgagtcataaatccttccccagtgtaggtgagagttcacagatactactctcataatctctctagtaagtctttccatttctcaatcatttaagcagtagaggacactgtttttatttctttgcattttcaatgtataaatcgtgcaataacacattgttcaattttttctaagttggtttaaatgctgagaattctcctgagttctcttccttggcagaaaaaataaatttctggaatattttcaaaagcatatccttgcaaatggaaatggtaagcttaataaaccatgctgtttgaggtcagccttgctgaatattgctcctcatatcatctttagttatataaggtcataagggatacttacgttcaagatcataaacaaaatgttggtgtagctcagcaatttcttttctatgcttaagaattattttcaaaaacaatatcacttttaacatacttctgattctcttgatgataaccccaggctttgatagtttgtttttcttttcagcttttgcactgggcctttgacatatgaatatacctgtatcactctcataaacttcagaagctttgttgcattttccttcaaattctctctgggtcaacacttaaagtataatccattaaccaagcccttgcaatatccacagtagaaaatgaagataagtaaatattgctgtgattcttttactgacattttttccaattcttacccctttcaaacagcgaatcagttctcgaaatgaaatcaatcttgtagacatgattaccaattataaaaagatgaaattttcaaattttattaattggatcaatttttagtatcattaagattaccttgctttcatttacattaggtgaagttatggtatacaatgacactaataagcaaaggcgagtttaaaataacaagagctaccatttattcaatgtggtattatgtggaaagaaacagtacctgatgctttgcaagcattatcttgcttaatttgcttcataaaactatgaaaaacatattatttcagttttataggtgagggatgtaatcgctagtacaatataggaaacacatgtcagagccaagatttgaagttgagtctctcagactccaaaatctgaaactttttcaaatatgccgtcttgttttccacactgatgcttttgacccttgccataaagtcagcatgacctctttgacaatgtgaatacagttaacactgtgcactttgaacaaaagaaaaggaagtaaaaggacaagaccattttcaggcaaaatgaagaatatgcaaaatgtcccctttttttctttctttttgctgatttccttcctaattccctcctcactactcccacctctaagtcaaaagctttttcttctaccttcaaacatctgcagctatgctatttcttaatttacctatcaaaaccacttttctctccaaccactcttcccttctcccaatatacttttatatcagtagttgttatccaatgactatgaatttaagtcttttgtttctttgggaacagtgtgtgcatgtaagaagaagcagtacagtataataaagaaggcaggtttgggagccaggctcttggctgcatcactaggtgacctttttgtagcctctttgtgcctcagtttcatcatttgtcaagtagtgcctatcccagcacttactgtgggaattaagtgaagtgattagaacaatgcctgccacatagttggtaatatatgtgttagctgttatccaaatgtatctttcattgaattaaaaatgtaaataaaatatgtcttctactaaaggaattgcacaaattaccatgaaaaagtaaaaaaaaaagtattgggattttgttttattacacctctaaaaacatattacgtgaggactttagacatataaggttacttctatgaagaaacagaatggaaaatgtcaagtcatttaagatgctcacttattacattaaaatattttccaggcaggtgtggtggctcaagcctgtaatcccagcactgtgggaggccgaggtgggcagatcacttgaggccaggaattcgagaccagcctggccgacatggcaaaccccatcattactaaaaaaatacaaaaattagctagatgtgatcccagctgcttgggaggctaagtcacgagaactgcttgagcccaggaggcagaggttgcagtgagccaagatcacgccaccacactccagcctgggtgacagagtgagactctgtcaaaaggacggaaggaaggaaggaaataaaatattttccattgattacccatgctttttattttgaattaatagtgttcgatgcattattaaaaaatagaatttaaaataaattgtagaaaatatggagagaaatatttatgtttcaaatttcccaagagtagggctttggtgcattataatcccctgatagctggcatgatccactttgttggttacttttacagggtccttctactctcttccttagtctccaggcttttaataatcacacagaatattcttttcactacagaacatacctacctatattttggctgtttctcaagctgacttatttcccagacatattcatcctttaagtacgcaaaaatgactttcataatatttccattgataggcaatacacaaatatgtttaaatgaaggaataatttattgcattgtactttaaaatccacattccttgctatacataatctgaaaccactgtaaaagtacacttttttaatgcaacagcaggcatacattttttccagtttgatgtaggcaggacctcaaataatgtcaaagtaaagatggtcaatctattcactattggaggaaaacattcactgtgtatcagcttgagttggagaaattacagttaagaaatgttttgtaactaatgatggcttccacgtttgtaaatcaatgactcataatgtatacatgtaaacctatatttcattattttgttagtaaaccccattataacatatactttaaccctattattcaatataaaatggcaaatgcatttttatgattcatttgtcgtattgttattttactcaagatttgttcaaatgttttactttttgtaagttaaactttctatgcttaaggagtatatagctacaagaaacagataaacactaaaaattacagttctaagacttagttgaatatctttcagtaatttcccttagagatatggtcacactgaccaagctacataaatatattttttaaaatttagtataccaatgtgtctattcatgataggttgtgtttttctccttgtacctaaaagtttgatggtttcttttccactctgtctctctctctctcttattgagctacctcgtactagtcctgcctaaagttttatattgtttctattctaactatactcagaaatacataatttgaaacttgaatataacctcttttgtatttctaatttttggtgagcattattctggttgttagccccttgaaggcaggtactttgtgttacattcccaatttatctgacaaaatatttagttcagcataaataatatgcttagcattcaagatataatttgtgattaatttattttgctttataagaggaattctgggggtagcatacacgccaatcatccttgaaatatatataaactacagtgcctctagagtgttatagaaaagccagtggattaaacatcaaaacctcttagagtctctgaatcatattattctattacttctcttattttctttatctatctttgtctcctattataagaaagaagacataaagatataaaaaacttttcctacctctgccttgaagaaagtttaactataaccttcataattatgaccagggacaagttaatgacagattccagctttggtatggctaaggtagaccactcaagggatcaactaactaatatcaaggacagtaaggttcttaccccattcatgagcttcaagtgttctatctcaccccaaaagagattataactctttttttacaatttcattttataatataaaccactatttaacctatatttctgaatcactggactgaataattttatatcaatttattccaactgctatgaatactgaaagtgcatgaatggaagatggcggcccatgaggcaggccttgttaacagtgtttccccagcagaagggtaaaacacaaataatccctccagagaatcaatttgcaaaaggagctcttcaaggttctgaactcctttccttgctctgctgtactaattagatctgacctaacaatgattctgcttatcttggcgttgtgtcactacccttagctatactttaaattaagaaactaacataatttattttgagttactagtacaaaagaaagtaatcttcttgatgggattcagtttgaggcagtaggttctgtataaaaatttttatcgtagatacaattgtcacctgttttctagaaaaaatatattaaatataacctaatgaatatgccaaacttactaggtctgtatttttgctttatataaaatgtcatcaaatttaaatataattcccaataaagtccacatctctgaattatctattacttgcattttggggtgtgtttatactacctagaatgttaacccttattgtgccttaaatgtgcatttgtaaaatgtaggcacttttataactatgagtgaggctggtaaggtagtgtttaggattctccatgtcagttagtgaaagtaagaagtacagtgttaaaactattgtaaatagtttccggggcaagtatagactgagtccatccagaatgactgtaaccaatttgacatcatgttatggataaagaagcaatgaaaaataaaccaaatagctacattatatcatattcttaactttcataagccatgttttatggaaaactttttagttttctcaaaaggctaatatatttcaatattttgaatacatcattgttaattttgagttggcagaggtaaattaaccaactaccattacgttttaggattaagagatatagcttttaataaagttactgaaatgcaaaaaaaaagagaaactaacataagttaaaattgattgtacatagtgtcaagacagcaaactcaaatgtctaaaaggaccagggagaaaatgtcaataaataaatgtttgtgttcaaggaaacccaaaactagagcaattgagggcccacacaatctaagcatagtgttttctgactcttgatgcatcaataaaatacttggcctctgataattttattttataagataaaccagtatataacctatagttcaagatcactggacttcacacttttataacgatttactcaggtaactaaaatatttcttcgctgagaagatcaccctactgcctcactttcaacacattaattaaagatcttagaaccataacaagctttaaggacttactaaacaattaggcaagaaattacaattttgccagtcatcccaggtaatcataccatcctgactcataaaatttccttatgaacatattgacaacttttaggaaaaaatctttctaacagactgcttgggaaaattcataatgtctctggcctggtcacacagcttaagtactttccgtagaaaatattcatgggatttatagaaagtcagtctacagtgtttacagattaagaatcagacaatcagggtcctcttcatggaaaatgaggatctatttacagtttatcaataatcagagatgctacgaagttgttagaatgagctaggtgtagccttgaggacttagtaaaagtcctcaaaggaaacttaagcataagcagagtaacttctctctgaagaataaatcaggatacttcctgatgtctaccgaaggtcccttgaagccataagcccaaacatttttaaattatttctgtcccaaatcctctcgctaaggaattaatgtcatcctttaaagatttagcatcatatgaatggagaagagccaggtaggtgctttcctagagagaaaaaataaatcaaacacaattcatactttattccagaaattaagtgttaacatgtcaaatgcttttgtctttaatttgaatgtctttcccttcataattatgtagagcagaggtttagtatttttgaggctattaaaattcctgagataaacttgatttttctctatgccgtcacgctccagaaaacataagaagaatgttaattctaacctaaaagaacccaactacttctgtggataatcagtttaaacatccatgggtcagaggaggggatgacagtttattgtgataaacacatgtctaagagaaccagatcaaggtcactgacatgtttaatattaattgctaaacaactgtcagatggcaatggtttgagttcaccacctctcatgagttgaatccaaattgctctctgaaggagaaatcatctactaaattctgttctttcaacaatgaaaacaggcatacctgtcaattttctatataaaaaataccattgtgtttattcactcacgtggattttcagctctgccaattcaatttcttcactgaacctactagtatacgcctcttcaatatagtcacgttcaaataaataagagtaatattctcattgagaaagggatatatacctcagataaattcattgttccctcttaccctctgttgttgataaatttagtttccaaacattctaaagcaatcttttgaaatcatctgttggcttgagtacaaagaacatgaggtccaactaattccaagcatttctttaatatggtaaaggtgttgctttgattgttactctcagccacgaactaccattggatcatttaattccttcaaaagcaattgaaggactggcttcaaacctttcaaaatctgttttcatatctacatatactgagaggaatagagagaagtttctgaataaaataataatactttgcagttctctgaaacttgagagggaaccagagaatgtttattactgagttttaatgtcttttaaagagccaacacctgatacttcaaaaacgttaatcactccaataaacattttactcccagaaattcatcttaaatccatcttataacataaacaagcctagtaagtagcattattaggagaaatttctggctgagttccacacatatattcaacttcctgaacaccctctaaaagcaattttaccttacttgacacaatacagaaattaatcagcataataagtaagctaaaacttcaataaaagtgtttgcatcttgtccaggcaggtggctcatgcctgtaatcccagcactttgggaggactaggcaggtggatcaagaggtcaggagatgaagaccatcctggccaacatggtgaaaccctgtctctaccaaaatacaaaaaatgagccagatgtggtggtgcacacctgtagtcccagctactcgggaggctgaggcaggggaatcagttgaactcgagaggcggtgattgcagtgagctgagatcacaccactgcactccagcctggtgaaaaagtgagactccgtctcaaaaaaaaaaaagtgtatcttaatttgaaaatattcataaagaaaagtgtaccctggtaagggggacagataacctaaaagaattatagggggaagagttttacatatataatgatcacattttaaaaattatagttgacctgcagataaataaagtatggtgtttttgcctttattccttaaatataatacatatcctttctctcaatgaccggctaatccaacactgatgattccttgaaacatccctgtgacttaaagtttacaatttctaagaacttttcctaactcaccatctctcagttattcacacacttaaattttcttttatcctattgaaatcatgcaagtattgtctgcaaccaagataggtaaacatatcttctagaccactagaacacatggctgttttccagatatacaataagtgatgtcacagacaaagaatcaagatacacacttctctttaccactgaaaatgttcacctcacatttttatctcaacttaggtgggtgtgtttttgttttttgattttgtttttcctacttatgaaaatagtgccaaagatcttcagttggcactccaaagcacagacaattgcaaccaatgttctagagttacttctgaatattatcctagacaagtagcaggagcactgacatgttttcataagagaataaaagacatacaaagatttattatctggcttcataaatttaaagcaactgtagtgccttgaatgtctttgtataaacttttatatgactctaaaagaagataaaaatctaatagagactttcagaaggtcaaatatgaaagatgatcatgtctaatgaataaattgatttctgctggagtaaataggtcacaattccaaaaagaatctgtattattttttgacagtgcacctaaagtaaaaatgtggctccatattatgtaagattttggtacaatatttaaaattctaaaatcattaagcaattccaacctatacagaagtatgacaccttgggattatctagactatatggctaactcttttaattgtatacagatgttaagtcttacctctgcatgtgtgcattgagaaaccagatgaaaaaaaaaacttaactgtacttttcaaaaaacttggttagatatttttatttaaacatttggttttgtacagtatacatttaaattacattgcttaatgaatccatctgaaaacagtcactggttgcttctgtgatttgtgaataggagaacatataaatatagcagaatgactttgtctagcaacatgttcttgccaagataattgggaattaaatatttaaatacatggaaataatatctttgcggttacatatgtgacttccaaatcagaccaaactaattccttaggaaggccaagagatagtgaagccatagcatcagagtgacacccagaaattacagacgacaagcattatgcaaaggcatagaaaatttgagattttggttttaagaaattttcctctttgtaagtcaatgtcttagtaaacaggaactatgtattcattacaaacatattgatagatgtgtatgtgtgggcattcatgtgtgtgtatacatgactataattcacaatttaatttgggtagataaatagatattgtatagatccacatatactttcatttggctatatataaaatatatatacataatatatagaatttcatctggttattatattaatataccataaataataagagtgtgtgtgtgtgtgtgtgagcgcatgtgtgtgtgtgtgaaatttagctataaactttgagaggggaaagagaaagcaaaaaaaaaaagaaaaggaaaagttaaacctcagaagagaatacactgatctagtgagtttttttaaatcttgaaaaaatggttttaaatttttgtttgatacttttgtaatctcaaagctgtcgcaataacatatagtggttttgaattgaaaaataaaaagataattgcctgcgctcagaagctggagatcagtttgggcaacacagtgagatctcacctgtacaataacatattttaaaaaattagccattggagcagtgcatgcctgtagtcccagctacatgggaggctgagtcgggaggatggcttgagcctgggggactgaagctggagtgagccatcactgcctcattgcaactcaagccagggtgacagcaacaccttgtctcaaaaaaaaaaagatattaatggcttaaatatgcataatctcatgtttgttaaatgatgcacagccatgaatttactatcaataaatatttttaccattttcttttttgttatcttttagatctccatcaaaataaacataagtaaattaattctttatctttacttttgcactatcttctctcgtttatagctttatcttttcaatcagtttctagcttcctttggttttattagtaatgtattacatttgcatagcattatgtattatattgaacaatataaaagtgccttttataagtaaaaatcgttgattattagcaatttcatatggcttaaacttaactcttctcaaagtgcatttttatgaattccctcatttgatcatcaaccttgttataagattaatactcaggttacacaaaagaaaataaggtttcaaagagttattactaagtctgaatcagctagatatgttaaagtactggtgcattgattgtagattaaagatgtgaacatgcatatacaaaggcattgtcctgaaattggttttaattaaaagctcaaaatccacatttccatcttcccgccacaatctcttaccccactaaaaagttatcatgatgattaacatggggccttacttcactgaactactaattattcttttcagtgcttcttttattattatgactttaacaatacatcttctgatcttactaatatattttttattaagaagcttagttgtttctaccaagattaaagaggagatcatagccaagtttcttttaaaaatgaagactgcttattcttagcaagaggagaaaaaattgagggcaaaattttgtggaaatttaatttgcctcatttgtccacagtaggtaagtatggcaactgtatgcaaaatgcagcagccacgcatttcatcagtgataatatgtgactagactttctaccctctctgtttgtttttgtttttgtttggtagaggtagcacctcccagtgttgctcaggctgttcttgaactcctggcctcaaggaatcctcctgccttgtcctcccaaagtgctgggattacagatgtgagctgccacacctgcctttcttctcaattttttaatcaatataaattataaaatgtggttcacaactaaggttgaaaaatatctagtccttcaccccttaccccttctcattccccaaaccctgtgaatctactgtaaaatgaattcataaaccaagagtcattgcttttttattctactgcttacattttacttggcaaacacagaaagaagttgggtagtacctcatggaagaacaaaaaagaagaaccctggggaacaatttctgggagtatatcataccacatgaaatctggaaaactccttcattctcatctgtcttttttccattctaaatcaacacactaattggataaaattttgcccagttaacttatacttcctgcaaatattacttcaaggatctcacttaaaaatgtaaaataattaaatccccccacaaaaagaaataatttaaaaatatacaaaggtatttgatacattttattcttattctctcaaaattattatattttgagcagaattattatattgaaattctgtattttccttacttagcattgcactgggaataagctggacaccatctgtttgattcaattgtttacctcaaaggggaagtaagttctagaaaacaactctgaaaaactgtgtagatgaactttctgattctacgacatagaataaggagctatatagagaattcttagaactatgtcatagaatcagaaaatgtataaggcagaattcttagaattatgttgcaatcagatgaactgacatactcttttttttttcctttttgcctcttcgctttacaatcaagttaaaccaatttaccttgactgtgtttgcactattcctacttcatctttattgagtaattatgttccttctcatgacaacaaaactacattttgaaaccttctcatttaaagcaggtacacaagacaagacagacaccgatctccagtgcagaggtgcattggacaatgtgacaagggacgcagtggtaattataaaagatctgttgacattatgtcttttctaaatcccattagaatgatgcattttaaacttattatttgatcaggatgaggagagtaagataattaaaatctttacagtacctatatttcatatactaaaacacagtaacaatatgtgagaattatatttcaagcattgggtcatttctgtgtcttataagtctctttgctatttaagaacccatggtatttttttatttctatttctatttcaaatattaaaatgtttatacccatatgtctatttcagaagaggtattgtaaaatgatttaaaattttgtggtcccttaataaattctatataaaaagcatagattaaagtggtcaggactatttaaaaaccagtatttgtgtgtatgtatatgtgtgtattttaagagagtgaatatccatgaaacatatcctcataaactggcctaactggtcttcatagaaaagcattattttcacgctattttatctatagaattaattgttttgcatagtcatagaattttctatatacaagaatccccagtgcccatcttcctacaagttaaataatgcataagtgtatcctgaaaaatgctagaatatctctcttcagagaacccatgtaaataaattagctcatattcttggaaaacagccttgctgtgtctgtgtgttctccttcaccacacctggacagacctcaactcgtaaacaaacatcctaagatcttaagtataattagtgcaaccaaaacacttgaatatcaatattattctttttaattgcattagcttaaaatattgtatctttttgttgtctaagaaccagagccctatggttttctcttaatgttaaattgtctataataatgagtcaaagtcatattagaaaatattagtactcacatggccattatctattatgccccattgatgaacgctttgggagggtgatgttaaatcttcttctattttatttaggaatctcattggatatcatagcacagtctacacatttcagtgtctcctgggtggcagacctcacagaatgaagccaggagccttatgctgagagaataggaatgttcaatgggttcttccttcatcaagaaaaaaagcacccagaaaacaaatagctaacagccatcttgaagctatcttgtgtgcttgtctcagtaaaaaaactaaacagaaggaggaaaaaacaaacttgacatggttaaaaagcagaggctgctcatctggatttatcttgcgttatgcttttttaatcaaaaattcttcaaagcttactgattgtttggttcatgaggtgaagggcctgtatcttcaaagaaagaagaggcaagatctgctaaaagagaaagcctctcgtgatgatgtacttactgccactcagaccagaaaagattctggccctgatgcagttaatcacttgggccatgagttggtcactgctgtatcctacggagagcctgaacaagtagaacttttgttgagtcattcaactgtagaatttctgcttcaaaggcaacaaagtcctttcctccaagatattaaaacatagactaaccaggaatgatttatgtattttaagatacaaataatacggatttttttaacactattactaaattatgtttaaggtctttgagtttaaaactgttaggaggactctcaggctatataaattacacagggctctcggagatcacaaactgtctaaagaaaaagggtcatgaggaaggcaccatctctccccatgttttcatgactgaatttccataatttatttagtttctaccaatgacagaaggcgggtggaggaaggaacaagaaagctatcttaaaaggagatacaacagagtaaatattttcccagttagaatcttagtgactttgaggggattaaaagaacctactgtgaataattatacatcaataacttggataatccagaaaaagtatataaattcctagaaacatacaacctatcaactgaatcatgaatataaaatctgaacagttcattaactattaaggagattaaatcagtaattaaaagcctcccaaaaaagaaaagcccagatgagatggttgcactggagaattacacaaaacaataaaaaaaaatagtgctaattcttctcagaattttctaagaaatagaagagaagagaacatttccatacttattttatgaggccagcattgtggtgatagggataccaaagctagacaaggactacaagaaaagaaaacaacaggccaatatccctagtgaacacagatgcaaaaattcacaacaaaatactaacaaagcaaatttaacagcatattaaaagtatcatacatcatgacgaagagggatctattcctgggttgcagggatggttcaacataccaaaagcaaatcaatgtaatacaccacattagtagaataaagagtgatcatctcaatagatgcagggggtaaaaaagtattttactaaattcaaccccttttcatgataaaaacacttaacaaactaggaatagaaaaattacttcaacataataaaggccatatgtgaaaaacccagagctaacaacatactcaaaggtgaaaaactaagagctcttcctggataatcaggaacaaggtattaatgctcactcttgccacttctattcaagatagtattggaagtcccagctagagcaatgaagtaagaaagataaataaaatgcatcaaagccagcaaaaagtaaaaaaaatctctgtttgcagatggcttgattttatatgtagaaaaccctaaagactccatagcaaaaaaaaaaaaaaaaaaaagttggaactaataagcaaaaaagttgcaggatacaaagtcaacatacaaaaacaattgtttttttttttattcctgaaaaaaagatattaatagtttgataaggattgcattgaatctgctgattgctttagatagtttggacatcttaacaatattaagcattccaatttggaaacacaggatgcctttctatttatctgtgtcttatttaatcagtatataagttttcagtatataggtctttcaactccttgggtaagtttatcactaactgttttattatttttgttgatattataaataaaattggtttaattttttatttttttattgtatatatccatatgcaaaagattgaaactggatccttatcttacacacaaaaatcaactcataatagattaaagacctaaacataagacctgcaactgtaaaatgcctaaaataaaacacaggtgaaaagctttaaaacattgctcttggcaatgatttcctgaatacgacaccaaaagtacagaaaagaggaaaattggacaaataagactacattaaactaaaaagcatatgtgcagtaaaggaaatgagtgaaaaggcaatctatggaatgagagaaaatatatgcaaaccatatatcttataagaaatcaataaccaaaatatataaaaaactccataactcaatggcagaaacacaacttgattaaaaagcgggcaaagaacttgtttagacatttgttccaagaaatacaaatggccaacaagtatataaaaagatgatcaatatcagtaatcaagcaaggaaatgcaaatcaaaaccacaaggaggagggaaagcaatgcgatatcaaccgacacctgttacgatggccataaccaaaacacaaaataacaactgtcagcaaggatgggaagacattggaacccttgtgcacttttggtgagaatgtaaaatggtgcagccactgtgtgaaacagtatggaggttcctcaaacaattaaaaatagaactaccatatgattcagtatttaccatgtgatttctggtattcacccaaaggaactgaaaactaggaccctgaagaggcatctgcacttctgtgttcgttgcagcattactcgcaatagccaaagggcagaaacaacctgtgtccattgacagataaatggaaaaagaaaatgtggtatgtacatacaatgaaatattattcttccttagagaaataggaacatcttgttatatgctacaacataaaccttgaggatatcatgctaagtgaaagaaaccagtcacaggagacaaacattgcatgattccacttctatgaggtacctaaaatgatcaagttcatataagtagaaagtagaacagtagctgacaggggataatagggcatagggaagatagggagttgctgttcaatgggtagagagtttcagtcacgcaaggtgaaaaaagttctagagatcttccctacaacaatgttcatattattaacaatagagtcctgcacacttagcaatttgttaagaggataaattacatgttatgtttttttttaaatctcaatcaaaggaaagaaaaaaagaatcttagtgatttttagagcagtgattatttccctgaattatttccatgttcaccccatcattaaaaaaagaaaaatccttggttgttcattcaaccacagagaagtggttataaatcccaacatattggtactttactgttaacactgacttgagcagacatcactcatgataattcctgtgtttgccatttgcattgtatcaccctgacttgtcctggtacgcaccagcaccactctgctcacttgttaatacacacattttccactgcacatgttggttacaggtcactttttccttaaatttaattgcaacacttaagcatggactaaccaggactcatgtttttattaatacatttttaagaacccatgattgatattcttttagccctggggatggggatatgaaaaaaaacaagaatcatgaagtggtccagaaaattgctctggaccatcctgatttctctcctgtattaattcctattgaacttactatcctttctattgaattttagtgcagaattgctttctgatagtgtctatctttattctctttccccattaaatcatctcactgttaccttactttctaacaccacttcctgcacaggtgttgtgtgtcccataatctcattgcttgagtgatttgaactaatttaactcacatgactgacagttcagtggagggtgtccttttgacagggtggagaagaagcttgactgtaatattgctcagctgtactgctatggacctcatttaagaccacaaacactttttcaatgatttatttaactttttgaacagataatatattcacaaagctcaaaaactaaaaagcacaaaaagatgtgtgctgcaatgtttccaacctattcttgtttgccgtctgcctttcatcctcgctctaccctccatccaggtgaccctgggatgtagacagcagtacctaaagtttcccagacgcttctaaagcagaacattgttgttttcagttgtaaacaaggaggagcctggtgtgatttcaggttccagtttccagatgtcgcctctctgtcagggatcaaaaccacttacagtgccaatttcacttgtcaagcaatcaaacactaaataaacaaaccaaatggatactgaacacccacgaggtctgtttgtgttatagattatggagaggatagggataaacaagtaaattattaatcttgaaacagatatgtggaaaaccatatctacattaaattgtcaataaaactgcattttctaattaagcaggtgtgagatttccatatatgcattcacccccaacaacatatttatttaggacttggcagaagtttaggtgtcatcaatgagaatccactcatttaactaatgagaaaactgaagttcagagatgcatcagggtttataattaagaatatgaagagtatggatccagccagacttggtttaatccaagcttgtccaacccacggcccacaggccccatgcagcccaggatggttttgaatgcagcccaacacaaattcttaaagtttcttaaaacattatagatttttttgcaacattttttaagctcatcagctatcgttagtgtattttatatgtggcccaagacaattcttcttcttccaatgtggtgaagggaaaccaaaagattggacacccctggcttaatcctaccacttagcagctgtgtgacattagacaaactacataactcctatgtgcttaaatcttcccatctgcaaaatggaaataagaatatatccttcataagactgtagtgattaagtgagttaacatatgtaaatagctaagaaggatgcttgacatagaataagcaccatagaagtgcaagctgttataggttaagtgtcttgtgaaagatgagaacagctgggagagtctagagagggttacatgctgataaaatgatgtactgaattatccattacaaagcattagaggaaaataaaattcataataaggtaatgtgcacattgcacacgtgaaaaaagaatttaagaaggctggagtaaaataagcaaattacactgatttagctcataaacaaggaaataaaaaaatcaataaggtggacaaataagtaggctctcataagcatcactgggccaggacaaaggtctcagagactccaaatctactcagttctggaaatgcttcctttatttatttatttatttttaattttctgagggaaaatacagaatgaaaaggacgtatactcacaggtaagtgccaaatgttttgataggaaaacattttaaacactaattgactttgaatcacgtttgagtaaattttggtcttcattgtatttaagtgatagtctaattactacctatgatttcagaacttttaccaaataagaaaataaaaacaattagctattgctcatctttttctatgtgagtgctaacataaatttttaaaatataaaacaaagtgaaagattagtataattttgcttttcattttaaaataaatatagctttccgtttaaactgtcttcagatacatttctctcagtatctaaaacaattactaaacaagatacgtttcaaagtaagaagtcatgcttttattaaagagaaaatggataataatgttcacaagtaccactgattcacaatttctagattagttatatttaagtgattgaacaacaaataaggaaagtcttaaaaataaatatttttctgcagaaaatacacaaatatattccactcttgagagatctcacctttgcataatataagacactcatctgatgcagttagcctatagatcctttaatgaccttacagccaaatctaatcaagcttagattgcaacagaaagtaaaggacacactcctattttatcaaaatgtgaatgctgagaaaaagagaagagggaataatatgccttttaaatttatgataagataattagcaaccttgctaatgtagttcttcaaacattaaatcctcgttttcattcttcttccctaccaaatttaatatactatgagaactctttagcttaattatgaaaataataataatagagttaagggtctgtcaatccagcttaagcccctatctagaatttagaacctggcatcctaattaaactgcaaatactttatttacaaagttattgtttatacattgtaatgaattaatctgattgaatctctgactgattatgggctaccatgtatattttcaaagcaatgagaggggcatacaattgcatttccaacattcagtcgctcagcataattagagaaagtaactatagacgtcaataatcaatgtgcacttgcaccctggagacctgggcaccattacgattccaggaacctctttgagttgtcattttaattatttgcatattaagatctctgcaggcaggcaatacttcaaaagataggccaaaacagctccttcaaatgttattaagttcaacattgccaaatatattttagttgccaattttgaaaaccaaagagattatttaaagtctatcacaaaactgttacagtgagaagactgagttaactacctgtgaccctaggccatcagtgcagacctggggttgctgaagatttggaaaagtgaatcaaaatttttttttctggaaaaaataataaaaagtaacaatacctaccatcatacaactacaataaaataaatgctttacaaataatgtcaaataatagatactccataaattctggtgaatctttgttattataagtagtagcagaggcaacatcaacattcacattcctgattcccatagcactgctttttctatgaattaatgttgtttcctcaactagactgaagaattaataaaaagtcctattttaccttaagtacaaagtgttttgtctacatgctaattaagtacgccaaattgttttctatgcttctagaagacaaataatgatttatgggtcctaaagagcacttggaatagtgctggatccacagtaaatgtccagtaattggttatttattgcttgatataagtaagcacacaaaatgaaggattcaatgttaaagaatcaaacagagatttatgagtgtgatcaaacagagttactatgttggaggtaaatttaattcttgtatatttcaaatatatgtcaaatatttctgggacattttgaattgactttcctctctgtgaatggcaacactacccaacatctatggtaagcctcattttctcttatccccaacaatgcctcacacacacaatgaacaagaaatgagaaacaatgtggtcaggctttctgtcataaaatctgattatagagcaggatttgctatgcagaagaatttagaggaagtcagagccacaaagtgtggctgtgccaccaaactacatttttttcacacacaaaaaagagaaagtagaataagaggctgaatggaaaggagaaataacatagacagtactgagtacttgttaacatccaatatataaaagagctacctgaataaacagagaaaaatatgactatagtattattattgctacaattcaaaccctttgagtgtgtgtgtgtgtgtgtgtgtgtgaaaaatagatacacaaaaatatcaaatgtggctatttatagatcttaaatacttaaagggtatgattattacaccttggctccttctcactcacattttaaagatgtagggaaaggtgatgcctaaaaagactaccattcctaaaatcttatgatttcacaattttctgcatagaagtagttgcttttaaaactctagtatgtatttgagctgtatgactccctgagaatggaatatgctaggatccagtaaagggatattgaggtttggcctaagggctaaacaaataaatacgttgaggccagaggcatagtcaaaggttagctccttggtaagaaaatagataatccccctctgaaaactccaggtgaatctagggcccagaaaaaaatacccacttctccagggtcatgcaaggctaaaacagaccagcctaggagcatggatacaaactggactagcaagcaccacaacctcagaaattagaatttggtgaggcagcttttcattagtaagatgaataacaagagggaatacttgttttaaaattgcatcaagctaactgaaaaagaaagattaggtgcaggcatccacaatttgttattatgtttttcaatcttggagaccggaattctcctgtgctttgaattaacagcacgcaagtgatacactatagagaagaaaagtcaaaaaattagtaaatcaatagggctgcctttatataacttgccaccataatttttccctggatgcttccaacgtatctatagttttgtttattcatttggcaaaatagggcacccacatccttggcacagttcatgggcttgaattgtaaccgggaagaagacaaatataattcctgctgtgatactgtgatttaaaatgagatatatacatttggtcttcactcccttctcctgacatataactcttaaaatctttgaaatctctggagtgataagaatatcatttgtatgctaatgaatgtttgctggctggcagcctctagatagcttcagaatgggggccagtcaccaagaccaagacagaattagagggttaaaactttcagccccaccaccaacatccaagtaggtgagaaaggctgaaagctaagttgataaccaatgaccaatgatttaatcaatcaggcctatgtaatgaagcttccataataactcaaaaggactggagtcagggagcttcctgacagctgaacatgtggaggatcccagagagagtatggcagctctgtgccccttcttccgtacatcttcatctgactgtttatctgtatcctttgtaatattctttataataatcaagccaaatgtaaagtattaagtgtttccctgacttctgtgagctgctctcgcaaattaatggaacccaaggatggggtctacagccagtcagtcaaaacctgtgcttgcaactggcattggaagtcggtcgggaggcactcttctgaaaatgatccttcaacttaagggatctaacactttctgctgctagactgtgtctgaattgacttaaattagagaacacttggcaggtgtctgttggagaactgctggcttgatgtttgggggaaaacccccacacatctcatgttagaggtattgtgttggctctgcaagagtaggaaagccactttgactcttcccacatatcttacatctgctctcatggaaattacagtggctatagacagagaatgaattcttaaacttaagaaaaacaatatagtttcagagagtgatccatgattggagctgtaaagaaaccagaagatgtggttgagagggactgggggaagggaaagaggggccacaggttggtggattctttaattagatgggctaattggaacatcctcactaaaaaggtagcatctgagctgagagtgaaatgacaagaacaagctagtcatgtaatcttctggggacagttttacaaataaaagtaaaaacaagtatgaaagccccaactaggaacaacttaaagtatgtaagaaaagcaaagacaggtaaagccaatgagccagtgaaggaaagtgaggtatgatgcagcctggagtcacagatcatttggcctgaaaaaggagttgaaatttagacattagatgaaaagactattctagccatcttgctactagatgatggtggcctgactaatgcatcacctgtgaaaatgaaaagacccatataaattcgggatacattttggaagtgaccctaagtaatccttcaattgttggggtgattatgtatgtttgtgttttaaagtgcggttcagtgagggatcagatgactcctaggtgtatttcgcttgaacaacaaggcatatactaatgatatctattgagaagaaacttcggcagaaattatgaactagaaaatggagaatggatagctctgttttggtcttgagaagtttgagatagctcttagacatcccagtggaaaggtcaagcagagggttttttacataaattaggagctcattgcagagatcaggattagagatatacatttgggattcatcagcatttagatggcattaaacgccacagtactgaatcaccttcagaaagattacagtctttcagaccagcatttggaagccaacagagcagaagtcagcaagaaaggccaagaagagcagtaggtatggaggagaacatagcatcatgatgccacagcagaaagtgtttgaagaagaaaagaactgtcaactttgtgacttgctaccgctgagtaaaaaaatgaggacagaaatgtgatcactggatttggcgcatagtgaccttggtaacagtctattcaatcaagaatggcaaatagcctggaagaaactgttgaggtcgatgcgtatgatacaatgaattaaaatacatcaatatttctagcaaagaaatactatcatttttacctatacttcaattcatccctgatttcatgaatatcacaatatagaatttggttataatttattgtttcatagcagttagttttttgaagctgtgaaaactcacaataattagcagcaaataattaatgtgcttataaaatactctggggaaatatgccctgacacttagtatcccaaatggcattactcttaaaagcaatacatgtgaccctctggctataatagtaaaaaataatttttaaaaatgaagaacaaagtaaactcttttaaagacttactttcaaatgtcacaatagcaataaattattgatttccacatctaaaattaatgtttttatttatttatttatttagttttttaattgatcgttcttggatgtttctcacagagggggacttggcagggtcataggacaacagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgactggacacagcacatgtttcagagagcacaggtttgggggtaaggtcacagatcaacaggatcccaaggcagaagaatttttcttagtacagaacgaaatgaaaagtctcccacgtctacttctttccacacagacagggcaaccatccgatttctcaatcttttccccacctttccccgctttctattccacaaaaccgccattgtcatcatggcccgttctcaatgagctgttgggtacccctcccagacggggtggtggccgggcagaggggctcctcacttcccagtaggggcggccgggcagaggcacccctcacctcccggacggggcggccgggcagaggcacccctcacctcccggacggggcggctggccgggcggggggctgaccccccccacctccctcccggacggggcggctggccgggagggggctgaaccccccgcctccctcccagatggggcggctggcctggcgggggctgacccccacctccctcccagacggggtggctgccgggcggaggggctcctcacttctcagacggggcggctgccgggcggaggggctcctcacttctcagacggggcggttgccaggcggagggtctcctcccttctcagacggggcggctgggcagagacgctcctcacctcccagacggggtcgcggccgggcagaggcgctccttacatcccagacagggcggtggggcaaaggcgctccccacatctcagaagatgggtggccgggcagagacactcctcacttcctagatgggatggcggccgggaagaggtgctcctcacttcctagatgggatggcggccgggcagagaccctcctcactttccagactgggcagccaggcagaggggctcctcatgtcccagacgataggcggccaggcagagacgctcctcacttcccagacggggtggcggccaggcagaggctgcactctcggcactttgggaggccaaggcaggcggctgggaggtggaggttgtagcgagccaagatcacgccactgcactccagcctgggcaccattgagcactgagtgaaccagacaccgtctgcaatcccggcacctcgggaggccgaggctggcggatcactcgcggttaggagctggagaccagcccagccaacacagcaaaaccccgtctccaccaaaaaaatacgaaaaccagtcaggcgtggtggcacgtgcctgcaatcgcaggcactcggcaggctgaggcaggagactcaggcagggaggttgcagtgagccgagatggcagcagtacagtccagcttcggcttggcatcagagggagaccgtggaaagagagggagagggagaccgtggggagagggagaccgtggggagagggagagggagagggagagggagaggggtaattttgtatttttagtagagatggggtttctccatgttgatcaggacagtcaaactcccaaactcaggtgatccgcccgcctcgggctcccaaagtgcggggattacaggcatgagccactgtgcccggctaactcaggatttttccctttgctgatgtagcctgacagcaggagggagcctataataatgagaaaggcgcgaatcaaaaacagcacagtggcaagtgcgatggccttataagggatcttaggaggggttttcttaaactgaaggtccatgtagccatcgtctgtgctggagagccttgaatatttcactttactactggggattccagtagccaggttggtacgggacggcatcataacaggctgacacagcggagcgccgcgccaggccgcccgcacacccagagctcgcccacggttggcagcgcccaaggttgcacggcatggcccgcttaagtgccactcagccctaatgtttttatttatgaagtaacttaacttttggtaacataatatataacttctctttcacagattattttatttttttagaattctagagtttgaatgaatccaattaagtgtgctctgtgtgtcttctcagcctgcccttagcaagactcacaatgtgagttctgttctacttgctatcaggagaaaccgcacaggaacccaaagaatactgcctgctggaaaaaaaaaaaaaaaaaaaaaaaaaaaaaaagctcatttcttcacaaagtctctggctgtggcaaatagaacacaccatccgtttatagagtctgctaattggcactagggcattgtctgggcttgcacttctttactggcaaatgcagctcatttttatttatgctcttcaatagattcagctaccaatacatacagatttggattatgaaaaattatctaggcaggtaaaaggaattgaaatttcagacagttcagtggattaggagggagggtgaggtaggcccaaactaccttgaagaaggagtattttgtgaaaatgagccaagccccatgttcacttttgaataataaaaacactcatccacatgccgacatgacacagggattttattgtgaattgtcacacacggtagttttattagtacctattcaacactaagctaatttaaaagcacttgaaaccttgggcagacgtttttaaatgaaaaaaaaaaaagttcaaaaagctctgcatcatatactatctactataaataaaataagactcagttcttctgagccctgaaacacattcatttccacatgagctgcctgcaccaaggatcactttcatcattctctagggcaacacagttccctgttctgtcagaactttatggcattcacccttttgcctagttttcactgcttggtccatttataatacatctcctcccatactagattcctataagaggtctcatttaatttcttttaaaattaaattaatacaattaactttgaaaaactggtagtctttactaaatctcaacataagcatactccatggcctagacttttcactcttaagtatagacccagcagaaaaaacgacacacacatccaccaaaagacatgcactaaagtgttcgtagcagcgctatttatttgtattacttttatttttatgttttatttttgtgggcatatagtaggtgtatatgtttatgaggtacatgaaatgttttgatgcaggcatgcaatatgaaataagcacatcatggaaaatggggtctctgtctcctcaaacatttatcctttcggttacaaacaatccaattatactccttaagttatttataaatgtacaattaagttattaaaacaaatatgtgtggtcaaataaagagtagaatggataaaattctcacacaatggaaactgtaatacaatgagaatgaacaatctacaacttcatgcaacaaggataaatctcaataatagattgttgagccaaacatgtcaaataacagatcacagtgaattatttcattacataaagaacaaataccttatcctgactaatataccaggtctgagtaaaataattgggaaattttagccaatgtaaacatgtctaattccctttttataagtacaaaaccagtcacaattagactatgttcctagaagaaagtattagttatccttactgtgggagctaatgagtagagggggcttgaggggcttctgaaactctggtgttattcttgcatctgggtacagattacacaaatgtgttcagtttgtcaaagttcttcagagtgtataaatatgttaagatatgtacacatttctgtctttagaatacagtttgaaaacaattttaaaacccttaaatttctaaaacttgtttttaaaacatggacgttacacctaccctcatatttggactgaatttccagccttgtaacaagagagcattctccggaatatgaatagaactggtggcagactattcatgtcatgcgaacagttagtttgctttctaaactagattgtacttttcccaagagcaggagccatttcttttgtgtctgttcatgtgtctgttttgtgcacagatgcacagagaaacagcgttctgagtgacgctgattgttcacattgagtagcagtggcgggcaagcaaaaaagagcagggctgaaatttggaaggctttaaataataactggtttccaagtttggatgccatcttctaggcaacagtcaactgtaaagattttgagtgaggcaataacataaggaaaatattattttaggcatgcatacgtactagaatcgagaaaatcaatgccagcagaccagtcagcaggcttagtttaagcctaaactagaatgatcctggcaccaatggaaaagagggatgggcatatatgaaaaaaagtcagacaaaaataatctatagagctttgaaagtgatagaggtcaagagagttgtaagttctaaagtgattgagttttgcagactgagtgagagcttaatagaggaaggaaaaccttatggattaattgatttgggaagacactgaaaaaatgacataatgggccaggtgcggtggctcacacctgtaatcctagcattttgggagtccacggtgggccgatcacctgtgggtcaggagttcgagatccacctggccaacatggcgaaacctcatctctactaaaaatgtaaaaatcagccaggcatggtggcaggcacctgtaatcacagctactccagagggtgaggcagggggaactgcttgaacccagtaggcagaggttgcagtgagccaatgtcgcaccactgcactccaactccagcttgggcgacagagtgagatcccgtctcaaaaacaaacaaacaaacaaacaaaaagacataacgaatagccaaagttggagctcaatgcagaactcatacaaagtacaggactcagatttcatatattaaatgtttctgttttcctcagggtattaaaaatactaaagaggcacagagatatagtgagaaagcatgagaagatttagaaatgctaaacatcatcaaaattaaaaacactatttctgtgaaaggatagactgagaggaaaatattttcaaatcacaaatctgacaaaagacttgaattcagactatataaggaattctcaaatgtcaacattcagaaaacctacaaatcaatttaaaagtggacaaaataattaaacagacacttcaccaaacaggctatatgggggcaaataaacacaggaaaaaaagtttagcattagtcatcagcaaaatgcaaaataacaccacaatgaaatgcaaattaacaccatgttctatacatatattacaatgaataaaatgaaaaacactgatagtaccaagtcccgacaaagatgtggaacaactagaactctaacacattgctggtgagaatgcaaaatggtacagttcctctggaaaacagtttggcagtatcctataaaattaaatatatacttaccatatgtccccaagattctacttttagatgtttatccaagaaaaatgaaagcatgtatccagagaaagatttgtatatgaatgtttacagttgttctatttataaatttatcaggtacatggataaacatactgtggtacctccctacaatggaataatacataccaataaaaaggagcaatctatttacagagagaacttgcatatatctcaaaggtcaagctgacagaaacaagctagtctcaaacagttccacatgttatgattacatttatacgacattctcaaagagacaaaactatagttacagagaaatggtcagtggatgccatgggtaaaggtgggagaagagtatatctacaaaaggacagcaagaggaagtattgttgggcattggaactgttcttgtatcctgactgtagtggtggttatacaaaactgcacgtgttaaaattcacagaacttcatataccactcaaaaagtcaattttcttatatgttaatttaaaaaaatcttctaaggaaatgcacagatagaacataaagcaaccatttaaatgtcagtattcttttgtatttttactgttatttatctaagagtatctaaaaattccacagtaataggacaagtaacttactagatactccagtatgcctataaaaattacataaaaacaaatttaagaaattgaacttttttgccaaacaactgaaatttaatttataccagattatacaaaatacttaatgtaaaactagttaccaaacctaattagcaaatgtacagtaattgacctaattggcaaatttcttattatttattgagatcactgactacccagctgggcttactaaaaaactgagaagtagtcaaaagactaaagaaaaaaaatccaaatatattgaacatgggagggattttgctcttaaatttaagattctctgtaatcaactgtgaaaatctgaatacatttgttttctaggtgaacaagggacaataataaatcataactgtcaattttgctcaaaatatggtttaggagtacattttggacttctcaggcagttaattggttttgcagttttgaaggatgtggtgctcagtttttgaggggttgaaaacaactcaactgctagaatttcaggaggaaaacaataactataacaaaattcacagtggctttttaactaaggtgacttttttggaaagttaccctaaatgatctgaccagtttcatgtatcataatgattttgaattgagataagaataattggtacgtgatctcagaaaatctgaatttgaaggacgccaataacaaactagataaccactggcaaattagtaaacctctttgatcctcagtttactcatttgtaaaataaactatctgtattagataagaagttctaatctttactatattacatatatctctgtgtgcgtatcttagattcctaagcagggcccaacccaggtctgagttggggctcaggggtgcatcattgtaataggagcctttgtggtgctgaggcagatggtccttagtgcacgcctttagaaacactggaccagagagacagtccctcactcttgcagctttaacacttgaatgcagtcagtgtcttcttagcctacttttgtgtcatccctcttttctctttagcagagaccagactattagatttgtcttctttcatatcagaaaggcaaagaaattactatggttttccttagacctgtattttctgagaataatatagacaacctcagacagcccagggtgagcttccttttcaaaactgctttcagatgggatgtcttctacctcgtaggttcaccttccctgtaatttctgtaattcaaacaggcctcataaaccacaactgatctttaagaagtcacctttcagattgtctcccaaaaaaaatttaaactcctaagtgaaagatgaagtaatatgatataaaagaaaatctaatgatacccttaaaataagattttactcaggcaaactaaaaggcctactaaagaaaattatctttgacctttactttcgatttcttatgtaatcctacccagttgcttttccaacaataagagaaaaattacatttaaaaatattttgatatttatttaagggaattctactattggctctcaaaggaagttttaattttatttgaaaggcaaagcaaattttagattaatcttagcctctgagtttaaaaatgcaaatgtttccaataataatgataattgacatgccagcacatgacatttgctttgagaatattaaagctgaggaaatatggatataaacattcaacattaaactttgagataattatattaatcctaaatgaataataattcttcaaaaataaaaataatctttaaatgctaaaagaatcaacataatcacatttatttatgctatgcaagtatacatactgtgtggaagaatccagaagcagggttgatacctgacactctagccagaatctgatgagactgatagtttggaactcagtccctttccttacaaactaggttgtcttgggcaagtaatttaactttgctgagcctcattttctaaatctataaaataataacaacctatcaaatctttctgcattaatcacatgttaaatgaggataaagacaccttttaattagaattttcaaatatctaaactgtggtgcttgcaaagtttcacattcttttcacgtttgtaaaattgaaaacattttactagtccccataaatctgaaaaagaatttctaattctagttttcgaaattcaaaagaaaaagaggcacgtttctgtcttattaatgtatggttttcttcttgttttccttcgacggtcgtctgtaacctcccttttgttttgtttaggtttttaatcgacaaataataattttacttatttatagggtacaatgtgttgttttgatgtatgattaaatcagggtaattaacaaatccaatgcttcatatacttaccatttttttgtggtaaaaacatttaaaatctacccccttagcaattttgaaatatacagtgcattatgatttattatagtcagcattctgtacagtaaatcactaaagcttatttcttctatctatggaaactttgtactctttaatcaacattccccttttgccatccaactccccacctccagcctctggtaaccaccattctactctttatgacttcaccttttttagattccacccgtaagtgagatcatgcagtatttgtccttttacacctagcttatttcacttagcatagtgtcccccgatttcatccaagttgtcaaaaatgacaggatttcctccccttttaaggctgaatagtatttcattatgcatatataccacatttttttaatccatttatcagttgatggacacccaggttgcttccatgtaatcttgacctaagttacaaatttgcgaactctttagattcttatatccttagtatatgagaaatatttaaatcaataaagcatcataattgtaaaaaaaaaaaaaaaacagaagaacaaatatgactgtggcagcatcaatagaaaccaattggtttgtgtaaattaaaaaaaaaatcagataaaactgaaatcagtcacttagaacaatattttaaaatcagtatcctgagcatatggtcatgtctgggttttcatttccaaaagagtaaatccctgaagatactttgcatatttttatcctctcagttagactttgctctttaaaataaaacctaccctggttaacaccgtatctccagagaaaaacacaatgcctgctacttaataggtgttaactttttatgtaattgatgaatgaaccaatgaaaaatgtataataattcttaagaaacaacaagtagtgttatctactcatagccaagtgaaaggacaactaaatattctgaagaatagcgcaaaaattgtgcttacccctttaaaatacaagtgatatcaatcgtttactagttccaaacaaagcactttctttgcatttgcttgaggcagtagagcataatggtttggggcaggcatactttttgggtcagatgagaatgggttagaatccaggctgtccttataaacaccattaacttgggcaagtactttcatttgttgagactcattttctttcttgcaaaactgggaaaatcaattttaacttatgacgctactgaaagatttaaatggcaacattttactggctatttgttaagttgcatacctgagaggactcctagccctaagagtgaaaaattaaatcaatattatttctgaacaactttacttaacaattataagagctgagtaagaaagaaagaaaatttgtattatatgagatgcatacaaaatattttagcataaaccagaaatatttttgcataagccaagaaaagagacaaaatgttaacagatttaagtggttagaaatgtgcttgacattcatgaaaatgcagtattccttatacaaaaataacaatttagttttattaggaaatacagaaaacttgaatagaaatctatttcagaaatacactcagaaatacttaaatatgaatccacagtgagctgatttattttgggcattaattaggtattctattacattatcaatcttttgatattctgcattgctggcctcataagactgttgcctgagtgaaacacatctaaagactacctcaatctaccttaaagttaaggagtagcagagaacaaatggctgaataaagagctcctcacattttataaaacatttcattgtctactgcaagctacttagctcaatttaaatactgaaatccatctttagccttccaaattatgtttcttatcagcaatgttagtgtaggtattactctgaaaactattataaacagtgtaaaaaatatgtatgtaagtcatgaaaatcattctgtttcccataatgaaatcaaaagctcattgcgtgtggatgaaagaaaaaattgagagaacagagagatggttttaaggaatattttggtgatactgcaaaccaacatgtaatgttttaaatttatcattaattcttcttgatattgcttagaattccagccatgtaggacctaaaagaattgttctgggttgaattgtggcaccccctcagagagtatgctataagcctaaccctcagaacttcagaatgtgaccttatatggaaataacgtctctacaaatgttaaaatgaggtcatttgtgtgggctccaatccagtatgactggcgtctttataaaaaggtgaaatttggtcacagggacagacatgcacagaaagaagatattgtgaagacacaccgggagaagctggctgtatgactagagtgacgcatctgcaagtgaaagaacaccaaggaccaccagggaaaaccagaagttaaaagaagcagagaataatcatcctagagtcatcagagggagcactgccctgtcagtaccatgatttcagacgtctatcctccagaaccgagacaataaatgtcaataaaccaccaatgtcttcaaactttggtactgaagccctaggaaactaacacagggacattccagagcttacagtcccataagccaaaacactgaggtgaaaaaaggtgaaatcttgctgaccaagatcttacagttacttcagacagaactctagaatcaagagcctggttttcttgactttaagtttaggcctgtcatttccccttggagaactgacagattggaaatgctaaattttaaaaaagttcatcaagttaattcctttaagctattttatttagtgacttctgtttaaactaaaaataaatactgtgactctgcccttttgatttttttctaagtagccatgctccaatttctgaagcctttttaatctaaaagataaaattgaaattcttattaacttagttgatacttcatttttatctcatgatccctttactattacatgcaagaggatgtgaaatttaaaaactatgattaaaattttacaacaaaaactatgaggaaaaggaaagtgtcataaaataccatcagttattttagttaaatagtcattttctcataatgtttgaattattgtaacctcccctaaggtatcaatatttttaacacacagatatcacggaacatctcctttctgatgttacttgtaggaacaattatttatttaactaatttttgaaaccgatgaggccagagaaagatcttcatgcatctttgcatctctagcatctagggccacaccaaacacaaagttggtgttccataaaggatgaataatacatcaattcaacaagtatctatttatcagatactatgagctagacagtcctctatatgctgagtataggataataaagaaaacacataagaatgcttgtcattattgagcttatgttctagtgagtacagacagagaagaaataagataattaaattagacggtatattggaaagtaattctcctcagaactaaggagaaaaataaggcggggagcaaaatttagggaatatggttgttgctattttaagtagggtgggaggggaaggttgtagaatttcaacttgacatttgacacttgagcaaaatattaaagaatgtttcagcatggctgaaagctttaaatcctagttgtgtcttttcacttctaataaataagaggacactgattcccagtgtacccaggatggtcctacttttacatgtatttaatcctagtttaactattaataactcctcctgtaattcttactggaatctcagattgaatgatatatagtctcattatttagatcattatctctacataatagttacaaatgtttgttaaatgaatgagtttttaaaaaggtatatctcagtctcacattttatcatttttatttgtcaagctgtttaaccactttaagcagcaactttgccatcaatctcaaaaccgtgaaaccaagattgatgctgggagagtcttttaatatccttaggtgaaaaactcaaaagatacacttatgattaacatcaacaataacaattttctctcactatgtaagttttatttagtatcccccttgtctttcatttcaccgctgagacgaacatctttatagaggtccagatggtgcagagagattatgacaatgaaaagtagctcatgctgagggcctcaaggaaaaacacgtctcggcttgcctgacagaccaatttcaattacgtacttactatgcccctcaacagctgaggtgctccctcttaccatgccttgtgcaacttcggataacacctgaggggattcatggttacacacaaaagagaagcgacatggacaagtaaaattcttcctactttacataagtgatgccacacccattttagaaataggggattcatcacaaatgatccactctatagaaatctcatgttttctgagagtaaatcttaagagaggacttcagggttccttgttatgaggacattttgaaacatcacgtgtttgtcaggctggcccaaacaatttctacaggcaggttgtcagaagaagatgccttcacctcagatgtgtaacgcttacttccctcaacccccatttcagtttcagaaagaagtgctaattagaactggggtagcttttgcgagtctgcataaattcagctatgtcaacgttgcttctgcccctctgcaaagtggaaaacagtgatgttctacataccatgttaatgtagaaataacttctatgctcatttagccacttcagcacatccaggaaaatgacattatgaatgagctacattacctagaggaaagagacagactaaatgtggacttctatacaacttaatatgcatctaatgtacaacttaagcagtatcttccacactaaatgacaggcaagttatctccatacatcagtatatgttaaggacatgacacagctttattgttgaaggaatttgaaatttccagccatacctggattttcctatatccatttattagtcagctacttgcagaagtcaaagtaattgccacattcattactgtgtttgcctccatttaatcagttttgcttaagcttctcctatcctcctctggaatccagacaagcaaaggccactatcaaaaagtgacaatgttacatatgtatacgtatgtgtgcacattttgccactgctaaaatccctttatttgcgttatgtaaatgacctacgttagtcacaggacatttacctcaatttaatatctgttatttagagtgcttgtttctggcaagacaaatgtcaacagtttttgaaaactaagcactgtttattgtttagctggcagttataaataaccacatctaacatttctgttatgtctttgggaaaaaaaattgtaatttttgtaaaccaaagtgtttcacgagaaattgccacagattattccataagatctttctttatatttccagctcccattctctcctcttgtattacataactatttactagccctacaatgcacatatctgatattgaacttactgaattatagtctggtgagttgaataaattctttgtcatttttggaaggaacaaagtctgtgtatgcattgacacacctaagtttcattaaccaacaaacaaaattatatgcaaagtgtctttcattttgactacataatatcaaataactagcttgaatgaattttatagccccaactggacatcatctccatttacagaagccatgtgggtcaagtacccagcatctttctgggcacctcatctgtgagtggacaggttacctgtcaccagcaaaaatgcttaccaattattaaccttccattaaatcatcacccaacacttggccctattgtaattacccccttcaaatggcttttctattactatttaaggtctgatttagatcacagatatgtgttaatatatccatatctgggaacagtgaggagcagaaggaaaaacataggctaacaattaatggagggaagaatgtgtcttaggcaatttcttagatcatctttagagaatacaggacaactgtaagtaaattacacattgtacagcattgaaaagtccttggatttgactctataaggaaaccacagtacactcattaagttagcaccaaacagttatgggatccaagtcaaaattatataataaaggatgaatacaacaatggcattcagggtgtcagcattggaaatatctgctttagcgtctaaatatttatttgctatacctgggaactaatctgatatccatttgtgtagtttgatcaatttgtctgtgagtaataaattagtaacccactacaaactagaaaaaagtgtacataaatgacccccaaagtggttgacctctacatgttcatgggatgacttttcatagaaccccttcaattatcacattggtattagcaagaccaatatttttatttacagattttcatgtaagtgtgcattccctcccttttatgtagcagacattttatcctggctagaaaatcaggttttttagacactgtaattgttctagtcttaagattacagaataggattatacagtatacaaacgtactgttaaaaggattttatgcttattcctatcccctcggtatttaataagagagaatccaaatcatttacagatgtctgtgggtagtaaagaaaaagtctatgtgtatagtactcattatcgctaaagaaaaataaacagatctgtgagcgagaaggcagggaagatgctggctacctggaatataagacagacacatactgagacctggacccagggacaagaaaccttagttcattcaagctcctgtcttcctggaagggatatccctatggctcttcttccacaagccattattccacaaacaattaactcctttaattaaaacatttttcctccaatggagactttgcaaaaatgttgaaaatctcaagaatttaaacctgaacagaaggtacaatatttttcaatatattaaattcttgctcctgttgtttaagtctagttttcctgatagaaaaaaacaactggatcaaagaaaatgagatagtaatggaggaaagtgatattttggttttgaaataaagatgagagactttcctttttcataaggactttagacttttcccctagtaacctaaaatacacctttgccttttatggaattgtcccacttgccatttcatttcacttcatttcatttcatttcattggtaatgggtggaagcccatgcagtggtaattgccagtgagaactgaaactacctatccgccatccaggttactgtttacattaacacacatttactatttcattgctctcattggtataacaactattctaggagagccatgcccaggtaaacaacttgatggttaattacagaaaactcccaaaagactcatcaagactgcagtaggaagtatcaaccaacagtttatgccctaaaacttctctgaaccccttccctcaaacgtctcacaatgctatttccaccaatcctaactgttacatcaggatcattatccaatctcaaccaaaccctaacataaaaaggtcagccttaaaccaaacttccaactgtcaatttattctgattctgcctttactcttctgagaccttgccacagcctggtctaggtggtcactctcactgaaggaagcaatgtgtcgtgagaaacacgctcacctgtccaaacccaaagaatggacctggaggcacgaagaacagcgaaagtgagacttttaatactagtcttgcaagatcgggtgtctggtgagcaggcacatccaggcagtcacaacaggtaatttatctcctagcacataagtccttcccccagttcctcactaatcaagtactatggcgttacaatcttcccggacgtcacctaagtttcattatcccccttgtaaggttataccctgctccacttctccgcttaaattttgatttcccaataacaaaactttcttcccttttataggctgacccttcgtctacattctgttcacttatggtgaccttctaggtgcatgaccatgtggtttgttacatttgcaggctggctgccagtatttagatatatcatgccttgaaaatggaccattgaaattatattctcacatgtactcagtttgtcttatcaatatttcgtataggtggtatttggggagcagccttttgacatcatccatttcttacaaaaagagaagtgtgtgcagattagtgggaaagactgttctagtaaaaagtatacatcatattatgataatccttcctgaaggaaatttaacctctggtttcagacgccacccaggttttcctgctttttcgaatagtcggttcgtcattcctcacgtaaggaaagtggtaaacacactaccagaggccagagcaagtatcatggaatggaaagttataggagagtcatttaataaacatattcactgcatagtgtggtttagccatcctcagctaatcattttttttttttgaagcagaggcttattctgttgttcaggctggagtgcagtggcgtgatcacagttcattgcagtctcgacttgccaggctcaagctatcctcccacctcagcctctcaagtagctgggaccacaggtgcacatcatctcacctagctaattttcaaaaattcttttgtgtagataggctcccccatattgcccaggctggtcttgaactcctaggttcaagtgatcctccctcatcagcctcccaaagtgccaggattaccatgcctggctctcaactaatctctgaatttaaaaaattgcctctgagaaaagtaagggagagttctctattttgtatggatccagagaatcatttcaggcatcaacataataccaagaagaaccaagccacaaaaccattatgataatgagctaccatctacgaacacttactatttattgagtacttactataatccaggcaattagaatatactgtcactcttaatcttcacatcagtcttatctggtagatgttatcgtctcaattttcaaaagaagaaaatgcttcagataggttagggaaccatccctgaccacacaaactaaaactcctctattccaatcatcctctattgaaacgtaatgacttactttcttcatggcgtttttcaccatctgaaattagcctgttcatttattcacttgttaactctctgtttttccctcacaaatttaaagttcagattaggaacctcaccatctatctacctctctaactctactgcctagagtggtacctggaatatggtggatgctcgatctatgtcaagtgatacagtagcatattccacaaagaagcaagggctgaaatatgtgtttaaaaatttccccacataattctgatatgcttacctccctccccaccacagatatgtctgatataaatatctacgctgacacactgaaggaaaaataaggctttttgaatttttatattttctgagggaaaaaaaaccagaaaatttatgtgaaagctcactttgactgacaaaagtgatgattctctagcaatagcacagcccatgaatttgttagcttgcaatcaactgctaatagcacatttcagtattgctgactggctttagagattactgtttctgtgttgtttttcacattaaaatttcttttctagcatcagacagtgagttactagctatagggagtaaaaggcaggagtagaggaggtctgtagaatcaacttaaaaaattttttttcattgatttagtcagtaattccatacattttttctgaaccacgggtgaccttcatacacaaccaccaggttgttcattttgttttgtgttttagagcatcagtaaaacatacatggtcttactgaattctcagcaactaaagccaccacagatctgccttgaatcggtattctcaaagtgtcaggtgtaaggctagaagagaaggaatgctcctcactccaatcaatttgctcattcaaatcaatctactgcactcgccagccagttaacaacctctgggtcggcaagcaagactttttttttttcttgcttttaagatgtgaatcctgtggtatatttagctcatgctactgtgtttgtcttactgtctctcagaaatgtctttaccctttaaaagatccataaacattttcagaaatatggtggcaataaatagatcttacaccataaaaggcattctaaagaaatagcatagaccaacaaaaacagttcaaaaaaatattttctgggagcagttgtaccatggaattcctcaaattgtttttactacaaaagcaacaattcaaaaccaaattgcaattcaagataaaaatatgagtgatttatgattccctctctaggagaggaaaaatatctttcctttatccttcctttggttcatggccaagcccctataacaaaagacggattaaaaagagaaaagcatataaatttattttacagaagttttttgtggcatgaaaagtttcataacgaaataatgaccttaagaaacaggcaatcctacaatttttaagctagttttgataaacaaatggatagtcatggaaaagaatgattggataaaaagtatgctctagtggtaataaactgggagaaacttagtaagacctgtcggatcagattcttctctgtaacctttgccaaagataaggaggaacttatattctcggtattggcaaggtatctctgacatgagggtcttgtgacatgcatcagggggaggtgagaaaatccttcctaggttttgtggcctgcttcaagagacaagggaaggagaaggtcagagcatgaccttcctacttcagtgttctttttttattattattatttttactttttcaaattccttcttaaattattttaaagtaattgtgaccagaaccccatcacctcacttaaaaacatctggaaactggcgtttagagggatatatcatccgtcaaggtcagaggccaaacaggtttctgaataaagctggattgaaactaggtctgactgcaggggaaacaatactggagtgctgggaagggaagagtgtggtcgctttaaatgatacagaagcggggaagggaagtgctgggtagagaaaggccagtccctggctagggctccacccccacggacccaggtgagaacaggcatttcctgcccaaatgttgcatttcccaagactaccctggcccatcctgggcctataaaaaccggagaccctagcaggccaacacacagaagcggctggataccctgaggagcacatcagcagaagacgacacaagctgctggacggcgagagaacatcgagaggatgtccagggagcacgtcaagaggacgtggagggagtatgcaggtggaagagcacaccgacagacgtcggcacagcagccagccgtccaccatcgaaaggtggcggagtttggctggagcgaccagagaagagtccggctgcaaagcggcctgactccaggggaaaaccatctccctctggctcagccatcagctgagagctacttctactcaataaaacctgccactcattctcctagcccacatatgatccgattcttctggcacaccaaggcaagaaaccccaggatacagaaatccctctgtcggaaggggatctaatggatctggttaacacaagccgcctatagacggcaaactaagagagcatcatgtaacacacgcccactggggtttcaggagctgtgaatattcacccctagacactgccatggggtcagagccccacagcctgccagtctttatgcacccctagacgttcaaacagcagggcactgaagcagccagccacatccccatcgcacgccctgcgagggggacaagggaatctttcccatttcagaagctggattgaaactaggtctgattccagcaacaaagctccaagttgctggcactctctgccatttgtcctcctaatgtctatgctccctaggaaagttattctccaatgggtcaaagttatcatctagtgtgtacatgttcagaaaagctaatgacatatgttagcggagctgccccctacagctctgcttcggtttgggaggcaattggttgctttgctatttaccaacaatttcagaggcgggagagaagtttgaaggatttctaagggatagtgagggatgaaataaaaacctgaaggaaaaaccctgtggggttttcagttaacattccaaaaataattcagagactaggactggaaaactttgtataatttattttgcttcaaattattatattttatgtctcttataccctaaaatgattaggaagaaacagctaatagaacaaatacaccaagactggtctttggatgtggcaaaaatgccagggtagtctcttccaattttgtacactcttggagggaaagaactccagggattagtgcataaactggctgctttaaggaggacaaaacaactgccaccctgggatttataggaagtgggcaaaggagaatgttaaagttgatccatgaggaacagatttgccttaacgaaagcaggtcccaggcgattccccacatacagcgccttctctgtccaactaacccatcactcacattgctattcttgacagaaatgtctgtctgtctttttttgtggttacaacattcttcaaagaccaactcaaatctctcctcctccagaaaactctgttgatcactctctaattgccagcatctccagaatgcttactgcctatatatcctgaactacgtaactcggaatttaattttataagtgggcaagaaggtcttaaccttcccttcaacttgaccaaacttcacacaggtttgttactgaccacaggcccttgatctcccttttctaagaggatttactttagaccacttggaattgtaaattctttctgtgttcccttaacacgtaaatcttctgctagactcctgtcagttttacaacccaggaatgtctttctcaaggtcctgggagccatcccttttgaaataaaatcttcaggaatgctactgttactatctcccagtcttagggtgaaggtaagagcctaacctctacaagcatcaattagcaaacacagatggcctcgtcaggatgaccaacgttacccaattaagttttctaatacttttccacttgctcaccccagttatcaataactcttcttttgtttcagcacagttcagttctctctctctctcctcttgcaatagtcttgatccctgttgcaataatcttaagtcttccttacccgcttgtccaggataacttctctttgatacactgataaattcagtagctatttcctgtgtgctatctttcttagaccggaatataagatcctgtaactattttaattgaataatgtggtctttctggaaacttctctgttaatatagtccctctcttcccctgtttactgcttctaccttccccagtacacacacacacatcattgacactttatgactgaattctaagttttttaaaaaatacgtatttgtccaggtgtggtgctcatacctgtaatcccaacactttcggagactgaggcaggaagatcgcttgagcccataagttgaagaccagcctaggcaacaaagtgagacctcacttctacaaaaattaaagaaaaattaaagaaaaaaaaatagccaggcatgatggtatatgcacctgtggtcccagccactggagaggctgaggcaggcagtaggatcacttgagcccaggcagttgcagctacagtgagctgtgattactgcactgcactccagcctgggcaacagagcaagacctgtctcgacagaaaaaaaaaaaaaaaaaaggtgttttgttgttgttgctgttgtttgtttgttttaaatacatatttggacctcccttctccactgctttttaacaaggtgctgagtggctaggaaacattcagtaaatactagtttccttggtggtcaaaatatttttcttctctggaactcagaaaatagattacagatgaaatatacgggataagtcagcctgtggtagtcacctctaatgactattttgactttctttcttgcttcagtcacagtaggctcagagtccttctcaacatcacatttcaggcagccagcaccacgctatcaaattccgcacataaattgaaacctactagcctttcttaaagatgcccttttaatctaaagaatatttgattttaaactctgttttttgatgagattcatcaccttcatgcttaaagagccatttattatttggtaagtaaactagttcacattccttttaaaaaatcaatatcaaagattaaactaaggtttttttttttccacacatttgagttgcgaaatcactggcagagggtgtctaaaatgaaatagaccaaaatatgctcaaaaacaacagatttttgttttcttgaaagacaagaactttcctagtcagtacatcttctaaaataaggcccttagaatgtgattgcctagaaaatattcactgcttttcttcttaaagtgttcattgttatttttgaagaaatgaagcagagtagaatgttaccagttttaatagccatcacttttactcatcatctttctaattcctagggttcaaaatataaaggaaagaataaaggaaccaccataatagattatgaaacatagagatgaccacggaaatggtcttctaagataaaaatacatgcaatgaataattgagggagaagagtcaccatgcagtcacttagtacacattgtttcctgccttaagaggagccataggtctaggcatttattccccccaaaagtgggggtgagggtgaggggtgagggtgacgggataagactggtttcaaggtaggtttctagttgattcaataaccaaggtaaacagagaaatgaggtgattcgagtttctcagggactctcaaagacaataatatttaggtaaacaagaaatatataagtgttttaaggttttcataatttctattgctttactatttttttaacccctggagtaagtgggggtgttgtctgtcttgctgcaatggcctcctctctctgaaaattgttgcctcttcccatccacatgttgtacacactaaggtgccaagtttgtaccttgacacctatctccagctactcctgtacatcaggatacacaactcactcaagatgaccaataccattttcagaaaatttgcaattgagtgtggcttgttagtttaaaataaacggataaattcctaagcagtgagacaaaatctaaatgcaacacacatggaaataaaacatacaggagagaccaaaaagggagaaaaaaaaatagaacaaaaacatggctgcccaaggttctcatcggcttttctgtcccttcatcaggccctcgaaaggacccttaaattctgtaagatacgcctgtgtcctcataattcattatttttgctaatggtaacataaatgactttctgtagttaaaaaggaaaaagagagtaagatactcttaatagtgcctttgtttttataggcagtaacaatagaaaacactccaaaggacgcgaatgtctttttagccacagaaaactgaaggagaaagctgtgctagcaatgatctgaaaggcaagggacacaggtggaaggccagatggttgttgccagaaggggagaaaatgggccaagttcttgatacccttgggatatagagatgcaaggtgaatagaatgttggccaggagacacaactggccccaaaggatttgaccaggcaaaaggcactagtcactcatagctttacactatgacagttgaaatgctttttaaatgggttctagaatgttatacatggagaaaatctactctttcccctatcaggcaaaaaaggcaagagggaaacaactttaagcaagaatgaaaatgattttttcctctgactaattgaattttgaggagccttgaatgtccctcttatttcattttcttttgttgttacgttaaaataatcaaaaaatagttttttaaagtttaaaatatgtctgcctgtttactcagaccccaatggagggtcatatttctgtcaattctttgattgtcaaaaagagtcaggttctggtacaagatctttaacaactgaattactctgaattctgttttactgcttaagaaggatggttatatttgtctttcatagaatctcagagttggaaaaaatcttagaaaatgtcaaatttaatttctcattcatatatacacactacctgtgtcagtactttcttgatatttttccttaagtagactcagtttttacctcttaataggaatttaatagaaaatcaataacatgaactaaaaaccagtagcatatttcagaaatagaaagtattcatttaagaaaatgttcatctgaatatcacctaaaatcaactggcatacacatattaatgataacattttagttgaaatagagtcctttcctcttgccatctaacaaggatatcatgaaaggctttgtaaaatattgtgctaagaagcagacagctgttaatcccaaaactcttcactctaaatggaaatctctttcatctaacttggcatgttcttagtaaatacaccttaattcactctcagtgtccactattgaagaccacatatacccaggaagatgctgtgacacatgtaagaggagcagttctttgtagaataaatgctttgtaatgattttattctctgctatctgaggactatctgtatatattgactacttgcacaaacgaaacttttacacattctatatgctcacatttcttcaacatcttactgaacaaaacaatttcacagtaggataccagtgaggattttcataatgaaaatctgcatgagagcacagtaataacatgctataattgctcagagagaaataattcttcatgtccaagtttgccaatggcacactccattattatttgaagtggaacaggtcacttaaatttctctgtatccatgtcacaagtttcatttaagttgtgcgttttacttgcaaatttacaaagtgaaatatggtttattagaagagatagtactggaaattatttgtcagatgtcttttgtagtaacatttctattcacatcttagcttcatgcaaggaataggaccatataaaaataaagctagaacacaaatcatcacatattcatatgtcaggactctgagcttaaagaagaaatcccttttatatctgtgataaactcagatgtctagctttccctgcaaccatgcatatcccttactggataaattgctaaaagaggttccctatacaaattcttatccataaaagcaggcatcctaatctgtacttgtcactgttattttctttaatatgtaagtcaattatagcaagctttaaatggaacctaatgagaaattctcataattaaagagaaaacagtacaggaacttcctgccaatataaactgttaatttcgcaacacatgctccatagactttttccaatttctatattttattcacactgtgtgtttccccaaaataatgcttttaatgaaattttcccattgagtacaattttcttaatttaaatgataactacatttttaatctgaaacctctttaagatcctcattggcaaaagacaagattgagaatcacttccattttcaggaaattgtgtaaaatcagcatggcagatatagcaatagatgtttctctttattttccactttgagacctgggagcttattatttgaatagccatgaaaaacagaatggattaacaacaaaaaaagagatcatacacatttttcttatcagaagtcaaaatggtatttcacttaactggctaaaaatacggaatgtaacatctcatatattaatgcatcttcctgtaagatctgttccaatatctaagcatatccaaatgctaaaatccacagaacagtgcaaggaaaaaatactagtaaaacccaatggaaagctaccatcagaagctgagtgtattcatctagctttgcactgcagtaaagtacattccgtagagtacattctgaatagcaatagcctacctttaagctgcactgtcttacatatttcaaatcacactttgtttgaaagaacagactggttatttccaagatatctcatgaaaaacttattatagttcgaggaaaataagagttgaagccttggcggaatacccaaaggcattttgcttttctgactactattcaaatcttacttggcccaacttgacagccattctttctgacaacgttaagcggtttcagtaagtggtatgtaacctgcagttttctttcacttgggatactgtttatagctaattcaggcacaagggactagaaaacataatattttcataactataaattacttttatgtggtttctcaactactatgtagtgtaggatgatgtacaggagtggaagaaagaacaatgagcctggacaggtttttcaaatttgagcaacagaaacggatttaaaagacagattacagggtcctcactccagatatttgaattatgtgcagggcctgaaaacctgtgttttgaaaaatctctccaaattattcttatattggagtaccttctctagacacaccggggttgagattaactaccaaatattaatagtgtgtgactgttaagaggaagaacgtggtgcagtggggtggagtgtgggaggtggttcaagatataagggaagagaatatattactttatttattacttcattcagtcatttattacttcaagtagacttcataaagaaaactcactttgctttgaaagtatcttaaagtataaaaaaaactttaactttatacaagcaatgaacgtatgtttcaaatatgcaaattaaatattttaaatattccaaaaaaagtatccatcttaattttatcaaaaagaaaactgagactcaaagaattccactgacttgtccagaattacacagctaacaaggtcaattacaactaaaattcaaattcaattctgcaaaacttatggtctttgtaatactccatgctgcttccttcaaatagtaagttaatttatcttggcctcactttaccaatggccaaaatgaaagaatgtgccagaggttgagaaatgactaacccagtaattatttaaaacatccaagggaaggtgtatggcccaatagcaagatttggccgaaagaaagtaattaggaaaagaacttcttggaaatttaaaataatttttttctactttaaacaaatatccaaaataattttccttaatatttaaaaagaggaaaggacaaacattcattgaatatcttactatgtccactgactatcctatcctgcatgctatacttaaagtgtattatttgatttaatcctcaagacaaacctctaaatatagttgtactgaatacatcatacacgggaaaaagtacggttaaacaaattaatttgtcaacaattgaaacaaaaagtccatgttagaatctataccgccttcccttaaaatcctatgtctttctaatatagagaaagacaacatcatatgcaatgagcaacagaacacgagtagcctttttttttttttttccaccatggaaagccttggtttctaaaaatgcattgcatgagacctttgtaattatgcagaagacagctggttattctcagttttccctgaggaaagaatgggagataataaacttcaaccatacttgtgacatttagattactgggaaataatctttagaagtattgggcttctagaagtattaggcaacaagagcttttagagtcaactatggatgaggaccttcaggggattatcaccttaaaaatcctggatcatttctcacttactggtattactcatgcacacccctcctagcttgaaagcaagagaaagtctaaggagactgctcagcagcttgcagcactgtaaatttatgtgcaggcactttcaaaacaacttcagaaaacagatttccctttcaacttacttgtttttttcatttagtgtattctatcagagcaagtccaagacaaaagctttcccaagagaaaagctgagataaggaataatgtattcggtgaaaatatgtaagatttattctaggtttatcattcagaccaaacctagtatctataaattatccacatttccccctaaattttatatcatcacaaatgtacatcaaaacaggtattcctttttaattgtcgtgaaatatgttatctcaggcaagtgtaataacttgaaaaatattcatgatacttaattacttttgttctttaattcatttaacttccctctgagggtgttagcatttcctagtatttcagaacaatggtttacaagttgtcttccacagcaatatcacgttcccatgtaggaatccctatggacatgattagtttagatataaatgaggtttatcaggaataattcccagataactagctctagcctatcctattctcacagtaattgtcatatccagtgctccagataccacaagagacaaatgcccttttacattgctatcaagggccagtattctacatttatgtttagattaagttggctaaacttttgtatcagtgtaagtgctaacactgacgttttacagaagagcttgcattttagttgcatatgtattaaatgatttggagactattttaattactaagatgctttgttgagagattattttgatacatttacttcggggtaaagttgagctgtgtgccctctgagtcaatattaagaaaggagagaagaggggatttgatattgtcaggataaactaaaaaggaaagaagaaacttggttggggcaaggatagtggggtgggggaaatggtgaagggtcagttaaaaagccagtggtggctacatggctgggaaagaactttggtgagtagatgtgtctagcactatttttttatgtggttgatttgaggtgtgaaaaattagcttccacccctttcctttgtagaggatgatcactggtaaattatgtgtgactcactgatgcttttgtggaagtgaattctctttggagagcttaaacagaaaaatgaagaagcagttaacatctaggttttcgaagtatatactcagagatcaacatctttgaagaaagatatacaaagccattaatttctctagagagtgcttcatcatgccccatgagtttataattcttcaaggcctaggtcaaggtctattttctccaagaaactgtttctgattatccatccctcggtgatcttcctcccttatgtaaccctacaattctcacctcctgtgccttttaatttagcatctaatactgtaattcataaaaggcctaatcaaaatagattaaaaaaaacagacaatggaataaaattcagaccaaagcctagcaaccatcttattcattctgcatcggtactggctggtgacagcttacaccacctgctatacaatgatgcaatccaatgtgcgagaatctttttttgttacacctttacatgtgctttcaggtgttttggttacagctatgggtatcagaattttattgatgggtgagcattttcttttcctaagacctaaaagtagcaggggaaaaggctcagcatgttttacccaaatagattttttttttttccgaatggataaagacaaactttggagccaaatgcttcattgtttgtgcataaatctcaacaggctggttgaattaagctctacatattcatcaacaggcattgccaataaagacacaaatacaacaaattaatatttttcaaaactctgtgtcttcagaaaatttctatgaggctttgatgaacaaaacacaaacataagaagcaccaccattgtctcactgtttgggcgcaatcattctcaaggacatctgtgctgattccttttcaaacttggatggctgctatctgaatcaggcccagatgcttttgttggaaaaaaaaatctgaattttggggttttcatttaagttgagtaacagctttctccactcaaacatgcaatttattttacagtgtgagattaatagcaataattgcctgggaaataaagaagtcttgaagaaaaataccacatatcaaaaggctacttaaaaaaaaaatgcgggtctttgctcaagcaatgaagctatgcttcttatttgcaaatcattctattataacttcagtcatactatgcagactactttaaacatctgaaatttaacatctgaaatttaaacatctgaaaattttaagtttttaaatgaaaaatcaggagggttgatattaggcttgtaaatgtaatatttgcatttacatatttctatataaaattgcacaattttatctagaacagaacccacctggcagtcttaacacaataattatttgcctaggggcccagaaagtggccatcagtagagattcaatttttctgagatgaaactattgagtgaagtgcattccctccttgataggaagcccaactgagagataaagttttgatggattcattaacagcccggcctgtaaatctcatctccactgagattttaaagcaaatggcattattctttcattatgctgaggcccttactaccctgttccgagttggtatttgaacctaacggcctaagaatatttataaagtgaagaaaagtaagggtacatttttttttcctttattttttccctcaaggcttgtctcacaagtgcaattacctggctctgggtccaggaaagccaggtctcagcatacagaatacattcacactgtgtcttccagcaacccaccagacctctgcatttcccaaaccacagtacttctcaaaccagcacaccttggcagtgctagggggcagtgcacagaagccagatttggcaagagagaaaagggaaaatatttaagtgtcaatgtaaagccacagtacactgcatgattttattcagctcataaaagggttatttctaggagaagtaaggaattctgcaaacatataagacaaaatcagaatgaaatgattattcaaagaaacagaaggggtgcaaaaaaaagagatgtctcctaagtcttttttgaggggaaaagggagaaatctaataaatctaacagaaatgtttacaggttggttacaggtattttttttttttttgacagatgaacacattggaaaggtggtctgggacagatgtcaacaaaagggtttgccagtataatgactgcaaggtgcaactacagagtacccacagttctccatctcaagtaaatcaattcagccttgagaaactactttgacaattataaatataaatatatacacacacgcacatattatatacacacacacattatatacacacacacaattatgtttgtgtgtgtgtgtgtgtgtgtgtgtgtgcaaaatacccagaatgtcacttccctccccaaactgatatctgtatacatttctatgttgtattggatacatatttataaattcaaaatttggagatacatatttatggataaatacctatctctttgtaaactacaggcaccaatatagcagtttttaatcttttaaaatctagtttagcatggaaaattatcctcattcttgttctttctgaaaccctcttactttatatcatagtattttgatgaaaaagaatacaagaagatcataactctcaatcaatcaacaattatttggtggtgaccagtaatctgatcagccttgtgccagttgctttgttgataaaaggactcaaaaccactgtcctgacataaacaagataacaacatcagaaaaaaaaaaaattgtgaggtatgtcacttatctttctgggtctctacttgcttgatttttaagaatcatatacaaataacagcagcctcgtatttttattctgtttatagaaatcagagattatatatgattttagagaagggagaaattagaaaaaactctgtggtttgaggtgcgacctgcagaggtcctgacatgtggaagggttggggtgaaaagatgaaaggtgaaaggtcatttctgaccaggaaaacaacacattgcagaggcacagatctggaatttgtatagggcatgtgggcacttgggaagaggacattaaccagctcttatggaaaggagtagtttgcagaggcaaggctgagtcaggcagaggtagtcctagaaagccacacaggagtttagtttggatgcatgggcaagtcatgcatccattcattctacattcactgctcatttcctgagttcttcctctgtgccaggccatactgaaaagcgatgacccagagtgagagaggataggcatggtcccagaccacatgaagtagaatctaagactaaagtgccagatttaaaactgtatataagtgaagagtcttcacattcaacatgacatacttataaagattttaaaaaggtctttgatgtttcatagtatctaacgttgttgcctagttctctcaaagcataattaaaaatgtgattctcttgacatgttataagcaataaaatttggggagaggaggggatttctagatgtcaaagtaagtataaatgggcatagacatgattaggttaggctgaaaggttggttggtcattgtttacagttggtggtagaacatgccaagttagatgagtcccaaagagattttatagctatgagatatcatcttgtgtgttcctggctttcagattggtacttgtcaccatggaattctagagcagcaaggaagtgcagatcttattattttgagacagagtctctctgtctctcaacctggagtgcagtgagatgaccatagctcactgtagcctccatcttctgggctcaagccatcctcccacctcggccttccaaagtattgggattacaggcatgcgccaccacacccagctgccgtactttatttagtttcaaactctattttctgaatgatgaaggtggaattcaaattggtcaaggattttactaaagccacacagctggttagttggcaaatcctgagctaaaaataatgtatactgattcgtataaccacccccacctttaccaagtttgagatcagattttaagaggatgctgcaatctctattctcttcataaccagaggagcgtttagtccatggtcctggttcccacagtcaaactcttttggatctataatttatttgtgaatgaaaacaagccattacaaagtggcaataaagcaaatgtagggtgtggctatagcaataattaatcataatctcaggtcccaggtggttcatcttgagctgatatttttttcctactgtttgtgacatgatgaagatataaatagattttaagtttaaatggaaagcaaatccatttctctagcagttataagtgtattaatagattgtttagtcactcgaacatgtttataatctgttattttcttaagaaatactctcagggctgggtgcagtggctcacacctgtaatcccagcaatttgggaggctgaggtgggcagattacctgaggtcacgagttcaagaccagcctggccaacatggtgaaaccctgtctccactaaaaataaaaaaatcagccaggaatggtggtgggcgcctgtattcccagctacatgggaggctgaggcaggagaattgtttgaaccagggaggcagaggtttcagtgagcagagattgtgccactgcactctagcctagaggacaagagcgagattccatctcaaaaaaaaaaaaaaaaaattcatgctagtatagtaggaatcagttgcagagtcagggaagctaagctttgcaagaaaccttggaccatttttattcagtggtatcataaatttatttggaggtacgatactttagaatacacatatacacacacaaaacacatttgcttattatgtcagggggttcctacatcttttgaagtctctcttcagacccacccttagctaagaaaactgatttggtgcagtcatttaacttggtacatggatacatttctttcagcattaagtggtctaaggtcaactcatgtgtaggaaggtcctgagtcaggaaaggaggaatactagacacatcatgttcatttcaggtccaatcccattgcaacgctgggcaagataacttacagtctttggccctcaggttcttcctctgtaaaaaagataaatgatcacagtagtacatgactgctgtttattgagtacctactgtgttaatgctaggcactttacatatttgctttcaattactgctaatatcaatattttgtagtagacatgaatcaccttttcacagatgagaaaaccaaggattagaaatggaaatgtgcctcatatcacgaagtaaaaagatccaggatttgtaccatttgtctccaaaatgcatgtccttctctatgatatggaaattcctacttgtaaggaataaggcagcctcatttatctgcctacgtgaaaagagccttcaaaataatattataaaaaccagagtttcatatcaatgtgatatagttgagcatttttataattctagagaacagaatgaggcaggaatgagagggaatatgaagaaaaggataacaggataacattctttatgatggggtacctgatttttggtgtcactgactatcatatttggtaaggtagtttataaaggggtttagaaagttacactaacagcttagaagtccaataatattttccttctaaagtattcaaagaaagaacaatgagataactttaaggagagtaaactggcttttcagatgaactttctgaaatgattatcaaaaagagctctagttttcttatgtctaagataaattattacaccaccgcagcaatttcaggtctggactgcttcctgagtgtagccccaaataaaggtcctcaagacacttccaaatatgcaaatcagctgagtgggtttgtgtgtgtgttaaactgtattgagtttcagagtaaacctgcttcagagtcagctagggaaacaaaccacagtttgattttagcagagtgaaggacaagcacagtccatcccctttcacaccccatagcttcaccaggtatcagcacacagccctttaaagattaagctctaaatggccacactttttgagactttaataaaaaagctttttacagtatttctcctaaaaatgtctgaaaacaatttgttttcttgaagccaaagcacagaactacagcttcccctcctctccctattattgtgatttccaaatgaatggcattgagttgattgtttatcatgctggataatggcttaatttattacagaaaccctagtcagacattaaaaaactgtaaaagcccactgatctaccaaatccttttgagacatagggcctatgcgcattaaaaacctgctagaccatggtgagcctatgagataggaaacttttttgtctcattagcaccaggatttaaaaatacagcacctcctcaggttgaaatgccaagcttgagactgctgtgtgcagctgggtgtagaggacacctggataagtcttaatggtgtgtaaacagcaggattagtgtttctgagtctccgctgtgcagagattttccgttggcttactcaatttacacacaaaaggtcttaggttcctttgggaaaaaagtccagctagacaaagaaaggacagaggaccttttcctttcacagggtatttggattcatgcatgcattcatccatttaagaaatctttcccaaaacatcaactaagacccaggtactgtgctaggtatacagtggtaagcaaaatcagacatgtatctgatcatcataaaagctaaaaaagctgtgggtcaaacacacacatgaacttcagcctgatttcaagctccctgaatttataggaatgtcttatttatcttttcattttccaagagactagcagagtgacttataaataataggtgactaatacacataaaggtaatggaagtttttaaacaaagtgtgtatgattagttttaaagtagtaataataacaaccattgtcatttattgaaaccatactatgcagcaagcactgattactcgaaataatcttgaaataaattgataggagacatttaaaaatctatgtagaacccacaaccccccataatactgccatatcacaaaaaatattcatttctcctgcgaagctgaaggcattaagatgctgtgtgtactgatttttaagaaagtgtcccaaaatctctgggccttttccaaatgcctatgtgaacagaggagaaatttgcagtatctgtgagacgtcctttgaaacttggtttttgatgagtgcactgtgtccaaagcagtggttttcaggtatcaagaagcacccggaagaactgttataacacaaattgctgtgctacatctccagagattcagcaagtccagggtggggcctttctaacaagttctcagggaaggtcgatgctgacagtgtagggatcacattttgataacctgcctttataggatttcagtttcaaagtctgagtcctactatgagaaggctctctttaagaatgtataagaggaaaagagtgcgtgtgtgtgtatgcggtgagggggagaaaaatgaatggatgaaggcctcagaaaactctctgtggttcacctccatcccagaatgagcaattgtagttctagggtctacagacaggtgaaacgacagaagacagctaggaacagtgcaagaaatattcaggtattatctttcagcttgattactagaggataaagggaaaggaagctcttagactagaaatcccttgctatcctgtaatttatatttcattacaaaactaaagaataaaagtagtcttatccagagaggggaagtcagtccaaattctggagattcctaaaattagtgtgtgtctctgtgtgttaaatcatcccagttttataaaaaaggaattgaggctcaaagaggtcattttggaggatctccaggatcaaaaaggaagaacaccaaaagctgagtctggtccaggtctctctggttccagagtgtatttacccattggaattattctgtctctgccttctctaagtggctccaaatatataaatgtgtgtgtgtgtgtgtgtgtgtgtgtgtgtgtgtagtagcacctggcacacagtaattcccagtaagcatttgaaagttttttttttttttttttttttttttttggtggtgggggtagtagcacctggcacatagtaattaccagtaaacatttgatagtttttttttggtggtggggggatgtacatacatctactattaactgcttactgggaatgggaattactatgtgccaggtgctagtcatatttatattagctcatttaatcttaaaaacaatctgagaaggggatcttacagaatcccaattgtatagataaggaaatagaggattaaataaagtctcagaccttggagaacttgcaaaagaaaacaaacaacaaggacaaaaaaacgaactccaaaccaattttacctcagagctagaatttttcatgttttttctttcctaataccagctacctcccaccatttggccaaattggtctgtctctggctctttatttaattatgtttctacggaattagattatcagtatcaaatttaatatgtaaatgaaatatccaagaatataaagatttctactgttgaatatcaattattagagaaaaatgtgaagagttccaccacattgaaactgtggctaatggccacattagggatgatttatatctatattagagtttcagttaatgtgaaataaaatgtatccttagttttttccattctcaaaatgaaataaacctgaataaattattatgaattgtgtactatcttacgacagctttttgcagttaaattgattaattgttattatccaatgctgaaatcattttcttgtgataactgggcaagtgagttaaaattttctaaggagaccaaaggcaatccactctgacacaaggtgaatagttttaagctaaaggtgacttccttgcagtatccatggctgtcatgaaagtagatgttaaaatatcagatctatttaccctcttcttacttcacaaaacagaatgagttatatagttataatttacacgcctctttaagggcaagtacaatgccagtgctggtctgtactgacatagagataacactggttaacaacggaatgattatattataaaaagaaaggacaaaaaaattgggttagtattagagtttatggaactcagagaatgaggccaattcatgctactctggagaattccaaccagctacaagcacactttccttaaggaaaaaacaaaaactgggttataattcattaaacttggctccttgaggtctgatgagatgagcacagggaacctgctctcttagcacaatcactactaactgacaatgtagtcgagaacagggtctgtttccataatactctcttaagctgtttgctcccaatactcttttaataataatgaaataaactaccttctcaatttttcatttcagtgctaaaagttacttatatagttttctaaggaagttcaccatgagcattgagtttcagaggcatgttgaactttcttaggacatctcatgagctttttacttttgttttttcacttgatgcataaaacccctaacagatacagaatatattcttctttaaacatttctaagggccctcttcccatctcctatgtagtgacagggcaaaaacactgagtcctagatgctcatggcccctgattaagacctgtggttgggaattcatgggaccctatttaaaccacctgctttgatggctcattgaaatcagaaggagatttttactctctcactgacactgtataaatgttagttcactacagggaaatggttgagaggggacagacggagaactgtgaagaaattaaaggacctttaatggattaaaaacaaaaagccattctgctctccagggtgcacatttatttagttagattttcttaaaaatattctcaagcctccaagttcaatcgaccagaatgactttaaaaccttttttttttcctgctccattggagagatatgcctttacatgattactttaatgacaattatctatcaggtaattgcaatgtaaagctaatatgtaagtatggcagaacctgtgaattttacaagtctaatgtctccagggtattttaaaaagcactttggctacatttttaaatctaactaaccattccaacagacatgggagttactactcttgggcaacattcaaaagaatgggtaaagttaaaaagagtaattttctgaagtatttttgacagcaattaatttcacaggggatacattcatatcctaaatctccaggaaaaaatttttttcactgtagaacaagatgcactttttgaagagaaattcctttactagagtttatactttataatgacctgaactgtagaagaaatataattaagtggattcattactatttcttttaataaggtaacttaattgcattttccccaaaccgcagaaaatttacagttattgttcaggcctaaaaagaaatacagttaatcaacctatgtgtccatcactggatgaatggataaacaaaatattatatatatatatatatatatatatatatatatatatatatatatatgcatacacacacacaggaatactatgcagccataaaaagaatgaaatcatatattttgcaggaacatggttggaactggaagtctttatgtgaaacaattcagaaacagaaagtcaaatacttcatgttctcacctataagcgaaaggtaaataatgtgtatacatggacataaattgtggaataatagacactggtgactgggaagggtgggatggagggagggcgggagggggtgaacaatgagaacttacttaaatgggtacagtgtacattattcaggtgatggttatactaaaagcccagactccaccactatgcaatatatccctgtaccaaaactgcacttgtgttccttaaattgatacaaataaaaaaaattaacttcaaaagaattacagaaacagagttacagaaacaagttctatacataagcatattatcataatttattgttaaagaattaaaattattgtagacaattgatatttgtggtcttttaaacttgatattaaaaattgagatcaaaatttcagagagactcattgacagcattttatttccatgttggcaatagttctcttctcctaatggtcatttgaggaaacattggtttacctctttccccatctctctgtatacacttaaattcaaagtataaattgtaggattaccttaacattcaatgtatagtcagaaaagaaacataattaagaaatataaaagcttatcatcttgaaaaattagttcctaaatgccaacttggagattttaaactaattttaaggcaaaacaatgtaatacaaataaataacaaaagctgatattcttcagtatagaaatgccttcatgttcatagtccaatcctctttaggccttcagacacaatgccattgtgttttctcccttttttaaattcatgtgataatattgttttcttgctgacatgtgatctctttttataaggaaataattctttaagttcaataatgaagcaattaataacagtctgaaataatttagatggcattggtcctttcttctggaaaaacaaaccaattcattggaattctcttattcaaagttaaaaggctgaaattactatttatgtaataaaataatgagaaattaacaagcaataccttcacgatgacagaattattattactattgctgctactactgtaattctcaaaatttttccttagaaacaatttggaagaaaatgacacagttaaggtatcctgacttaaaagtaagtcaaaaaaataaaaaaaaaagatgactattaaagttttaatcactctgaggagagagaatggaaaaaaccacatagaagaatcaagctgaagatacaagttaaatcaaattttaaagaacattgatatgaagctgtgaccagttttagaggtttaattagtaaggtaattacatatagagctactgatgacacacagcctagaggttctatattaatgaaaattaactttaattatttaatttgtctaattaaaaggtagttatgtcactagattttgaattacattaagccaagtacaacacattacatccttgtgtccaccaaaacccaacacattcttagccctgttattaactcaacataagtgagttgatttgaaatttctagttaattgacaatttaaggcattaaagttgaaagactcaactaattaaatacatcattcatttattgaataaacagttgctgagcatctgctcagggctaaataccatgacaagtttggggaatgcaaaagttaataagacacttaaatgctttttggcttttaaaataacttattagaaactgtcatttctacattctaggtactcaataataatattgtaattggattctccagaattatcataattttgccaataggtaaataacattttctactcagagaaatctgtgttggcatatcaaatatgtgaaatttggagacaaataatataaaaatacattactctccaaattcctaaattatcaaatttcctagtataattattattcatttattataaaaccaaataaccataggtttaatcttttaaacttcacttacccaagcttaaatttctaccatagttcccacattgagtaaaatttagtcaatcattgagtcttcttttaagaggtgggtgctcgttatgttgtccaggctggtctctaactcctaagctcaagggatccccccgcctcagccttctgagtagctgggactaaaggcatgcaccaacacacatggcagtcaggtcttattttgtacccagacattctcaatggcttcctatgtagtcctaattacagctctgcatttgcaacttactattcttttgcataaatcttccagtttaagtttttcttgactctgtctccagaaattactttcctatcaccacacttttgagcttgtaacccatgtgttgccctattatcttcttcctttgcctccaatgatctaaatgttgcctggattcttggaaacattttcccctttcctggacttccaaaaagaagctcctcaccaccctttcaatttttcactcatcacatcccttttgcaggatgtcgtttgcaaaagaccatatgcaatctctatttagcatatacaatttatcatcaatatctcaagctctctgtggttaggacctatgtcttggacttctgcacaacatcctcagaagttactactctgctataaataaaatctcaatatatttcattgaataagttaacaatagtttttgaggtgctgtgggattttaaagtacattctgaacatatgtgcattgtaaaagtgttaatcacattttattgaaaaattaaaattatttgaaagtttcatttatcagtagcatataggataaatctttgttaatcagaaaagtctattaatcagatctagcattttgaattgttccgaaacaataaaaaatagagatctacggaatttatctgaagtttttgctcagtttattttcagtttatctttactgcaatcctaagcaagaatgctctcctattctctattatctttataatttatcaatttattatttaaaatgtcctattcctgtatgacattttacaaagctaaatgttttttctaaaaagccctatattctccactaattagctgacaattatatgatttatcatttttaatatggctttctttcaatttattcagataagcaggatctaacatgggcttataaggtgaacaaacgtagaaagttctaaaatattatgatctcccttcaagcaggactttataaatgtgtacaataaattatgctaagtaaatgagataattattcattcaatttaagagaaatatacaggcacaggccacattgttagatctagatatgtttaaggacatctctgctgctatattgtttctaatttcaaatgtatttaaattgacccttttttggtggagagtgttgggagaaaggagaaactcaaaacatgccgaggggtcactaaaagcatattaaggagcttcaaaattttcaagatgaatggtatagaaggatttctaagtttagaaaaattcacttagtttaagcagagatgtcacattcaatttcctcattcatccattggtctaaatatattaaacactcactacattccacatattaaaatttagagtattttaaagcccttggtatataatgttcctgttcagtgaagaactccattttcatttctaacaggtctaggatatgcttatgtattttaatgtaataaaactacttcattttccctgtagagaatttgaaatatttagagaaagtgtaagaaaaaaaattctcataacaaaccctactactcagagacaactacctttaactctttcacatatttcgccctccattctttttcccctttatgtgtgtgtatgcatgtgacataagttagttactcttttatatatttttcatatttcttctttatatataatgtgagtcatttcacagccactatcttcacggaacttacgattttgtgggagagagagatgtgagaccaaaagatgaactaaaatgtaatgtgtaataatggtgattgtacacagtataacccatgcctacacaagggcccatccatcagtctggtggagtgcagatatacgttgttgagctgagggttgaggagtgtggagtacttgcaggagctaggtgatggggatgttgaatggggagcgagtagtgatattgggtatttagggtctaaggcataccttggaggtggtagaaaactcgcagtagaatagcagagtaatgtttgggtataggagacaaagtagaggttgacggggctaccattttatgctaaatagtcaggtctttcctttaggccagggctcaagaaaataagaataaaataaaaataaaataaaataaaataatcactctcactggtttgttacacctgaaaatctcaggcctgatgcagtggctcactcttgtaatcccagcactttgggaggcaaaggtgcgaggaccacttgtggccagaagtttaagagcactctgggcaacaaaacaagatcttgtctctacaaaagaataaaaaataaaataaaaattaattagctgggtgtggtggtgcattcctgtagtcctagctacatgtagtgaagaatttacacggtcaacaatcaaaacttgagattgaagcaggaggatcatttgagttcaggagtagaggctgcagtgagctatgattgtaccactatactccaacctaggtggcaaagcaagaccctgtctctaaaaaagaaaatataatttcccactcccccatatgatgtctaaaagttagatcacagacactggaaccaaattactgacttagaattctagttccaccattcagtagctattgggtcatgagcacattaacctatctgtgcctcagtttctttataatgaagtaaccataatatctagcccttgaggctgttataaggatcaaatgagataacatttataaagccgtaagaatggtgactggcatataataacactatataaacggttgttaaataaaagcaatacccctgtaatatcaaaacaaacaaatcttgatagccaaaattcctgctacagaatagaattcatgtgctttggggtaattgctaatgcactgtatagttacttctaaagaatttcatgattataacattctataatgaatcaatataataatagcatttctatggattaatttaaaagattaagcatccaagctgattataattgagctcatttccagtctggttaattctggcagttttggagcagcagagtacttaggttctgagttatttttcattttgggcggggtggtttatgctctgaattaaccatgagctccactttagagaacttgaaaaaattgactttttagaatatttttggcagaatatacaaattgcttgataaactgcaaaagattgagtaatttttcaaaacacccagactgcacctgttagatcattattatttcagaaattccatattgtacattgaaaataacctcacaagtatattttctgtatttatggccaagagctggtcattggagatttatgatgctctgcaaaaaacaatgctgacctggcaagtgcctccagggaaggagttgctcagaaaccagtgaatgaaataaattgctattaattatggtactaagtcttaactccagcccaccccattggtttgtgacccaaatgtttttaaataccttaattcaatttataataatgctgcccaagggcaaccaatttgcctcatatggttttctaggacacaacgtagtattttggcacactgcacatgcttaaaaattatttgttaaattagttaaaaataaatcaaaccaaagtcatcaacaaagtctgtttcctattgagccatgaagtgttttgcaaagaatgactctcttgtcttagttcagatgccatcttgatttaggattttcacttatccaacttttcttacaaggaatagttaattccagttattatttccctagcaccgttatctcagatagtgtaaactgaatatcaacacatacatatatcatactatcaattctttgtcaggtacttgatacactttagatttaatcctgacaaccacactgttttaaaatgggcatttttccatctcttttttttatagatgaaaaacctgaggcaccaataggggtactggtcacacaaggagaaaggggagacttcaggattcttttcttctaaattaactttgaaatcgttttactgttagcatcacgttttgagaataatttttgataaatgtggtatgcttttatcctaaaaagtgtattttcatctccaaatgaaatagtagtaataaaagtaataaaactttttatttcatttttttctagcaagagatggtcttacttttacttccaacaggagaattcttagtcaaagaaaaataatctttaacacaattaacagaaaaaagttgaatctcatttcatttcctgtggggccctcccaggcctaccattaatactcattgctaccattttgcttttctttggtccattaagtaggctgacagtccttcatatttttatatactacgttgagaaatgggaattcctgtcaaatgtatcttacgaataagcattactataataaaattattaaatgggtagatttagatgctaaaactggtagaaccacaattacaaagtatgtaaaaaagccccatcagttgtccatacacaaaagtggtgttatatgttagtgaatataaaatattttatactagagcattctgctcccaggagttgtttttgttgtgttctactttgttttaaagagaaaattctctagtagtatcagactctcccccaggacaaactttcagtttgtttcttttgttgttttgagagaacatatttacaacttaattttcttaagaggggtacatttttttgacatcactatattacaatttgaatcaaaactaagatgttgaccatataacttcttcactgcatgtaagtatatcaaaacaccatgttgtatatcttaaatataaataaaaacaaataaaacctagtataccaaatatggagatactaagattctactaatgtacactctccaaccatgagacaatccatctaaagatgaaagatgagtaacatatattagttcctcaatatattttagcaattattattattattactattcttattactatatattcaaatctttatcctaaaatccagccatttttctccaatgcttttctttttatggttttcaagcttgctcttgggaaacaagataagatttctacctcatgcctaaccaattacaataggccttaaaagctaagctcctcaattgagattttatttcttttcccaattacattctccccatgggattttcttagaggtaagcagagaccaacagaaccaacagcttgatatccaggcataaaagccccaggaattatgattttgtgttggcagatggtcaaactaagctaatgggtggcagaagcaaataacaccccagttaattttctagctcaatcaattctgatctcatctcaggcttatagcacattgcactgtcagcccaaatttaaaaagacagtacattccctcaccctacagaatgcagcaatagatactacaaccagaggactcaagttctaagcagacagctttgaaagtggaagagaccctgtaattccatgttgtttattagactgactcacataagcctcactcctgacagggattctgtcatgctgggtgcaggagtggaacacacctagcaaggctaactactctttttccagcccctcctggattgtaactattaagacgggcaggcatgatcccaagtaaagatctcaaaattcaaactgttgaaactcagaagtacatcttcctcttgatgaatataaaacccatcctagaggagaaactaagattttttttttctacctaactgaaaatatggcaagggattcttttttgtttggtttcttagaacatttccaaaactctgtgacaccattatcatgatgaaaaattccacttaggaagtcacaaaaaatactgtggtctgatgctggggactattgaaatatttaaaaacacaattatttacaactaaaatgtaattaagtccaacaaattcttttttaatatttactatatatttcccactgtactacacactaggaaagcgaaggtgagtcaagcccagggcctgatgtaaaataaggacattcacctttctggttctctttggattacatgtatattataatgcataatacaatatcagtatttgctcatgagttctccattctttcaacgtcttcttttcacatctcattatggtaagaatctgtaattctaatgagatcaaatatgccagtttatcacagtaactaatatacattccaaaattgccaacaatctccacatttgcctaccgttcggctctttatttttaagcagtaacatggtagaagagacacattacttctttatgttcttgtaagaagataattattcccatctaccccaaaatattggtattatgaatgacttagggggtacatatgggagacaaatttaaaacaaaaaataatctgattcttttattggccaaaggaaatctgtttgcttctgttaaaatcttataatatttttaacagagttcagttacttcttattttcttcctccacatatccacattggtaattgttacacttaatttttattgaactatttaaacttcattttaatgttttactgtctctttcttcctgttaaaactttactaactcatctaaaggatggtgtcctagttcaatgttaatgatgtgcttgatgtaatctcccactcaatacacacacatccccaacacacacatagacacacacatatacacacacacacatatatatacacacatacacacatacatatctacacacagtttgcagtttattttttctattgattattcttaaaaagttaaacaaagatagagaacatcacaaactacttttccgttctagtctcagtgcttcacaggctagttaattctaaggtagaaaagatggtaaggagattagttgcagggactagaaaattctactttagcagctgagactttttctctgcctgctcaaacactgaactttttccactcccagatcaagtccaatcacatcttttctgaatcactgcattaaagtgattccttctttctttgagttctttatgctttagtcatttacaattgaacactaagttatatactttaattgttcttttgttgttttccaaattcatattttgcctcctgctaaatctgaaggtttcttgaaaacaagcaatataatcacttgactatactacattaatagtatttgaatggtaatatgcatgtgaagagttagttaatacatactggtgaactgcttcacaataatattctactcataaaaccatgagtgtaacttgttgcagggttagcaaggagccagaggagcttagcaaagccatgctctgtgggaagagtacaaaaacacaaaaacgttagagaattcttttccttggcatcaactcttctgagatggagccatataggcattccataaatgttaactgattgtgatcaacatattttacttccaagatttcacatccaaccacctgccactcatccacctctaatgttagattccaaagggactgcaagttctgttttccaggtttgcctgcttgctcctctggattctgctttttaaggtaggaggcaagtggctgtgagaaggaacacatactgcttttaaagaaatctgggcaaaacagttcaataagtgcctgaaaacgaggagaattataaagttactgaaaataagaatttaaaagaggaaaaactaatgcattctaaattctacattaccagagcccacttttacttgcttcacagttttcttcagttccaggaacctgcaggaaccctcctgaggctgagtgccattttaaattttccctgtgagtagaaggccctgtgaagtagctttagaagttttggaaggtttactggctttggtattttgtcaggcagttcttttgatcaattgctgagcctgacaccagaaggccctcctcctccacctacaccctacagctctacaacatctgaagtcgcctccagtttctattttgtttttgttttttcctcaaaagaaaccagaaacccatgtgggcatcctgtactggctttttataaactctgtaattctagaaccctggacatcagaaagactaccacctctttaaaagtgactgagctataaggattcaattaaggatgatgaagaagaaattgctcattcctttgtatgtttcccttatgccaaccacagaatacaataaatagcatggctgacgagattgttccacagaacctttcatcagatgtatttggggaaaaagcttataatttaaaaataaaactcttcagaatcacctctgcctggtagagtttttccttccccagggattctctacaaggtaggtttttgcttccccaaagattctcatgtacaaacaagcactttaacagtactattaatacaacattttaacaaaaggtgggagtagtaaagatttgttttttgttttttagagcaccatgatgggtaatttttgttttatgtgccaacttggctatgatgaccagttgtttggtcaaacactggtctagatgttgtaaaggtaccctgtagatgtaactggcatctaaatcagttgactttaagtagagcagatgaccctacatagtgtggctgtacgttatccaatcagttgaaaaccttgagaccgaagacaggtttctcagaaaggagggattctgcttctagactgcaatatagaaattctgcccgagtttccagctttctaagtaaagactgcaactaacccttacctgaatctccagcctgccatttgcccaacacatttctgacttgccaggccctacatgagccactttcttaaaaatcaagcaatctataaatactcatatagattgcttatttgcagttatttctaattattttttctctcttaaattagtgtatattgctagacattagtcaagagagtatcatttcaggagttatgaataaataaaattttctcccaaataaatgttttaatttttcttccatcatgctttaaatgtatgtgttaaaaagtcaaatcccttcatttaataatctgtgagcagatatgatgatgtaataggtagcacattaagatctaaaggaaaagaataggggaggataggagttggggtggtgggggcagcaggtggtacctatttgccaagttcctctttctcagtttcgcctgtggtctagtctgtgaacagatgaataaataattagaattctctctttccacctctgtttttcttgctattctgaagtgcctgaatatgcctataggtaactgtggatccaagtaccggctataggaaaagaatcttgtcatgttgtgttatggtcgtaatgctacagaaagtagcattaaaaggaggtgctgaggcatgcccatggttgagacgtatttgcggcaggctccgagtcctgccacccagtactccacacaaactgagctatggaagaaataagtatacatttttcagcactgaattaaagatgcctcttttcccagtactctatactagcagtagaaatgaattccagggatgtgcaggacaatgacacagacaaatggttctctgctgcatttctgcagtcagatatgggaactgcagaaacatttgctttgaagatacataatatccaataagcaaagaagctgggttttttccctgtgaagttatccccaagagaaaaaaagatcagaattagaatgctttgtaaaagtatttaaaactttatatgttggcacccaagaaatgtagctccactcacccagtatcaggttatctcttttgatttcttttctaaccaactgaaataaggagtatatgtattctgaaaggccaagacaatgttacatttcttgcttgtcaagttaattaaacctcagaaaataaaggtattttgtagaatagtcatatgtgatcacatattacatgtcaatcttcacaatttataagcattagcatataagctctattaaccactgtgtctcccacagatagaacaatgcctatgatactcactcatctttgttttaggagtaatcagtcatttttaaaagacatgacatcatttaattgtcattatggtttctgaggttcttcatattctaaatgaatgtttactccaaatggccaacaatttgcacgaggttaacagaagaatcaggcattttgtgttttgtcttgctttcagaataacagaatttccttcctagacataaataaatggagtttgactgtgaacaccaattatggaacccaggtctatagaaatacactgaaaataatgctgcaaatcactaaagcaagaggataattcacaacaaacatcagtatggggctgtaccaaatggaaccatccaaaggttccctgcctcaggtaacaagctttaagcaatgcttgtaataagccctggggaacaattatgactagagaagacatgagtagagtcaaggtgtctcaacggtgtcaggacacagagaagtcaagagatatagaccagatttggcagctaattttagattattaagtagcatcacattatcaaccatatgaatttattaaagcaactttaaaactttattcagatgaacttacccagacttctctgagacaaagcaaacagaaaatattttcctaaaagatgtgcaatgtaagagtcctcctctctgcttaaaagcataatacgttaaaatatcagactgatatgtgatctcatcttaaatatttcctgtaagcttcatcttcctgttttctttagcaatctattccccttctgtccttagaaagcaaagggtatttgatgctaatgtactttgttgcaatatatacacatttctcccttgttccagctttcctaaagacatgaaaaatagcattgaatcctgtttctggcatggtcaatgttattcggctataaattttctgtgatttagtacatgattttggttgacaatttctacttttactatgcagtataactaattaaacattaagaagctttgttgtcatgctgttgataaaaatggcacttgcaaaaattactaatgactaattctataagaaaggacacacagggttttctttcctacccacaaggacttctgaattatggaaagtgaggtctagacaagatcaaacaaggctggaagagtggaatcaggggctggaccctgatttgagtgaggaggtttaaatctatgtgcttatcaatagatttaaatgttaaccaaataataatgtctctgaaattgtatataattaagaatacatgaaatttacattagagggtaatgccttttaatataaaattattattcaaatgctgtagtaaattcctgaatttactactcctgtcccaggagttaatggagtttgccagctgagaacatactgtttttttaaaaaaatataatacaaacttttttttctataaacgcaaaaatagcaattgaagggggagggagcgaaaattctgtcctatgttcagtgtctggaagcaaaacatatgctcaaatttttgttctttgcaaataactacttttcaataaaacaaccactaaaaggatatattgtcaaaacaaaacactgttttcatgaaaaatgacttaaaaagttaaagtagaatttatgaatttctaaagactgaattaggttacattgcctaacatttcaaaatcaacctcctaacatttaagtagattttcagttacacatatactttaaataaaatgtggtggtattttatcactaacatcacacatggacaaaccacatttaaaaccatcgttacatttgtttttccaacatttcctctggtttaattcaaaaagtatataataacttcatttatgaaattcctactatttttcaggtattttccatgcattatctctcgtttaaaatattgctttcagtattttatttaaagaaaataagtttcaaagaatttgtgtaacagcccaggtgacatagctggtgtacggctgagctagagtttaaaccatgtttatcaggcttcagtgcagttttctccccatgttacccagacagaaccagcaaaccataaaaagttttataagcacctgatctcagataaaaattgagcgccaagttaaagacgaacccacaggtgcccacagtatttttattgtcaccatcagtagtgttctcaattcctgagaaataataattttggggatctggaaacaagaaattgaaattcatagcatttcttagaaattccttcaaccataaattattatgtacctttaataatattttgttttaagataacaatgagtgaccataatcataaattgtgtatcatttttctgtaacagacttatacatacaaaagtgtcagaggcttttctataaaaaagatatacagtttttattattaaaacatattgtgaaaagaaaacatatatatttttataacatcaaaatatgcttacctgacatacatatttggtaacagacaactgtcatagtagcgaatgttaacacaaaataaatgtccataaaattattttttaaattgtaatataacaccacagctatttaatatttaaatgctattattcttaaaatgaaattttgaagcagataaactaactgctctctctgaaagtcttgacctttgttttgtgacgaatattctatttgcaattttcttttcatttttgcattgacattagttgaataattaagagtaaatccgaaatggtcttcatgttaggcattaaggtgtatatactgatccatataagctaattttctctttgaacataatagtttctaggtttatccagagtttggttttgctactgaaattgacattgcttttgttaattgaagtttttaatcattttcagatttcatttcaaagtagttcacaacattcaacatttacatctttttttttttttgcattttaagtatttgtacacaactgtaccctacagcaaatattcaaacactggaaaatatctgtgaatgttattggataacattaaaataatgtaaaatttgaattgctcagcaacactaatactacacagaatcaagtgtagaaattgttaattcaaggatacattttgcctccaaaacttgtttcttgggacactataggacttacataaagtatattatgtgtaaaaacatataaacatattttgtatttacaagtatgattactcactgttagtagcagaataaataaattgtgatttaggtaaacaatagaatactataccacaatggcaatgacaatgacaatttagaaacataatattcaagtctcctgacacagaagcctacaaactgtgatgattccatttttacaaaatacagaatcaggcaaactaatctacttagttaaagtcagaatgttgattactttcaggggtgcagtgtgtaacagccaggaagggagcaccaggatggcatgcttctgggagctagaaatattctgctttttgctaaacacatgtgtgcactgagtttgtgaaaattcatttatctgtattcttagtatgcttcgataaaaagttaagaaggtaaatataaagcacaaaaaaatgttacttcaaaacttttgacgaaagcagcttaccttttgaactagtttctgcagcagacaagaaattagaagtcaaaaagattttttaaaaatttacaggaaaaacactaagaaaaatcactgagactcctatcttatcattagatataaatggacatattgtttggtaaatgttattttctcaacaatgtatcaatcaaagctgtattaattgtattctacttatcttgtcaatttagttttttagcaattcaaattttcttatgcctacacatattaacagtacctaaatgaatacttaaaatgaacttgagaaatgagctttcaaataatgcatttctgtgattcaaaatgtttgtttgtgagcaaagcaactccaacttctactaaaaaataaattatttagttttgaagatctatatgaagagtggaaattagactaaatatcttactagagatcatgtattcatgttttgcggccccagtatccagcattgtagcttcgtaggagataaatatgaaccatgttttccgagagcacattatctttccatgaaagtgtagtaatatctacacttgaaactctatggaaacttgaaactctatgatagtttgaaactcactgctcacaggtacatacaactctgctttaaactaagttgcagtaacatagaaacccataggttttaacagtattgtttaatggagtttaccagctgagaacatactgttttttaaaaaaaaaataaaatacaaacttttttttctataaacgcaaaagtagcaattgaagggggagggagcgaaaattctgtcctatgttcagtgtctggaagcaaaacatatgctcaaatttttgttctttgcaaataacttgtggaagaaaaagaaagattgtgaaaataatgcagaatatcttacaaatgaagttattttcaaataagagacttaagaatataaaatgagactttcgtttcagtatctaatattactaagcaaagtgaaattgccataaagccacattctgtaactatagcaaccttgcaaggtaacacaaaagggctcatctttatgcaacagttttagaatatctatgatcctgaatgtgacagtatgtactatcttttttggtctgctgtgacatcctaatacatagatattatgaactatatccaatggttcattctttatcagtcaagaaagctatatcttagaaacatgtttaaaattaaaatgaaatacgtttaaatttaaaataaaacaggtttaaacagttaaacttgctaaccataaactaccaaaaaaaaaaacccacaagtgatatcactgttgctattttaaacataaataaaaatatcatacttatttgtatgtttatttccaactactattttatacctgaataagaaaatctcatcaaagtgctatgatatccccataatgacaacttccaaaatgaaattttcttggtctcaaagcacacaaaactctgacacaactgaatgaaaatgtaaaaatgaagttgtcccaggagatatgaagtcatacatatttactgaagccagcagagagcatcattaaaaattcccatggtagactcaatgtgaaagataatttattccacttaaatatgcctgatgatgatattagaaaataatctaaattaagaactcttggataagttgataggtgtctttttgctcagaatgtctaaatcgtaaatatttctataaacacacacacacacacacacacacacacacacgtctataccatttaatgtagtccaaagagatttgagttagaagtacattttagttaattgtctctcctcaaataactctctgtgggggagaataaaatacaaaataaaatatctaagggaattcaccccacagactaagtataaagaactctgtaatttggtttgaatgagcttttggttttttggtttaactaatacagagatttttatttgatcattgtatagactagtgaatccatttttgtgctcctttttaagtagtctactggggagtataacaaacatacactgatgacttaatgtgaaaccaaacacaaaggtgtttacccaaacacttttctaactggctagataacatgtactaaaaataaaggcccatagaaatgaggagaatgaaaggaaaagaggtggtagaaaaataaagatagaaatttacttaatatttttcaacatatattgtcaaatttttatctagattgttctttctggaatgcaataaaatgatggtttgaacaaagcagtggaaaaacacgtgatcccaattttggcttgtttgttttatataatattgtggtttctattcaaattaatatttctaattttaaaaaaggaaatttgcattaggacacacaaaattactatgcaaggaataaattagacaatctcataagatttgagatgtagaagattacaaacaaaaaataattataagcatgactttgaaggccaaagggaagttatttgctgcttacaaacaaattctattattaaagtctgtattctatcaatagtcatttgtgtgactgggtgggagtgtttgtgtgaaacagacaatatgtccatctgagaaacagtaagctgactgaacagtcatgagattatttgctcatatactgcctggcaaattttaactgtcctttaaggatacagtttttaattttgttctttttgtgtctaataatagctatattatactttggagagcccaaagtctagaatattcaaagaaataaattagggttattatctcaatcattaattcataaacgtgtttctcatataagcacatcactggccttattcttctttaagaaaaagaactagtcagttaaatttcaaataatttttagaatatattaaatttggatgagaactacaatagaaaataggggtatttaatgtatagttgttagtcttattcatcacttttaagaatatatttttcttgaaaaagcaataaaattatctcagaatgcaagttactagttttattttattcactttatgttttcagtatccaaaatggatttgaccaactacaattacgttagactgttctccatttctaaataaagttctgatgttgaaaaagaaaattttgcatctctcttctacttgatccattagaggagttcggtctacttttctttcttggattgccaaactctacataaaaactaagcagctaaatatttgcaaaaggaatatcagtttcagatacgtactaggctatttaatactgtttcattgagaaagctggccatatttgtaaacagttagaatagcaaagatcttcagaagtattttcctgctctaaaaagatgaaaaactcctggtacatttctcagagtgggaaagaagttggaaacgcaagaagctttgagaaaatggctccaatcattttaatggctcactaaagtctttagtgtttaacatctgtgagtttatctagtctttcgtttactcttttaatgtctatgagtcaaaatgatgaggctgaattgtgttaagtgatatcacatccttgagcttgccatttggaatacatttttcataatagctaataactatcatttatttaatttttctatcgtgtttcattcattaaattcatgttcatggtcagggaaaagatgaaacttagtcaccaatatgagggtgttcagcaacagattcaaggtgctctttagtaatcatgctttttactttaacctcaaattgttttactgaattccaaagttgttgacaccaagactcataccaaattgtaaaatagttatttttttatctttcctttctggaaaataaaacaataaggtaccttttaagtaaaaaaaaaaaaaaagtagaagaggctggataatgtataatcagtggtattttcatttacatggtctgttttctattggtcaccatttctacactgagaaacaatgatatctgtcttaatctttcaagatcagtacagtgtcacagctgactggaagaaatgacagacaattcttaaaaactgggagaatgaagtatagagcttcaagaaaaatgatatcaatactaaccccaaacattaaaacaacaaaccaaccaaaaacacaacgcaaaaacctttggaaattataaaagagaaagaagggattggtcaagatcaaacaattatacaaattggagggaaagaaagtccatgagatttaattggaggcaggtgaaattcagaatttcttccaactgatttcatgtttgcaagggtcttatgccacagccagtactaaagagaaagaacagctcagggctaaggtggaactgaaagcagtgaaagtaggagggaggaccataaaattagccaagtaacctggagagttaaaacagtctagagattttttcttccttctttcctttcttgctccctctgttatcttttcctccctctctctctcactctctgccttactgtcttcattcctctctgcagaaaatcatgaactgcaataactgtaatccaccattagcttcagaaaaaagtataatgttgcttgaattttatgccaaaatatgttttgacaatgataatttctaattgccctgacaatgtattctcaataatcatacaaaatcagaacaataatgcaggtactcaatttgaattctgtggcttaactcttgtttgattttcatatgataattagcacaaatcattacctacattctatctctgattaagaaatggcttcctttaacctgatggatttgataactacctgttcaaagattttgctttcctctttattattttcttatgattgtcacagcatgaaaaatatccttgttgtttggaaatatcagattataatatgtttaattggtattctactttacagatcaaactatcatagcctaaaaagtaaaatctaaccttaacacagacagcatattttcatcatgtttaatcacaacttgatcatttctcagtctttcagcaaaaaagattcggttttgaaacatggagattggcaaagaattttagctttgtaaactatgagtcttcttaactgctcttcatgtatttaaaatcccaccaatacttgaaattggcttatatcaaatgtgccctctttctttctgactttccatcagacgggaagtgttctctgagctcttcaaaatactttgctcctgagttatttgtgtactcttgcatattaatatgttgagttgcttaaagatagtaaccatgttttggtttctttgatgtctcccactctacttgtcaatgatttgtacacagagcaaatgctcaataaacactccgtaagttcatgcaagtaaaagtaatttgtttcccatctaaacaaaggaaaaaccatgtctgatggcagctttctttccgattctatctgtttaacctcaaattcaaaataagaagaggttgtggtataacgtgtacattattttcagaaaaaacatatttttacattcaaatataacttgtaattaagtccaaggttatttatgtagtagagctaaaatccttcttattggtaatagcttttcatttaaatatagaataagactttggttacatgattaatttatgttggaatatcacacttttagtaaactttagaaaatgtaaatactaataaaatgttataaaacaaattttataaagcattcataaacataactgcatacaatatataaccacttttattaaaatatagcatttagactatcataccaggttattccttctaaaacatttaagtatttcctttcagttacttttcagtaactaataaaaatgcttatttttcctaaacatatctttaaaataaatctaatttatcagtatttaaaatatttttaataatgctgcatgttaataacttcctactttctatgtgctcattctgtaacatgagcttcaggttttcctttaatatagaggcttagttttaactcaaacacacaaatatgcactgggcagagttctcaacttgtataatgcttctttgtatttaatatcatgcatcacctacttccaaaattccttttgctatctgttatgtttagcaaaacaaatgtgtcatccagcagtgtcattaattagaattccttgtaaaaggtggtgaagtgagtgaaactctaaccttaaaatatattttggatcactctgcttcacaaaacttagagaagacattaacactgccctttaaaaatcaaccactcagtaaatgtaccatatacattttatctatatcacataatgaaagagtaaaacataattaaaagactgaaactgacttattttatttaatggaggacatttaaggagtgaaaatttatttcaaagttttacttagattttttttaatgtgaatcgttagttttgtcagaccataattgtccttagctactctttaatggtatttaacactcacccatatttcaaagttcagatcaaatatatctgatatttgtcagactacgttaagtatgaatgtgattattgcaggagaactttttattcttcttaaaatagtatcttcagggaaaattttatttccatttatattgaacaattaaaacaaaaaacatgaacagaaacctacactgaaaaattcatttaattatcaccttaccagctcataattacttcattctgaactgagataacgactgtagtgaaacaactgtatttgttttattgtattatgcacaaaacacaaacttctaatgattaggtttattttcagtaatatcattattcttaaattttacttcaacgtaaagaataaaataagtagatatttaatgccttaaccaaataatgcaaaacttaacatattttaatccctatttagtgaaaacaaagcacatgtttatacatggtcaatattttactacttaggggcttagatttttacttctggccaaaggatactccacagcctcctcgaagtcaaaatttcagccaggcaaacagtctgtcagtaactattgattgtttagagaaaatactagtgatttattgaaagatctatgcttctgtctttcaatagtaaatgaagaagtaggccaagtgaaccatgatatgatgacatggagaaaagaatatctccaaaattgctgctgcagatgcagaagaaatagaaaagtggcaagttgaaatcaatactcattttagacttagtgatggaatgcttcatagttaccagactgaccataaagcacaggactccaggtcagctgcaaaggccataaccttctttcctttttcactttatagtagacataaatggaattgttctgtttatacttaaatatacacgagtattttattatacaatctgatataagaccatgtgaaagtctcattgaccttgctgaggattatgctgtttgaaagattctcaactgctcaagaggtagacttctataaaaattaatcattacttgaaaaatgactgattaaaacagattactgctttaataaaatcacatgccaaggctagagaaacatcctttcttgttaacatatcttgatatacaaagtatactaccagaaaaaacttacttttcctcagatgatgatacagtttctcttggaatgggaatgtaccataagcctggatcagggtaaactcttgtttttatacagacacaattatatttttgaaacatgagtagcgggcaaagacttctcaacatattcacttgtttcttcattcatcacccatccattcattaattcactgaattgatattttctgagtgcctactacatatgccatgcactgttgtaggttctgggggtacagccacatagaaaacagacaaaaatccctgtacttaaggtatccaatattatcaggatacacaaacttacagctgtataatatattgccacatatgaacaactattattttagggaaagaaaggaaagaggatagttctgaagcctttatttcagatcagatggagacagacttctttgagaaggtgacatttgaacagggattacaataaagcagggaaacttgtattgccaatacctgagggaagaatatgcaggaaaaaacaataggtgaaaatgtcctgacagagaacatggcatttattaagtctgcttcattaaatgaagttttgagaatggaaataaaatactgagaataattgtagatggaagttgtgatgcttcctttatcaaacagttattactcagctattgggaattgagagatcaatatctcctaaggctgggttatgattaggttctttatattatgtagcacaattcattaagccctcccagtataatatgtttttccattcaaaaaataatatacactggtgtagtatttaattggtcatcttacagaggcagtaatactcagacttagagaaagagccaccaaatagtctgaaattcacatacagctctagcttgatagttgcaattgtccaatcctttgaaactaccttgacatggaattcttaaaccattgataaaaacctgcaaacatttaaagttctattgagtctgagataccttggccaataatataaacattctttactttaaacatacatggcatattgtgtacatacatatatttattcataacatatgtatgtaaacacatattatatattggagcagccattaacatgtgccagttgccatatgtcactcaatgtttatttcaacaacttactgttcatctttaaggagtgcagttaattgacaactcccaacaaataatacttgcaagatctgctgaggccatgctctctgggtttgcccctagccaatgactaaccatggcgtggtcaagggagggcaggaagattgggacctggccattttcacccaaacaagaactcctctgatgggcagtcttcactccagagctttccagagaggtggctgagagcctatcagatctgtactgtggcttgaggcctgtcacccctttctatctggattctttcctcttttatcactcataattgctacctcccaacaactttttgtaccctaagtgcatctgagcatttgtcccctggagcacccagctgtcacatgtgtttatagatgtacatgcaaatatctattattttagggtaggtaatacattattaaaactcttttcacttacttatagtatatgactaatgccacaaaaggacagacaattattttgtagttaaatatatcctacttaaatgttaaagggggctttcatataatgaaacatttgacatttgtgaataatttttaatgagaacgtcaatatataaggcagcctcaataaagcattttcctgtagggtttaatataggatttggtttggttgtcatatctaaattgtttattaaaggaccaaaagattcttcttagaagctattctgatatttgagatgtccccatgtcatataactcaagtgtcggtgcaggacaaatctttactatgtgatatttatttttattgaatccagaagttctctgattatgcagggatgtattataattatagtaatgtacagtcagcatatacattcacaattataatgtgatttttgataaacaaaagtattttcgtttattagtaagactttctatttctggtactatagttatccttcaggattttttcaacaatttattaaaaacttgactcattgttcaatttccacctatgagtgagaatatgcggtgtttggttttttgttcttgtgatagtttactgagaatgatgatttccaatttcatccatgtccctacaaaggacatgaactcaacatttttcatggctgcatagtattccatggtgtatatgtgccacattttcttaatccagtctatcactgttggacatttgggttggttccaagtctttgctattgtgaataatgccacacaggaaggggaacatcacactctggggactgttgtgggttggggggagggggaagggatagcattgggagatatacctaatgctagatgacgagttagtgggtgcagcgcaccagcatggcacatgtatacatatgtaactaacctgcacattgtgcacatgtaccctaaaacttaaagtataataataataaataaataaataaataaataaataaataaaataacaggaaaagcaaaataaatgtgacatgtctaaaacagtaaaataaaaccaaaaaaaaaaacctgactcattctcagaataaaattaatacaactgaggaaactgtcaattaattgttcttcactttcagcaaaaatgattaaagtcaactgcacgaacaattcaagatttgtcctgattattcatttgaaacttcctattttccccatgtttttccataaacgcagaacacttaattaatatattctatacacaaagaaatagttgaaattatatgggcagcactttattgtataaattttctttatagtgtctaagatctactgaacatgaaaaacatttaacacctcagtccatgagattaacataaaaattagtgctaatataatggtgagccatgtggttatataatttatatgtaaattatctcaaactaaaaaataaaatcaacaaaaagtatatgttatattactgaatccagtggcagaggatatcatttgaggaatgctgtttctacatttttaaattaattagaagaaaatttagcaatgggagttttgtttaaaaatataaattataccacgatgtaatctaacatttgtttgactaggcaacaaaaatttcctggccttctcccaagattatgttattcctagaaatataaaataatattactccttcatgttattccatatctcatgcttacatcaaatgcaattactactgcttttcaagaaacaaccatgacaagccaataaataaagtattttgactttgagttgggttcccactacaaatgaattgccacaagaataaatgacaaattattcatttgctattccctcccccaagtttaacagaagccttagaaccttcagtacatctcaaacgctgtaagagtaatttatgatcctgaaagagaacataccctattggggcctaaatgaccacaaacaatgagccattttatgagtgttaagtaaggaatccaataaaaaggtgatttaaaaagcagacatgacatctttgaattaatctttgctctaactgacaagtaaatgcctctacatattggatatttttccccttacagcaaaaaaggcagtaactagtcatttcattatagataagttgctttaccacttgagcctgttttctcttccgtaacataaagaggctgtatcagaggtggtctagttaactatattcaggggtcaggcactgaaatgagtgggtcactataaattaagacaaaatactgctttgagctattttgttttttttggttgttttttttgtttgtttgtcttttttttttgagatggaactttgcttttgttgtccaggctggagtgaaatggcacaatcttggctgactgcaacctttgcctcccaggtccaagtaatggtcctgcctcagcctcccaagtagctgggattacaggagtgcgccaccacgcctggctaattttgtatttttagtaaagatggggtttcaccatgtcagccaggcttgtcccaaactcctgatctcaagtaatccaccctcatcagcctcccaaagtgctgggattacaggcatgagacaccgtgcctggcctatgcaagaaattttatgtaagggcattgacattccaaacgattattaaaacccatgtgaaatatattcgctccacaaccctccaaagctcccaaatttcaaattttggaccaaattatctcgaaattctctcaagcctcttcaatctctaagaagcaatctaaaaaagccctgataatgtgaaccattaaaatcaatataacacaggcacaagatagtagaggggattaatgcagaaaattatttcttactatttactgagtcctgttagagaattgcatatcaatgtttctattctttcatctggtctctaaatcacccaagtatcactcaacgctacatcttccaagaaaaaaaaataactcagatattatgggaagagagccaaaaacatcccagctcatagcctaatacacacatttattgggaacctactatgtgtaagatactgtcccaggcatttgggataaatcagataacagcactgacaaagattcctgcccttgtggggcttatactctgcagagacaaacaaggaaacaatcattaaactttaagtaattcgtgtatatattagaaaatggtgtgtgctatggttttctaaaaaataaacaagtaaaagggattgggagggtgggagacaagtggcagaaggttgaagtatctaatagaaaggttcagaattggccaggcgcagtggctcacacctgtaatcccagcactttgggaggctgaggcaggtggatcacttaaaatcaggagttcaagatcagactggccaacatggcgaaacgctgtctctactaaaaatacaaaattagctgggtgtggtggggcatgcccatagtcccagctactcaggaggctgggggcaggagaatcgcttgagcccgggaggtggaggttgcagtgagccaggattgtgccactgcaccccagcctgggcgacagagcaagattctgtctcaaaaaaaaaaaaaaattcagaatagactcagtgaggtccaatttgagcaatgatttgaaagatgtaagggatttaagcatctgaaagaggcactacagccagcgccctgagatggcaggaagtgtcctgagcaaaactgcaagaggtcagtgtgagagaaggagacaataaaaggtctgaaaattctcctagaaaccattaacactgtgcattttagctactatatggattttcattctaagtaactgttgaaatgaggtatcatggctaacagcaactgctttggtgttaagcagctctactgtttatcagcttcagtgtcaagttgcttaatctctgtgcttcacctaacaaataagtataattgcagtataagtaccacgtaggactggttatgaggataaatgagattaatgccaaacgtcgtactgtgactggcatagagaaaccgctcaataaattgttttctctgaacttgctactttcaacacaaaatttttctcaaacaatgagtatcagtgataccaggaccattctaaaacttatctccaacatctatgctcagaatgatgaatcaattaaccaacaaacctctactatgtgcaagggattattttaggtgctgaagggatacaaagaatttaaaatgcattccttgatattaataagaacatgatttaagtgaagaaataaaacatacacataaaaacataatttaatattcctatcaataaaaaggaataaagtactgcatctgcacaaacacatttggatgactcttaaactcactgtgcagaaatgaagaagccacacacaagagcacatacttggtgattccaattaaacaaaatgaagactattctatggtgacaaaaggaagatcagtggttgcccagatccaagggaaggtgtgagaatggtttataaaggagtataaagaatcttcacaatctttggaaatgttctgtatcttggttgcagcattgtttcacaagtgtaaacaattgtcaaaattcatcaaagtgtgcactttaaatgggttctatttactgtattcctccataaaattgatgatagcaaaaacaaaacataatagtcataattgatcagaatggattgaataatcactacagtatatcttccactatagtttgaactagaaaattacaggacaagtttagtttagatatgccaggtcacacaataatttccagatatttcttgaattgcattaggtctagaaattttgttaagcttgaagataaagttctcctattaagttgtcattagttgtggctctattcagtcaatgtctgaataactttatgtcactgtttctttgtttctatatgaagaatcctttcatcttcaaactttttcctcaaaaattttctttttttatacagttcattccctcttaggactgtcccttgcagagatttccaacactttcttactgctttcaatgtaactatcaaagattttaactgcagttttattttttaaatatgggccattctggcttctatctgtagcccttttccaaagatgtataagagaggaagtggcatgtctaacatgtctaatcttaaaaaggacacacttttcaaagagttttattttcaaagttatcctactattggttaccaataattataacacatttttatgaaatgtcaaataaaagacatgcatatatccgtagggaggtagaaaatgaaacgggatattgtgctcttcctaggattcaactttgctgtaatattctatgaggttatcattcaattgttctacaatctaaattcccacatttcaaaaatttaattttcctatgaaattaattgcttaatataaaaagcacatttataatttattcttcagaaatgaatgctttgaaaatacatttaaataagtgttgatggacatcattaacagtgaaatataattaaaagagtaaattatttagttgggtttttttaaccagaataaaagatttctatggaagctttctgttcagaatattaaatgcctaagaagtcatactagattttgaatgtagtacctattctggaaagcaaattcaggattcttgccgacagattaaaaattatttcctaatatagatgactcaaagaaatacctgtcaaacagagagttaagacttctgaatgcagacacagcttgaaaaagaagatgatgtattttccatggagcatttgccgaagaactattcagcagagacataaataattaaaattaaactacagtcgctaaaataaatgaacgatattctgaagcaataggttgacttttaatcctgattttcacttacttccaagctcacaaaatttaaccatctgcagcaaatcgccacatcaataatttgaattagccggattccaccgtaatttctgaagtgcacctcactccaatttccaatgcagtacaattgaaaacgttatcagataaaactggttgcagaaggcttggaacattaaatgctttgacaatgacaaatagaataaggtgagatgtgtcttaaaaggagggtcttcccactacactgtgtttattcaattttagggacaccctctgccacattagaggccttttcattttcttctctccagacaaggattagtagatgtgggccctgcttcccccaggtttatattactgtataagggtaaccctgtgaagtaacaagattaccagagagaaaattttttaaaaaatttaaaaaagggggtagattatgtcaaagccttccttgaagagagagttaatttgtttttttctaatattttgcaggatgtattaaagaaagtctgtagaaagacaagcagggaaatgtgacaacagactatacaaagaatttataggttcttatgacattatttttctttgatgtaaccccatgttggtgatgttatagaacttttgatatctggcagaattatgtcaaatacatgaactgcagtttaagaagcataaacgtcaggttgttgaaatcttccacatcaaactaattagaaagaatttttgaatgtgaattacagcagtttattagacgtcatgggagatacagaagatgtactgatattaggcacacagaggtattttaaaatatgtaataactgaagagacaagacatgaaatataccaaaagggatttttttgtgtgtaaattaagcatctaaccataaaataatcagagaattaatcaatctagagtaacatgaatattatcaagagaaggctgagcaatacaaataaaagaaataatatctccccatggctactcacaagaaattaaaccttgctgaatgtcagtttcccctttgtgacagggatcagcctaaaggcctagtgtccacaacatgttggacaatgtgggatttttaagtgcataatagatcccaatcctttaaatctccaaacctcaccatatcctatatcacattacacttcaactctccagtggaagggtaagtatctgggagttcaccctttaaggacagtagttctagaacccgtagtatgtacttgggatcagcctctagttgaggttattaggtctaagtcagttttactttctattataagcatatttgtcagtatcaattaaacaaaccctctcacttgggtaaaatatttagaaaacggaaggcatttcaggtgggaaggcgggtacaagtaagaaaatagaattggaaacaagtatggcttactcaagatagcatgaacagacctacttgtcagagtgaggattaaaagtaaaattattaaataaatagggctcttcaatagtaggaaaataatgtggaggagcctgtaattgatatgacaggtaataagggaacatttgcacatttctgagcaacggcattccgtgatgttgtacaagccagagagagtgaaacctaactaagagaaaccagctaaagcagctggcaggaatgatgtaatgcaagaacgaggtgatgagcgctacctggattagactgagctcactggaggtagaaaggaagagatggttctcctaagaatcaagaaaactgaactcatattgaattacctcttcaattctctcaaatgtcatgctgccagtgaaggccttacctgacaacctcatgtaaaaattaaacctccttttctcatcggtacactcctgtgtcccattcactgatttttttctctatagaaggtatcactatctgacacactatttatctggcttttgttgtttttgttaatgcttgtttcataccattaaaatgtgagtaccatgatccatgattttcatctgttcatttccctgttcccctgagcccacaagaggggattcaataaatttgaactgagtgaacagaatgaattaatatccaataaagaaaacaaagatgaggctgggcacggtggctcacacctgtaatcccagcactttgggaggctgaggcgggcggatcacaaggtcaggagatcgagaccatcctggctaacatggtgaaaaccagtctctactaaaaatacaaaaaaaattagccaggcatggtgggaggcacctgtagtcccagctactcaggaggctgaggcaggagaatgacgtcaacctaggaggtagaacttgcagtgagccgagattgcgccactgcactccagcctgggtgacagagcgagactccgtccccgcaaaaaaagaaagaaaataaagatgagaaaacattaattatgctttcaaagttccccacctggcgttctggtacaaagttatatacaagcaagaacttcattaaaggatctcaaataaatcttacaatcttaaaaggaaagttcaacaatagttcgatatcacgtgacactaagaaaaaaatgtgatttgaccagtaggtaatcaaaaacagactaaacaacaatccaaagaaactgccaatagtccacaagttcttcagtaaatgtgaattatagcaataatgtgctaatttgtattcactaaataggttttcaagctttcaaaatgtttaaaaatgttttcatttatcattgcaacacgcatggcgaatggaagatggagacactaaggagttaaataacctcccatatgctgtccttccatattaatgaatagaacattacttgcttctataccaaactagaatttggtgggaaagtcatgaagttctccaaagcaaagttagagccattagattaagaaagtgagtgtaataatgtactatttttttcctttagaaaagcgtaacctcaattggccattgagaaggatggctttattagatgatgaggagtctgaaatatcattaattcactcatcagcatctagaaatattctttaaccagggcaagacaaagaaaatgcatttattctcagcaatattcattataccaaaacatttattcattttgcttagaatcactgaagtaaaaacagacacaaattagaaaaaaaataaagcaaatgttgaatcacattctgagtttagaatagaagaagaacaaaaacaagttttctcgggaactgaaaaaaaaaagaggtcataaatattaatgtactagatctacataaaaaaattctaaatgcaggattttcataactctaaaccagaaatcattttagcttatcttggaaaacactaccagtgaaacaacttaatatcagttaattttgttttctaattcaatttgtgagacagcactggatgtattgagaaacagtacatctcctgatcttctaagataccatgtaacttgggagtgctgagaatatattacagcaccctggtaaaaacccatgcatggtgtagtttgaccttagtggggagctttagctttcaccatcaggttctgacttgctatttccttactgtgtaatgtgaaaaagtttttatcttggttattttttcttatctgaaaaaaggaagtcaaatgtcattgtccctttatctcagatagttattataacagataagaaaatgctttttacaagtcaaaaatgaattaatagattaatttaatgtattattctataagtttacctaaatcagaactactactactgttacaattagaaaatgataaggaagggaagaggaagtacatttagaaaactgcttttacaaaccaaaaacaagtatttatgaataaaagatgaagctgctgagaaaagtagaaaattacaataatatcactttattcaagaagatattgggcatgtattcccaaccagcaccaatatattatttttcagagataatgttaccaggaagaataaagctatgtttatttagacagggccagaactttttttaaaagataaactaaaataagtaagatactggaattgatttgaggaccctttgcaatctctttatgttctctgctttctaggtattcactaccagacctcgccaacctaaattttaactctctctttagtcttgttgaccaaaatgacttttcttcaatctaaaccatactgaagctgaattcaatctaactataggaagacattaacatggttcaaataaagctttgcataataactgtttctattatgttgatggtcttggaggtaactaactgttaattcatctttaactgaagaattattatagaagtattctgggggaggtgtttttttgttttggtttttgttttttgtagtgacatgtgctctcagtgtaccacaatatcatagccccacccccacaacataccttatgggccttgtgcataagcattctgtaaattataacacaggataaaatggggcttacttgtatcttctcctaatggaaagcctctcctttagttgtgaaaacttgaaattatttcctctcaatacgtccttaggcaaagggagctgtgttggcaaaagccagagagagatgatgcttggctcagagctgaatggctcaaaggtactttcaggataaaattgaacttctgtgatttactcatttgaaataatgagatttggagtgttctaatataatccacaaatacaagacagtaagatctgaaacgccggctgtagccctgagattaataacctctagcagtagttatcaaatattttaaaataagagacccttcctttatagacaatcatgggagaaagcccaatgttaaaacagagaaaagactatgtctctgctggaatcagggcaagggctccaagtcctgctctttccgcactcttaagccccagcagtggtcctcaggtccctccccagaacccttaggctcagtaaggcatgacctgaaatccattagccttacataattctgtgaaatttagaactgaagaatccagtttgttccataacagcaatttgactgaaatacatgagacaagttagagtggccaggccagaatactagaaattaaagtataataataattttaaaaaatgacataaaataaagctggtagctttcaccctaggcttccttgcagccccactctctttctactaggtcttgaaatttagaaaaggtatcttgaaatccctaagtattaaatagtccatacgtgaattttacaaatgtatccaagttcatatttgggaacataaacgatggtaaaatggttctcttctaagtagggaatgggaccgtgtggaaacttgtgaggggatgtcagaggtagtgcagtaaactgctgatgcaatacaaggaatgtccttttctgtgctagagctaactctcccatttaccagttgattaactttacgcaaaacacttgttattcagtttctccatccatgaaacaacctgtctgcattaaatgatcagacctttctttttaaaaagattactaatctgtattttatctagatacataatatttttgctgagttgaaataaactttcttaattttcatattcccttttcattataatctctatcctgagaaccatattcatattttcatcactgctgaatgttgtctccctggatgtcttcttagaacttgatctaagatgaatgttattctcccacaggcactttcagaagcataatccttctgggtacttatatccaggctcttcaagtcgccttcagttctttcctttcacttctcacatccaattcaactactccaatgtcttcattcattcattttttttattatctactttgtgatttgtcccactgaaagaacaagacccaggccatgtcctaatgaaattgtaaatctagtttctcatgtttggtcctttccttcttttcctcatattatcatcacagttcagcccacttttatcttaacgttttaaacaacctcttagcttattcaccttcctctaatgatcccacctttcctcagcactgtaatttggaattcactctgccattaagatgtctttttaaagtgggactctgataatggcagcatccatccccaaccctctgacacacactgtgtgttgactgcaaaataagtttataaatccagggttataaatgcagctatttaaggaacctggtaagacacataaatgtgtgagtctggttagggcacacagtagggagtaagagagcctagggaaaatttggagaggctatgtgctgcccagtgactttcaaattcaattaaaaataactacatctatgaaccagaaagctaccaattctttcattccaaacctcccttgcagccacatttgtgttgcagccacacaacatccctcactataatcatgctttgcttgaagctgttccaatatttctaatgacactgttctttctttcaggtgtcctctttcccagtgaatctatcctcatttctcatctcttccctgtcagctaccacttatccaagcactttttttccagtaagaattcatctcttgctctcctatatggtcattatattttatattttacatatttataaacatgacatatgtatttatgttccacaaagggctttgaatagaatttacacatagagttccctgggttgatgtgtttatcaaaatggaagataaagtgaattaattacttaaatatttaacactattgaatagaaataacttccccaatattgcttcatgatttagacagtctattaaatgtttaagcaaggcactagactaagtttattaagacaaattttggaatatgtgcagaaatatgacctggctaatagtacagagtcaaagctggttgaatggtgttatatagtggattcagattgatgtggcagtggtggttacactaggggcactaaggttatccctactggcactctgaggactctattctctaccacacttttttccattaaaaataccaagtagattaatatcatatttgtagataacacagggatagaattacatacgaggagaaaatatagcttacttatatccatgtactaaaatggaaatcagaagcatttctcttcctttgactcctcatctctactttctcttcagtaatccatactataaatgacatcaccattcacctagagtcttctcatgaaaatctgggaagcagtcttgactccagtcgtgcccacatctttgtaactaatcaaccaacaaacccatagaccctaactccttagcacatatcaaatctattacttatttttcacctctgatgttaggaaaatagtgtaagcttctggtatctttcttgactaaataattgttgctatgctgttttcttatctttggttctgcattttttaaatctgttctcttgccagaataatcttttgaaacaaccaatctgatcctgttccttaagtctttccatcatcttgacctttatctgtttctccagtttcatcctttaggttcccttgttgcattaatactcaattgcttgcaacctgcatttctcttacatacttacattatgcttctgcctgaaatgtgtctacctatgctagacaaatataatggcaccacaatgatgtataaatcttaatctccagaacctgtgaataggttggattacatgtggattacatgtgttgcggctcagaacataccccaaagtatggcaccctggcatgctgagtacttggaactgaaggaaattggaaaagcctcagaaacaaggtctctgaccttttcctgccctcctctctcacacccctctttctccccagaagcaagtcatagcaaccagaattgcatttctccaaggtctgtctagaaactaaaagtcttctcccctaaagtaagccataaaatgtagaaaggtcactctctcccttttcccttgaagactctcattgccctatactctggagggaaaaatgctacaaagagaagaatctgaaaaaaaccaaaaaaccaaaaaaaaaaacaaaaaaataaaccaacctttctggatttcccccctcagtctattaccattagattatactcttttgtccaatcacatttctacatggcggttcattcttcactgaaactcagtataaaaagtacacagttttccctgggtatttgggtcttcaactctgaaagtgcctgtgttacatgaaactttgattaactaagtttgttatacttttctcttgttaatctgtccttcattacagcagtgttggctgtgacctttacgaagggtgagaaaaagatgcccttattctttttgcccttaaagatagcaaaggcaattaaggttgaagatgttaattacgtttgctaatcagctgacctaactatagggtaagaaccctggacccaatgttgtcacaagctccttacaagtggaagaaaacagcagaagaggagtcagaggaaaatgtgactacagaagaatggtctgagagatgcaaggttactggctttgaagatgaaagaaaggagtcaccagccaaggaatataggcagcctcaaaaaagatagaaaaggaagaaagcagattctttgcaagtgcttctaacagaaatgcaccattgatgacaaatcaaatttaccccagtgggatccatgccagacttctgacctacagaagagtgagataatacattcacgttgtttaagctattacatttgtagtaatttgttatggcatcaatagaaaactaatacactacaatgtcactctagccaacactcatcactcaacaagactcagctaatgaagaatgttggtttctgtaaataacttatattacagggcttttaactattgatgagacttccatgtaaaaatgtattcacctactgagctataaatccctctagaacaaataccaagccttatttatgtttgtattcacagcatcttgcataggacccttagtagataatttactacttttaatgattgaaggtagaattgaatagtaatgtttcatgttttaaagtgggctgacaacatcaactcttgagtagagtacagaaaggctgacttatgagcagttcatgtggaaaaacttagagatttcaactgactaaaagttcagtatgaattgataaaacagtaacactgacaaaaatacatacacacattcacacatacacacacacacacacacacacaaccacacccctacctttgattttagatggcattaacagaagtattatttccaaaaccacagaatgcttccattttactatgccttgctcagatacccagggatagtataattaattttagacttggctttaagaggtatcctgacaattagagcatgccaagattaggagaaggagacaaccagcaaagagatggtaaggtcttcagcactgtgaaggatggtttgaaagaaccaaaaaataaaatatggaagagaaaaaatctgaatttgggtataggagttgctatggtttgaatgtgttccccaaattttgtgtgttgaaaacttaatcctcaaattaatacgctgactggaagtgggtcctttaggaggtaattaggattagataaggtcatcagtatggagcccccttcatgggacaggtggctttaagaagaggaagagagacctgagctggcagggactctcttaccctctcaccatgtgatgccctccacatgttatgatgcagcaagaaggccctcactggttgctagtgccatgctcttcgacttcccagcctgcagaactataagaaataaacttattttctttataacttacacatttatggtattttcttatagcaacaaaaaataaagatggggtggagaaatatatttatagaaagtatttttttaagtaaatgagaaattagacataatgtttttaactctagagaaattgaaaacagagcacagcacatcggataaattcaataactatcttaagaatcagcaaaacaacatgcagatggctgattggcaatagtttcagtaggcagattttgattaaaataaagaaaaactttttaataattaaacctctccttaaaacattatgactttatgaggtaacaaggtaacaagtacagccttctgaaagcataaacagcgtttacatcatcacccattacttaactagcagaggagtttgtttgaataggcatttggactaggagacttctaaagattttgtcaaatttgtgacttcattatttgttaattaagtccctctccattctaaagcaatttctgtgatttttctgattgtggtagacttcacaattatactgatttaaaacacattaccatgtactttctggctcctagtaaattgctattcacttaagtgttatctctgagtcctaaagtgttaacagacctaccaaattatgtgaggaatctcgccttcccccacaccccaacaagcttaattttctcttgaatatttatctcactctctcataactttcatataatttcaaactctccaaaacacacccaaaaagggagctgaaggacaggaagggattatatattttttccatggtatattctcttctaatgcagaaaggcaattaggcaaaacaagttaaaagcaagctaagctttttcttcttgagcagtgtagaacaaaaggctttatctgatttatgctaaaactagttcattgcaagcaggatcttaataccctaatcaaagaaatttaaaaataaattaaagaaaacatctcacctttgttacttagaggcaaaaattacgacaaaattatttcctggtcagcattcttagactagcctcagctattttttttttcttgaattaagaataatgaaaatcaccataaaatgaaacaaaaaaaatgtatcacaaaaatattttgcaattctctttctgcccccttccattttacttcctttctcaacatttgggatttaatgagctttaaaaatatgtatacaaaggataactgtctttgacttttttgatctttcctccatgtagtttgtgatttaaaaagttagttgtttcctttgaaaattaattttatttgactcatcattagacacccaatactctgccacatgttccactattgtgcattcactattcactagaaatacattacacactttaccgatattcatatacttcatccccatagctaaaagagatttttagattttactatctgtgctttacaaatgagacaaatgagtttcaaagaggccagataactttcccaaagccacacagcagatacatcatgaatctagggtctaaatgtgggtctacttaactccagtctccatgatccttggctatgcttgtgcaacaagatttcctcagcatctttcatgtaccaagctctacccttaattcaaaactgaaaatatcaaagcccctgccttcaggggtatcacattctaacaacagtgactgaccaataataaatgcaatccagctaaagaactttataatagaggtaaatattaggtataatggtgttcctaaaaaaagaataatccacctttcctagtttggggtaggagtgccagtgtgcgcaatgactgaatatatactgctaacagctaatctttgaccaaaaaagtaagattcagtctatcattggattctgcttcctctataactccaggaatcagccatgccaaatgtgctaagggcttccaactctgcacagatctcactggggctaactcaagggctggacaatgccatctgacaagttccactgacattaaaaaatacttgtctggtgtcccctatcatcaaatccctccttaagaacagatacatcagttaaaattatgtggcactttcaaatactatcatcatgatttattgcaacagatgggaccactgagagatttatctttggcaaggggataatttttggatccccctcaaatcacatgcaatatgtaaccatctatgaatagagcttccctagaccctaaagttgccctctcaggctgctgtcattactctttcacatctatttctacttggagaaatgagtaacaccttgctcttgcagtgacaacattacaatctcgtgttcttgtccccataggagcttgaccttatcaccctcatcactctctccctgctttttcttgtattcacactaatctttcaaccacttcctttatagttttttttttaaatcttaccatacatttccatataatttctatacctgagtctgtcatttctgaatgtctaataagaatactgtctattatttttcagtagaatccatggaccaaatttctaccccaataaagcctgaattttgtacatacaacatattcttgttttatttaatggttctttctccacaatttccagaaaaaagggtcattatcatcatccttttccattgcatcaagatatatttgtgccagattttaaacgtgagctcagtatttgctgtttagcttttccttgtctggatcctttttccattgtacattattgagaatgatcctaaaacatattacaaagtgtccataggtgggcattacatacaaagtttaaaagttgccacatattcaatttgatttttgttttgtctttttgtaaagcacatggtctgaactctacacaatgaaaattttaatgacctttacaacaagatttgaaagagctcagtgacatctttactaatgtgaaaactgacaatttagtttcagggatgaagggtagatctaatagaataactacattttttttcagtcctttcataatggagcaacttcttttaaagcaagttaataattattctttttattatcaaaaaaagtctttcaatgcagaagcattatgaggtgagttatcaagttgtacatgtcactgcaaggaaaaaacaaaaatcctcaccatgaagattaagtcctcagcttttggaggtcaaaggtcaaatcaatgagttgatagcactagtcacaaagtgactgggcattagatcttctgggggaaggagtgatctcttttaaagtacaggatgccaatctgccataacctagtgaataaaatcctctgttaagttccttgaaaaatctctattttagaaaatgcatcccaggtgattgtgggagttcctcaacttcagaatttagggaagctctatacatagagggttacatattgcatgtgatttaagatggtaccaaaaattatccccttgccaaagataaatctctcagtggtcctgtcctgttgcaataaatcaagatgatagtatttgaaagtgccacatatttttaactgatttatctgttcttacacagggaattgatgacatgggacactagacaagtatgttttaatgtgagtgaaacatgtgagtaactgctctgggctgtccctctgagaactactaggtagaacaatagtaatgatctcaaggtttgcactgatgtttgagcaactgttcagatgttctgacagggaagtgagctacttgaacatgtttgattaaagaatggttctcctatgggctttctctctattcagggaataacatgcttaaagtagttaaacaaaaaaaaaaaagaaaaaaaaaagaaataaactggaacctagcctaataactggcattcgttctataaataatgaggacaaatgccaaaccaaagagtcctcacattcatcagtctaggtgttggctttctttgggatcaatcagcttctctcttcttccacctcattggtcagtgcaaatccaactgctctttaagactcttaacttcagccagtcctctggaaaagaatgccactggtcactgaaagtaccgatgggtcagtgtaaatccaaccacactgctgagaaaacaattcaaaacgcatttctgctgactgccagacaaggtattgttttatttaaacaataaacacctgaaagacagctgttaaaagccatcacatcattcttttaggtcagtatagcatcaaacattatctgttcactgagtttagaggaagatttctggcagattttgctactagcaatctatgaaatcctatggctaacttgtgaactagggtttccctgtgaaatggaatcacaattggacaatttagggatttccatccctctagcagcagtttagcccaatctaaatttgattgtttccttaaatggagtaatttaattttctccaaatgtctacagactttataatgccaagtccagaaaatgaaagggaaaactgggtcagtttcccaggtaactcaagccaaagaataaaatattgctttgaaattccttataaagcataagttgttttaattttctgaattatcttattcattgtctcagtagtgtaattgtatagtctatacctgggttatgcaataaaatagtattttaaacatgaaagaaaatattagtctcagttcatagttctttgaatatccctgcattttacctgtttgaaagttaacacgaataattaatagagagtacttcagctgctcctattgtgaatggactatcatggggtcgtaggtacatggcaaacaagccaaacagaaagggagaactgcagttttgtgcaataggcatttatataagtaggtataatatgaatgcaaaagaatacatcccgaaaatggtagctattattatacatgtggctacatttcttaatataaaccgtgaaaacaaccattctgaaaagctgtgcctttacaccacatgtaacagtcccacataaagcagaatctccttggtgattacagtaataatgactacgattgaatgaaaccctttagctctcactctcttttcgaaaggacaagtaataggacatacattttaagcaaaatatggcctcaggcactgtagtactgttgatgctttttaattcgaagatttcctaccattgtagttcttcagcacaggttctatggcttaggacagccggctgtggacctggacgcactgataagtcatctacttggacatacaataatgtatctgtgtgctgagaaagaaaaatcaaaggcttttgggtgtttatgcctacttgatgatctcggaagaatgaatcaatttatatttattttagtgaaagataagctacatgaccataaaatataagatctacttcattttttgaaactttccatcacaaattgccaaaagatccttcctgaaaacgtcgcaatgaatcatgctattcagaagccaaacttccaggatcctcttcctgttacttgtatagacacagagacatgcaaagattaattactgtccctttcttaaagaaatattcatttaagactgagataattagaaaaatgtgaaaagaaacctttgaccatcagtggttgtgaaagtggtttttaaatcttttccaaaatttctagaggcttcttgcattggacagggaatgagaaagataaaaagtgtcaaatctgaggccacttgacccacaatacgatacaaaaacttttttgttttcgttgactttgtttattcttcatagaaagatttaccttggagcaaaaaggaaaaagaaatttaaaaattagtgtactatgagaaagaaaaaatatccaaagtaaaacccaaaggaaacttgacaaacttgtttagctaaccaaccagttgatcattaaacaagaatttattgagtatctatttgtgccagtcactgctctagggacccttgagacacatcagggcagggtagagatttctgccttcaccagattccttcctctggtgaaaggaagacaaataaacaaaataaatgagaatttttttaaagtatgttaaaagatagtaatttctatgaagagaaactagatcatggtatggaagttcaggagacggccaaattgcagtattaagcagggtggtcggttttagtctccttaacatttttagcaaaatcttgaagtatgtgagaatactagccaattatttaactatttcaagataattatatgttatttttccaatatagacacctcagaaatatatctacttagcttttccttgaaaatgtggtattcagataactaggtgtcagcagtctcaactatatatcattctgtgaagtcattagtatggcaaaacattaatttacaaaaaaagtttcatctcattggtacctccagtccatgaaaaaatgtctatctccctgcctccttcaaccaataaatttgcatctgaaaaccagcattttaccaatgatttcctagggttgctcaaagtggaggcaagcctatttcatcctcattattgtatgtaagataaatgttaaagtgtaaagagtaacagatatctaaataattttgattgaggataatcaatctttaatacttttttgtacaaatgttctctgtagtacggatcatcaggacatgggtgtctagttagtttcaaccaaagacaatgccagaatcataaataatagggtattaatatgatggaaagaagatattaagataatgatactgtttttgttaaacctttggcagattacagatcaatcgttttaaaatcatttaatccaaatgcacacggtatcttttccttattgtcaccattaataaaaagcctcctctatgcacttttgcaatttgtcatgtaacattagcctcagtaattgagtatttttattaatccatattacagatcataaggttttgatatttgaggctaaattatttactcaaggtcagtaaggaacaaatctggaatatgaacccagctcttatgacttcaggactattacccatcagttacaaggtggagttttactccctcaaatgaaaatcttgataatgagagacaccggcattctagataaaaatctgtgaatggtttcctttatactaccactaaatttattgactaagaataagaagatgaaactctgtttcatgattattagtgtttaactgaagaaaaatctttgaagtctccttaaggttggctattctatattatgatagttattttggttcaaaattgtacaaagttttgcctatcataataagcagcgtcacctttcatgccttgtaacacaaagagggacaatattatattattatatttttagaagatctctaatattcttctctgctccaaaatgttatgattctaattaaagatccaaatttatctagtttaagagctaaagactatagaaaattacattgttttttaacctctgaccagcacaatttaggaaatagcctcctatcaagcctaaaagtgttgatggttgttaaaaatctagattaaaaaagtacatttgcaaatgtataaataacataaagtcattattttggagaagaaataatcagtttaacctccattatgtcataatttgaaagttttgctatttgcaacatatttcagtaaaacgcatctaagtttctattcataccacctcattttttaaactattaaagtacagagagtcctttctgtgctcctctctgaggataagttagtctacaacaagtttagtaaaagtcttgtttagatgatcagtttttcaatgttatcattgtttaaggaatgtataatgacacagaaaactttgcttcacagagccaggattacagaaatacattcaagctgggacttttattagtaatacatgtaacaagattggttaaatcacagcaagagataatacataagcatatactcttcaattagtttttcttggttctactcagaactaatgaacatgtaagctaaagatgaactagtaaacaaacattgaattctaaatagtcacatagccttctatgtgtactgtatagataaaagtagatatttaatgtctgatattataaggtgaaactccggtcttcccacggtctgcggctgtgagttaaggggatccagtattgcaagagtagaggtaacacagtagaaaatttaaacaaatattcttacttcttagtttgtatatgcaccaaacacaggcatttcaacagtaagggtctgtcaacattcacaaacttttctgaacaaacagatgacttattattatgaaactaaatgaggaaatacaatttaagaatttatacagaagaagatacatatcatattttaataaccaaattaggtctatatcagaaatcacagcaaaatatattttaaaaagcataaaacaaatatgcattaggattttagtaactggaagttgtgcacttcacagacaaattcgctatatagcaacacaggacttgaaaatggtataaaaataaaaatcatggaaactgtgtgatctgaatgttgtatctttccaaaattgataaactgaaatccgaacccacaaaatgacggattaggagagggggattttgggatttgattaggtcctgagggcagagcctttatgaatgggattgctgtccttataaaagacactccagagagctctctttctccctttcaagtgaggacacaaagagaaggtagtgatctatgaaccaggaagcaaaatctcactggacaccgactgtgtcagcccttggtcttggacttcccagcctccagacgtttgagaaataagtttctgttacttacaagctacccagtttatggtatttttatatagaagcccaaatggactaagacaaagacaaaagaaaatgtattaaaaaaacaccaaatgctttattcttttctaagtattaataatatcaaatctattataagagtaagtttaatgaaatattattgtggtatgacagtatagataaaaatttaaagcacatggtaatattagatattactcatcaattagttcaggtggaagagttgtatccaggtcttaacaattacaattagctttaacaattagttttgagaaaaatctatctttattacttttataaattatactaatttaagatctactcttcacaaagagaataaggcttatgcactttcagaatgtgtaactatattcttttcagttctacttgtaatattttgctcttctagtaacatgagaagcctggataattaaacagtaaatgtccatttgactctttaaaatggacagttgaaaccaccgcccccaaacaaatacatttaagtcatgaaaatcgcaaattcaagatacaataagaaaaatgttctggaaatacaatggtcaaagagaaagacaagctttctgccctcatagagcttacactctactaggaaaagttagcattaagtataatcacaaatacaaatatgtaattacaattatgatgacttatgaaggaaaagtacaagcctccaatcaaagtgccaacattcgctgataattattaacttgtgctcctgagctattaaccagctattatggcttgattttcatgtataacatattttgacttttttgtaatttaaatagtcattcatttctgataagccattaaagtaaaatataaataaacaatcaaagcaattattggaatgaagtgaccagttacacatacataggaaaagaaacaagaacaaaagagaaaagacatacttcattcaaggcaaacagataaacctaaattctaaatagaaaggagaataaaattagcattatcaatgatcctaacaacaacatcattgacaaatttcaagccccaaaaaaatgtgatccaaatttcatgaagactatttgaatccatctacccacaaccagcaaaagtaaggttggctttgaataacagatcttcagctgccccaaagaaaactataattcattcaaagtttattcttaaccatatccagttaaaggtgacatatctttgtttaggaatgtaaaaaacacaagtaacagactgactctaaagtttgaaacaggatgactaattaaaaataggaggcactatggcctatgagaagaatgagtaaactcgtgtttaattcattgtgattctgccagcccacagcagtggtctctaacatgtctccagctgacttcgccatttttgtcatgtacacatgataagggattttgcagtttccaaaccctgagttgttatggagcacagaaggatcaacatcaactctgtaaggacacatcacaaagtgagaccagtgcttacctcgagagaaaggacttgagaggaggatgaagaaggttatcaaaaggcatgttctttttacatgtgttaattattttttaatgaaatatattcatctatcactggacatttaaacagttagaaaatatttaagaattcataaagaagaaatcaaaataatgaagatgttcttgaatttatttttttatagtctttttttcataaagaaagacattaatccacaaaacttcattccagatcccctgaattcactactcacacaagagaaaagtggggaaattgagaaaattgctccatgattatattgagatataaaaatttaggaaacataagtttacactgtaaatcagttatataaactgtccagacttaaccccgattttatgcacaactaggatttaactccacataggaaattgcaatgtaaagttcctaaattattttttccagatttttttttaattcctccaacagatggcacaaggtggggatattcacataagacagacttggattgatgttatgctttcctttttctgaattcctacttcactttgtaccagtctcacagcacttccattctgtcattcattctaacttgcccaaatgttttcatttccttgttatatgaacactctgtggatgccatgtcatagtcatgattgtatttctgctctagaatatagatttgttgaattaatctgcaattagagaagacttacaatcacctttctcatttctctacatctaattaaacaatatgaaatgggtaccaatgtgatttgcaaaatactcaagtccatctaaaaatcttctctctccatttaacagcaaaaagcttactcgtcccaataatagaagaagaatgcaatgaaaaaaacaaattcctgtcctctgtgtctttgtgctgattgaggaacaaaatctgatgaaaactggtgaagttaaaaaataatgtttgacacacatgccaacagaaaacatttaagactgacatagaaaaactaaataaagttaagtgacacttgacattaagtacaccaaaacaaatatcagctgagtataaacatgaactattccatatgtagaaaatggttgtataattaaaaaattattttaagagttactttttcacaaaataacaaatatacgagtgtatatacttagaaattgtgtatttatacatgcatccatacaaatacacatatgcatacatacaaacacatatacatatactttactcagccagtaagataaagtatattcttccctctatgccatccctaagtccacaaactaaagaacatgatgagaaatgcccacttaagagaacgcagtggatgagattttggcctcaagtaaaaatgtttagaaagcactcaaaatggtacacaaaacctctaaaataattgatacatactgtcatttgcatagttgctagaggcttaatatgagattaaattatactattgaaaatagctgccaaaaccaaaactgtgataacctatgttgttggatcaaagtattcaaacagcatttgtttctaaagctctattttacacatttaaaattgatatcatttcttacatattgcctggctcatgttcagatgctttttcaagcagaaaagttttcctgctagatgacacaaacataaaggtgcagaactgtgaactgtggtcccaattcaccagattaacactgagaacacaggaaagaataaagatattcctgcatttaaactaataataataattaaaaaacagaaactaaatagaaacattcactaacacacagttaaaaatggttgatttaaagactattctatatgtttgccacagctgcataccacttacttccttttaatgacaacattaaacacaatgaggatggttttaaatggcaaattacacatgcttctggatttcgtaccaacatcatcaaagagtacacatgcctgacttaccaagcaatgcgggaatgcatagctagttgataatgcccttaaaacaaagttagtatgcataaaaagaaatgtcttgctcctctgtttgtctctttcttaatactgcctttttaggttactacagtgttcatgtgcataaatgacacctagcagacaacaagatgatgcacccacagcagtaccatttcagtggtgcacatgcttagacttatgtctcaatacagaatggctagggcaggtgtgctccagagctgaatatttgaagatcacatatttacagttcctacacttatttaagtaccattaaatgatactgcagaaactgacaccgaaacttgtagctaatttctaaatatattaattatgtgagcacctgacatgaaaaagatcactctaaagagaaaaaaaagggtgggggcgaaaatggaaacatattgatggatttttcttatcttaaatttataaaatatttattaacacatatacctacctcccagtgcccattaccaatgccaaaaggtctaaatacatttatgtaactcagacacactgtaattcatacagatgatattaagaagaaataaaataatgtaatacctttacttttacctatggatttgatgaaatgggtccatgaagaaagggtttccagacaaagaggataaagaggagaaaaacaacaataagtattatgaacatatgtaaagccactactctctgaaaattaaacaagacatgaaagtataaacaaggttttgaagacaaatggagatgcaatcaggacatgttgggaattctgccttttttgaaggcaagtacatgcaaaaaactgaaaggcccatgctcagttttaaaagatcacacaaaagagagacatacaataaatctacgtagagaaagtattgattctgtggaacactatactcagcattctacaagccagaagccaaagatgtctgcatgttcccaaactgtcatgcatggatgaaaaatggacttattttttggatacagtggtttaaactgaggatcttctttcagacagcaacttctgatggttctcggtttttctttaccataaccaccctttactgcatatgctgataagtatatagaaactttcaatcacaatttcttatgtctcatttatttgcaaatattataatgcaagaaatgaaggaaaataaaagccacaggaacaaaccaaaatcaaacgaacaaagaaatggaagaaaaacacatgaaaaaatgtgaacaaaagatatgtatttaatttgcagccatataatttgcaagcatttgcccatcctttgcagtgatggtttgaaagcagctacagaacaagaaaacactgaaagcagagtggaaaaggaacagagcccataccttggtcgcccatcatcaggtgcgccagaccttgaagggaaacaagagcacagtcagcaataaacaagggagcatgggaaggcagggttgtcacggtgacaaaaatgttcagtgacagacatctcttttcctatgagacatgtctgtatcacagaggcaaatcaaaaagcattctttcaacccctggttggaatgctttggggcaaagtgttctagaactgcgttttaaacactggcatatgctgcactgtgtatttcttccatgcatcagttggaacaaccaagagcacaagagcatgacttaaaatccaaccaaacccctcaatattacatctgccctctgtgccctttaatgagactgttttgcatattgcccccacagggcttgtaattcttcagtgatgaaattacatttttttaaaacccaatggaatacatgaaacatgggctgggtctgatctttttcccctcatcaaaaaatgagcattttataattaaatgaagaaaaaaaaattgtagtcacattgaaatgataatgcagaaatgtctccttgtctgacacatgtagcggctgactaggcttgttcaaatacaaaatgatcattagacatgcagttgtaaagctagaatttactacaaaaaagggtttttaagaaacaatgggtcagctgcaaatacactaaagcaattttcctcagagaacaaaattatttgagatttcacctaaatatttcttaaatgctgaactctaagttagtgtaaagatacatattacagatgtaatttcatcaaggaattctttaaaggacattgaaattcctttatttaatttatttattatttcctgcttgacaattcacttcaaactgaagagcacttctcttctaaataatactactaacatgctttcaaaaattcttttgctattcaagaagttactttttactgaaaggcataattcctagctttttattttaaattcagaaataaagctatttctctatccatgtatatgtctacaatacgggaaaatgttagagaaatacacatttatcagttttaataaacttgtattttcaatttccagtgctatttcagatatatttgaaactttatttgagctatataacattacacattggtttcatcagtatttaaattatctgtgttgttttcttaaaattttaggggtattcaaacatctctgtaggctagatataattacaaataatcatctaatcacaatataacatgaaagttattaaacacagtagtgtgatgcctctgaactgtagcctctctgtattttctgagtgattttaacaaaaagttcacacaggcagattcaacagcttatgatctattgataattcatagtgttttatatgctgatagtggcttatttgtccaggttacatattttttcatttaatttcacttttaaaactactacagatatttccaagtaacattttataagttttatggactaaatgaggaaattgtcttgaagatctaccttttagaaaatatattaggtacttccaacggttttgatgctacatcaataaggatggaaattcactaatccccaaagaattcacattcttcctgctagactttctacctatactgtaaaggtcatattatagatagaaatattaaaattatgattgaacagactttattacaatagcttatgggcctatattctaaaaataaatcttaccatgggatgagtgtgtgtgaaaagagagaagcattcatgctaattaggctgattttaaagcctcttgggatgcaataggattttaagagaaaagaaaagcatttcacaggatggataaggaaatgcaaaagaagttgaaaagatacctctaaaaaataacttttaaactcagttgacatgcacaatataaatgagactgacttcaaaagatattaggcctgcagggtaatatatcatttttatcaagtatatactcacatgcaattaaaattatagtatacaaaaacagaagccatatatggatacaacacttagaaaatagtaatttatgatttcttttaaagttttaatctattttatttaaataacaaaacagaaatgttcagcagctaagcaattataatattatccatgtacgaatcacaaatataatgtttacccctgctactggtcaactctgtattatcatgaagtgttctttcttagatacatgaagtcttggtaaccttaatggctatttatctgtaacctgggatagggagtctttttctaagaaatccttcattctatggaaatgtacatttacagaatgactatatttcaaaatatggtagtaaaataaaatatactaaatgctgtcttcccatatacaaatattagtaaattagtaaatctttatgtaggaactgttaatgctgtgaatatataagttgatagaacatatataatttgataaaaccttccctttcaccattcttttgttatgccttgttctttttgcatgttaacactttgaagatttgtttgtagcacactgactaatgcatttaagttcttaaaaaatgagaataaggaaatatgttttaatttgctggattctacaggaaaatatataagctatataacttcttcaaaattccttgacagagataattttttataaaagactgaataaaatatttagcaggcaaaaaatattacaaatatacttaccaggaatcatatcgaaatgctgtatgctttcatgtccactggccaatggcttattttttaatctaaatttatgtctcttacttatactcagtactttattgcattctttttatacatccaatcattttaaacaaaccaatgggcttgaaatgagataatgctaaattttgccagaatagaataagtcattttgataaaaaatggaaaaaggatcatgcactgtcttatgaaactacaaagaaatattttgtcttttaaagtaaaaaaagcagaattgttatcatttttctcatacagaacactgtaataactattctaagcttcatatgggatgctgaggtctaacaagggttggagttaagcttgaaaaagtttcatatacttgggatggcagggttgagaatgtatgtgttctgtatgaaaagtgatacacaatccagaaaccaacaaatgttcagaaagaagttcaacttaccatctaacttcaagatgtaccctattagtactaagaaataaaggacaaatgagagttggaaaaataaggtagaaagcacccaccttccacattgttgtcttctgaaagcacatgacaaggagggagagaaaaggaaaaacattcattaagcagcatgcagactggaccttgcctttgcatgtcttcctcatgcaaggcaccaaacacatcatgcaagtgctccatcactatcattcaagggggaaaacaaaatcacagggaagcaggttccctcccattggcagcattgataggaagtgagacaaactttcataatactgccatgccctgtgcaaagagtttttaaaaaaatctttcaactacccagtataaagcaaacattattgttattacatgttgctggtgtggtctttctaggcaattatttttaaaagcttttttgttttctttttaacaattctaaaaggttctatttccacatactgatttggccttagattttaagaagtctattggaaagagctatgaaatttcacttaaagatattccagttctaccaaatatattatccatatgccattactgccttttagtatttctaatacctcaattgctttccttaaagaaaaacaacgtaactatatggaactaaaatctgcaatttatttggttaatttatagcatattaatattgtattgcaaatgagaatagtttattggaatttataaaaatgctaacttttaaaaatgttaggtaggaaagtgatcactggaagagaagtccactgggaactgtccataaggcaatttggtttgtcgtgatttaaaaactttgtacttctgttgaggatgtgaatatgaatttgtttgagacaatgaaaatatttagctcaatttctcttatatttctatatatctataaaatacctacatgttttcatatattttgttagtcatatttccatgtgtgtacctatgtatatatgtataaacatatatatccaagcagatttgtatttcccaagataatcaatataaatatataaggtttaaagtattattagtacctagtggaaaattcaagttctatttgagactcggggcctgcaatcccggcaagaaatggaagggaaagctgtcttaggggactagggcaagagcaaggtttcagtagttatcaaaaatgttctaatagtaaactctacccatgttgacattctagtctcatccttattttttgtttaattaattgtactttataaactcatcatctgatcagaggtgtttataaacatggcaacatgcaagtatagaaacttgaaagcaaaaacaactaagaatgtaccatttgattaggttcacctaaaaccttcttaattggataaagttactagtgaattaaaaatcaacaattttgtttaaaacatttcagctgaaaattgaagtatcaacacaggcacatctactgatgtggtgttagcatgtaatagaaaatggctggtggctaaatgtgggtaataacatctttacacaatacttggttttccagagtttatttttaaagaaacaacaaaaaaaactttcaaatatttggtctgtgatattgacttctagtttgtttttgtttgttttttggactgccaatttattaaacaaggaattaggctgaatttgttacttttcagtggtgactttgatgttacacaaacacaaatattaaagttttgttttactgcattatattggacataatacaaagatataaattattgtaatgtttaagatatacttttcctgtatattaactttgaaattgtatcttctgtttaagatgcttacttaacaagattatttaatatgtattgtaaaataataaaatcagggaatttagaggagagtcatgtgccaagacagtatgtcaattgctacagcattatttaatttctgtaaagacgggcaaatatggttgtgaggagcagtgcttcggtagaaattttggtaaagtgtggcctaaaactacaattaaaaaaaaaggaaagaaaagcaaaccaacaaaatgaaacaggcccaggcctgacaccaactttaggaatgcactaagtagggcattataaaaggagttcaaggtcactgattcagtcctgacggcaagttctcctttcatgaccatagatacaagcctaggttttgccatggatcctactctaccatctagcatttttttctgaattcttattcataatgagaacaagcttaataatgggaattcctttaaacgatccaagtcatgtttaatgtgtaaacaaattctgactcgactaaatccagaaaagtggtctgtctcagaaaatttagatttagaaaaaaaaaatcaaagtactagaataaatgggtgatatattaaccactgtttaaaaaaaagatggtgatgatgatgaagacaactggcttggagcagactttccttgagtttccatatactttcagattcaatctcagaataaaaatcctctttcctcttccattctattctattctggtatccatttgctaactttacataatttaaaacttgttaacctaaagaaaatccctacattatttcagaatttggacgtgattataactggtggtagctccagcatttacaaccattctccaggtatttttttcccttctctttcctttccattttatttctgtactaaataataaatgtcgagtcaaaaaagaatagtttatctcctcataacaattttttctttatctttgtaaattcttatacacacaaatgctactttgcttttgagcagcaacaaagacaggtgctgaattttggcatgccacggtgtacaggtaaagcagcatattttggtttagtgtaaggtagaaagcagtccatccggccttacctgtggacactgtcaagttagggaaaatctcttggtttgcagaaaaccctggcttcttaattctgctgacctaatccttgctgagtaaatgaagtgcgtctcttaatcattaactttactacgatgaccacgccacctataaagatcacactcttgctttcttttcattggaaaaataatgaatatagagctgtgaaaaagatactttacattttatttttctttcagataggatgggcttctctcacaaagatgggaattaggcaccagaatatcaatcatgctatgaataatggctgtgtgctgacaagaaggcaagcaacagcctgttttaaaatcactgtaaaagagcatcttcacaaaatttttatcttcggcccccagcttataagaatgcaaggacagtaactttagtttatcattccagtgttctttgcacatactcttaagtatacggttctaggaaaacaaatgaatacaaaaacaaatgtgcttgtttcaatataaagaaaatcatgaccagtaaaaaattaaaatttggaataaaatatcacaaaaatctcctttctgtataatcagtgctaaagtttggcaatatgtaagtctttctctaaatgtacagacagtggtccatttagtgctacaacttacattaaaaaatgaccaaaagaagcttcctgatatcacttgggcattcctttacttctttaatttttggtttccttccttctctgctagatgcctgtgactggctcccctcattttccttgattccctctctcctccatcaaaactgccactactgcgagtagcttctgtcccagataccagcactccaaggtatggcatattacagcaaaactggtggtggtaacaggcagtggaaagacagatgaagaataagattctatttccttcctccatacagggagtgtgctaacttctatccacgtctctctcgcccatcacattacttctcaagcctgtactcctcattttggagatcaaatgccagtacagcagagcttagttcccatggtggcacaggatggagctttgttttttcttttggtattagcagtgaaagcctttaaaaaacctcaatagtctgggaatgcttcaagcactgggaaatggaggaaatcattgagactgtggattaaagcagcagtcagctgaaggaatagaaatgcggcccagaaccaagacgatgttcaaagagaaaatgaagcataaaggtccattatggagacttagggaaggaaagaaatggtcctggacaggaattgggctaatttcaaacatgctttttaacagaggacatcacctcctttttcaatcccagctaaataatattgcaggacactcccacccagcctgcttggagtactcatcctaggaaatatatggagtcaactacaacaaccagtttttctccttcttcactgctcgggaataaaaaatgtatctctaaaccggatgcagcaacacagatgttcctggcatcacactagaaacacttaaaacaatttccccccaaaatattttgttacaaagacatttgtggtatttaattcaaaatgttctatcttgttaatgacaattaaaagaaagaagagaaaaagagaaagggggcaggaggaaggaaaagcaagaaagcctaaagttattgcgatttatagtgattaagctatttgatgaacctgatgaaatttaataactgttagtcaacatattataatataaatcgaatgactcacataagctataatgaattcaatttcaaattttcatgaggaactactacaaggattttcaaatttgttttgctttgataatctcagttcttccccaagtctaaatcttgagagttaacatttcaacattcatttcaatagttggacttaggaaggaacactgaatttaacagtgactgtaaacatggtgacaagcacagtctacagtatgtgtgctcacaccacctatttttattttttattgctgagaaatgaatgcttcctgatacggaattgacagacaacactgagcagagtgcttatcacataccctcccaaccaagcttaatcactgttaaacaactctcctaagaaaggtggctcaggtgagcagtgctttcctttctaagagtttgacgtcatcatattttaggatacagagcaagaaagctcttggactgaggttaagagagtgaacttaaatacaccctacctactttcccaacttaccaacccttctagtggttatgtggttttgacttctttgttaacagatggacaggagacatcctttggcctgtgtattaccatcagagaatattctgcaatgtgttctaggtttgctatcattaagatgaaaagtaggtgaactcccactaataagactaatggtcttcatttgaaagagctgtcaaatgtctactggtatataaatttttttcaccattttttttcatcttactacagatgtttttcaactaaatattaaaatactcttaactttattattctatacctgggttcttagacatgtccaaaacaaatctatttaatttatctaagaaaaggcaaaaatactttgtgatgaaattaaaaatatgactaaaccacattgtaaaaaggagtcttaagtttgatgcttaaaaattacatttacatgcagtgtacagaaaataaaattatttatatgatatgaccgacctgacaattatacattctttttatatcaaagaaaaaatgaaattttatatcaaattaaaaatattttatattgttatcttcacttcaataggaccctcacatatgtaacaaacagcttggaaggaagctattccttggaaggaaaaatgcacagcatattaaaaggatttgatttttcatttcttcagagctcttagtttttcattttatatggtgttaaaaattcactgtatttacatgtgtcagtttatgactaaattaatttcaaagttttatgaaaatcactgaaaattattttaaaaggaataggccattcttagctaaataaattagatcatacattgaaattttccaggaggctctcgggattgattaaaatattattttttttttctggagatggagtctcactctgttgccaagactggagtgcagtgtcaccgtgttggctcactgcagcctctgtctcctgggttcaagcaattctcctgcctcagcctcccacgtagctgggattacaggcacccaccaccatgctctgctaatttttgcatttttttagtagacacaggatttcaccatgttggccaggtgcctggccaaaaaatattacttataatcaggctgagcacggtggttcacacctgtaatcccagtactttgggaggctgaggaaagtggatcacttggtgtcaggagttcgagactagcctggctaacatggtaaaaccccatctctactacaaagacaaaaattggctgggcatggtggcacatgcctgtaatcccagctactcaggaggctgaggaaggagaatcatccttccttcctgctcacttttggtttccatttacatggaatatctttttccacctctttacattaagtttatgtgagtccctatgtattaggtcaatctcttgaagacagcaaatacttggttggtagattgttacccattttgccattctgtatcttttaagtggagcatttaggccattgacatcaatgttaatatcatatgttcccacttacaagtgggaactaagctatgaggacacaaaggcaaacataatagactctggggactcaagggaaagggcaggagaggagtaagggatacaagatacacattaggtacagtgtacactgctcgggtgatgggtgcaccaacgtctcagaaatcgccactaaagaacttatccatgcaaccaaacacaacctgttcccaaaaatctattgaaataatttaaaaaaataatgtgctagaaaaacacacacacaaaatataactactggtatcacttttttttcttaacagcaatagaataaatgagtaagaagactgtgagaagactgaatgatttcatagatcctgctgcaagaaggcagaaaaacctcagagaaaaatactattttcttaattgcatttatttgttgattctataaagtctaagaaactttaatactgcttaatttcctttattaaagaaaaaaaaaggctcccagtcctcttctctagattgttacaataaattgcttcctcaagaaaaaacaaaacaaaacaaaacaaaaaaacacgcatttagaaaatattttgtcctactttaagagcaaaattaggtccaggtttataaatgtgtttacccatgggcattctaaccactagaaatcaaagaaagaattattccataaatttcttgctgtctttaaaatttaaagaaaagcactcgtttcatacccatcacataaattgtgccttccttttaaaacatctgaaacaaaatgacacttttgttcaaagccaaatattttggtaggtgagacaatatattatgaatttgccacataaaatatatttgctctttcatttgagttataaaatgcaaatttggtaaaaaatattactttcattccccttacatactcgctgtgtagtaaatctcctgggaactgagcagcaaattataattcttttgcaggaagaaaaactaaatactatacaaactgcaattctcttttggaaaaaaagtgttttgtgttacagagttataggaaaatagtttgttcataggtacaaccaattctatacttttgaagatattatatatgtagttatttgagttaatgtctagtgactaaactaaacccatatgaatattggtcatgtggaagagagagccatgatcttgattaatccattttatatctgttgatttactgatccataaaatcaaatcaacacaaatacaaatttctaggtaccctaatgattcctttttaatgttttcctgaaatgggcattcactacttaagaaaacatgctgaacagaaagagaaatttccttttgtaaccctaatatagcttcttaaaatattaattccataattcagagaagttcactttactttttaaaaatgtataataagaagacggtatacttaattacttcttcaaatttgtttaaactgctttctatgactaccggcaagtctgcatttctaccaaaacaatttcaagaaaatttaattttaaaaataatctcatcaagccacacctcattatatgttgctttaaaatgtgtggcaatacaatgataccattacttcaaaagctcctccctaaacatcagtaccagcatgtgtgtatctctctaacacatatgtgtatacatatacacacccaattggtatttcatttcataaacaaatccaaactgtgatatttttctcaataaaaatattttttctacaaaagttaacgtgaatagaagaaaaacatttataataaataatttgataagatcatcaataataacacaactactacatgaccacttttcctataaacattttaccttactaataataggcattaaataaattataaacttctcttttcctctttgtatctgttatttcaattttgtttgtacgtattagaaaaacagagtgttttctaactgcatgattgaatatgtaaccacagagacatatggcatatttctaagtaaaattaaaatttcagttccttagccatgttccacatgctcaatagccacatgtagccactggctaccaggctggacagcacaaattgtgaagctttcagtcattacaataagttctattgagcggtattaactacagcttctctgacaatatcttttaatatcaagctattcatataatgtacatattatttgttctttattcaaaaaaggaaataattaaaatgcatgatggttttaaaagcaaacatctatttagagcagggttattacatttgtgcaatatggagaactttgtaatatttccacttaaccttaaaataataacaattaggaaataaacctgataaaaattttattgtattcatttaaaaatgtgtttgaataattcaaactctggacaattattactcttttcatcataagtcttttcctttagacctcatagatgagaaaacgctgaacctattttgatttttaagtaaactaaactagtaatctaatatcgtcttactcttaagcccctcattctcgcagtatgcccaattagatcatttatcattactgtctttaagtctatgaccatttttcaatgtaagagtttaataagcttttaacagagtagttttaaaattaatttaaaaagcgcctttcatcctactatcttatataatgtattctcttataggtcaaagactttccttcctataacatgggcctctttttgaatattacaccatagaaaaataaaccaaatgagcaaataaaatagtcaacatttctgtaagacttaaatacagcagagataaggcaattggataaatggagcagttcacacctctagttaattctagaaaagtccaagatcctattaaggaactactacatagaaataaatgaaccaatgagaaggcaaataaaaactgagtagggagaatagaaaaataatccttaggctgggcgcagtggctcaggcctattataatctcagcacttcgggaggccaaggcaggcagatcacttgaggtcagcagttccaacaccagtctggtgaaattgcatgtctcttaaaaatacaaaaattagccaggcatggtggcaggcacctgtaattccagctactcaggaggctgaggccggataatcacttgaatctgggaggcggaggttgcagtgagcagagatcacaccactgcactccagcctaggtaacagggcaagactgtctcaaaaacaaaaaagtaacccgaatatggaatggtagaaaagcaaaagaaaaaaaaaagtggcaaaattatctatgggatgaaatgatgaaataaaaagtttcatgtcaagaatgagtaagatgtataataaaaatttataatagactttgccaagtctattttagtatttaaagtattttccaagtctattttcagtgttgaaagaatgctggcctgctccaaagattaaatatctttaatgattatagaaaactgacctttttatgttagattagtgacatcaaatctctattgatacatagtgaatgaaataaggcaatgcatttatacctcaatttcctaatgaataacatttaatctaacatttaatccatatgtcccaagcatatgagctgttgtttggaaaataaactaagtattgagaaggaaagatgatttccaaaagatactgaggtcatctgatattttatcagcaccatgctctaaccaactgagctaaccggccgactggtcatctgacattttagcccaaccctggtattagaacaacttgaaagagattacacaacataatgagatgcttattaatatttataatgaagaaaatatgtgttggaaagccagaatcagcatcctgactcagtactatcttatatcttgtactactagagaaaacacacttttacataaaataataaatgacagaaaaccttaatacatttctgacagtattgcaataactaagaaaaaaactagttgtgcaacatgtacagtaagtatgtgaaatggctaatagctgctagtaaatgtagcttgtggcagtacctagtagcttagacaatgtatatcttgcagctatctaaagtaaactatgctcaaaatgtgtaatattgaaaataatacttaacacatggggaaagcacagtggaaagagagtagaaaagtcactgctttctgaaatactgaatagaaagtgtcatcgtttttttaattaatatggctcagagcaatatgaaaactattctggactgagattgagaaaatagacttgataactttaaataggcctaataatagactatgagaattaaatcaatcacttgaaagtttgtaaacatgtatgaaaacgtgggtagtgtgataatttttaaaaaatgaataaattgtcaggaacaaaaaatacactaagaaactacgaatcattggagaatctaggcatttcttaccaatacttcaatgttttatctattcatcttgaagaagaaattggagagagcaaggtgcctctcgttacgagacttctagggtctgttatcacaaataagataaatctaatatactttttctaatatttaaaaatgtttctcaatgctaaatatttaacttgctccacagagcctggcacacagcaaaagaatgtaagaccccttattcaataatgccagattataaagcatcttatttatggctaatacgtatttaatgatgttagccattatattattataattaatgcttccttatacaaatcacaggctgcttaagagcaatgccttttccattccccttcttttgttcagcttctagcacagtatgtatatgtagaatttgcttaataaatatgtgttataaagaataattagtttcctacctcaatttcctgcttggcttctatgaaactatcagtagcatgggaatgagtatgtttcttttagttggcaggatttacttgccgcagtgagctttcttaagttgtattctcacaccagatgtaaggaactcaatcaactggacatgtcatttggggcaaaataaactgaaggagtttagtattagttgccatccaaatttcaggcagtcccagatttattagttaggcatttccaaactttctccatcgattgttgtttatgaagtagatgatgatgatgatgaagatgatgacaatgatgatgatgcagaatacaactgtctcttaaactcaaaaattatttccacttgtgtaatctcattcaattattataaagacatggccatgattagttgagagaaaattaactattaaagatccaattgggtgctaataaagtcatgcatgcctcagaaatggggatacgtttcaagaaatgcattgttaggtgatttcatccttgtgcaagcataatagggtgtacttgaacaaacctggatggtatggcctactacacacctaggctatctggtatagcttattgcttctaggctatcaacccatgtagcatgttactgtactaaatgctgtagacaactgtcatacaaggtaggtatttgtgcatttaaacataggaaaggtaaagtaaaaatatgattttttttttaatggtacacctgtgcagggcacttaccatgaatggagcttgcaggactgaaagttactctgggcaagtcagacagtagatagtgagtaaatgtgaaagcctaggacattactatacactattgtaaactttataaacatggtacatttaagctacactaaatttataaaaaatgaaaattaaggtatgtgtgctcgatggctattatgtcactaggcatttttcaggtccattacaatcttgtggaaccatcatcatatatggagtacattgttgactaaaacgctgttatgccacacctgacttcattgtcaatatcactatcagtatttttgtcagaaccattcaacaagactctaggaagttccaaactttcccatatcttcctgtcttcttctgagccctccaaactattccgatttctgcccgttacccagttccaaagtttcttccacatttttgggtatctttatagcagtaccccactcctgatatcaattttctgtattagtctgtttcacactgctataaagaactacctaagactgggtaattcataaagagtttaaattgactcacagttctgcatggctgaggatgtctcaagaaacttaaaatttcatttttagcaaaatgcctgacacatagcaaaaagtcaataaacatgaggaattaaatgaagaatgaatgacccaatggtaaaatcaggcctgactccaaattctatgttcattcctctgtattagggagttttagcaaacttttaattagtcacaggtaccctacaggcttagcagtatatttataggaagtaaataattgtagatttttaaaaaattaaatgtaggggctgagcgcggtggctcatgcctataatccctgcactttgggaggccaaggcaggaggatcacgaggtcaggagatcgagaccatcctggttaacatggtgaaaccctgtctctactaaaaatactaaaaattagctgggagtggtggtggacacctgtagtcccagctacctgggaggctgaggcaggagaatggcatgaacctgggaggcagagcttgcagtgagctgagatcacaccactgcactctagcctgggcaacagagcgagactccatctcaaaaaaaaaaaaaaaaaaaaaaaaaaattaaatgtaggtagccccattaaaataatgacttacaaagcttcatttagaaatcatattttttggaaaactagcattgtttcctgaatacaaactattgtttcatgatatatttagtaagttaacaatgaaaacatttttagtaaattaaataattttgtttacaatctaaaaatcaactttatttttcagaattttaatagatttatgatttattatttataataaaatatgtcaaacttaaacctatttttattggataggatgcaaatattgaacacaattagattactgacattttaggatgatctcaagcaacttttcttttctctaacaatttgccttgataaacttcaagaataagcaaggtatttaagatggcattctcaggattttggtccaaataattaattttaggtttcacttaaactagtcaccatggtacctaacacgtaaatactaaactaaaataaagctccctctaattaaaacaattcaaaataaccacatcaattatgcacaacagaaaaatacaattttaaatactgttttcagggatactaatctggtaaacatgacatacatgttctgattccagtgcggatgtacatttagaaaattcatccatatagtagttaactgagacatgcagaaacaacagaaccacccactgcatttagaattatatagctgtcaattaaatttttaagaaccacccattgcatttagaattataaagccatcaattaaatttttaaatgactttcttatgaagggattataatactagtcctgactttaaatagaacagacctacgaaatagaattatttcctatttattatttaattctatttatggctcccgaaattgtggctaaacttaagtttttcaatccatgaacttagagtgcagtttaagagatttaatattatcttatttaaaagataagaaaaccagggcaggcgtagtggctcacatctgtaatcccagcactttgggaggccaaggcggaggatcatgaggttaagagatcgagaccatcctggccaacatggtgaaaccccatctctaccaaaaatacaaaaattagctgggcatggtggtgcatgcctgcagtcccagctacatgggaggcttaggcaggagaactgcttgaacccgggaggtggaggttgcagtgaaccaatatcgtgccactgtactccaacctggtgacagagcaagactccatctcaaaaaaaaaaaaaaaagaaaagaaaagaaaaccaaaggccacattgtatgacacaacataaccttgtgctctctgggtcacaagtttgaatacaacttcaaaagaaatagtgtcaataactaaactacttaagaagcagacttcagataacaaacaagatgaaagttgcatactccttacttaaggatagtaagtacaacttggctaaagtttttgttttttgtttttcacattaattttagatgagaaactggaattctaaggtttggttttgttttgttttgctaatagactcctgtattaaaatacaaggggaaaaataatcaaaagtagccaattaaccaataacccctgtccccaaaagggcatctgaaactatgtatatcagaatttgcaaattacaaaaaagaaaatcaacaaacaagttttgccggcctgagatagagatgtattgctatggtttggctctgtttctccacccaaatctcatctagaattgtaatcctaacgtgttgggagattggcctgatgggaggtgattgaatcacaggtgcaaacttcccccttgctgttctcatgatagaattcttatgggatctggttgttggataagtgtatggctcttccccttcctgctctctctctcttctgccatcatgcaagatatgccttgctttcccttcactttccactatgattttaagtttcttgagacctcctcagccatgtagaactctgagtcaatttaaactctttatgaattaccgagtctcgggtagttctttatagcagtgtgaaacagactaatacagaaaattggtaccaggagtggggtactgctataaaggtacccgaaaatgtagaagcaactttggaactgggtaacgggcagaaattggaatagtttggaagactcagaagaagacaggaagatatgggaaagtttggaacttcctagagtcttgttgaatggtcctgaccaaaatactgatagtgatattaacaatgaagtccaggctgaggtggtctcagatgaagatgaagaacctcttgggaactggagtaaaggtcactcttgctatgctttagcaaaggagactggtggcatttttctcctgccctagagatctgtggaactttgaatttaaaagagatgacttaacatgtctggcagaagaaatttctaagcaacaaagcattcaatatgtgacctggctttttccgaaagtgtacagtcacatacgttcacaaacagattacctgatattggaacttatgtttaaaagggaaacagagcataaaagttttgaaaatttgcaactggaccatgtggtagaagacaaaaactcattttctggggagaaattaaagctagctgcagaaatttgcataactaaagagaagtcaaatgttaatagccaagacaataaggaaaatatctccaggacatttagtatatctttgggtagcccctcccatcagaggccttgaggcctgggagggaaaaaatggttgcatgggctagtcacatggcccagctgctctgttatgccttgagatatggcaccctgcatcccagtcactccagttccagtcatggctaaaaggggagaaggcacagcacaggccatggcttcaaaggatgcaagccccaagccttggcagcttccacatggtgttgggcctgcaggtgcatagaagacaagagttgagctttggagccactgcctagagatttcagaggatgtatggaaacacctggatgtccaggcagaaatctactgtgggaatggagcccacatggagaacctctactagggcaatgcagagaggaaatatggggttggagcccccacaaagagttgccactgaggcactgcctagtggagttgtgagaaggcagctactccagaccccagaatggtagatccaccgacagcttgcaccatgaacctggaaaggctgcaggcacttaacaccagcctgtgaaagcagccacaggatccataccctacagagccatggaggtagagctgcccaaggccttgggagccccactcttgcatctgcatgtcttggatatgagacatgaagccaggggagattattttggagctttaagatttaataactgccctgtttggttttagattttcatggggcctgtagcccctttgtttgggccaattcctcccatttggaaagggaacatttacccaatgcctaaacttccattgtatcttgaaagtaactaacatgtttttgattttacaggctcacaggaggaagaaccttgccttgtctcagatgagactttggacttggacttttgagttaatgctgaaatgagttaaggtcttgggggactgttgggaaggcatgattggttttgaaatgtgaaagagacatgagatttggtaggcgccagggatggaataacatggtttggctctgtgtcccacccaaaccttatcacaaattgtaatccccatgtgttggagttaggggagtggcctgtgggtggtgactgaatcatggagcagacatcccccttgctcttctggtgatagaattcttaggagatctggttgtttgataagtatgtggctcttctcctttgtgctctctctctctctcttctgccatcatgtaaggcatgccctacttcccctgcaccttctgccatgattgaaagtctcctgaggcctcccagccatgaggaactgtaagtcaattaaacctcttttctttataaattaccaagtctcaagcagctccttacagcagtgtaaaaataaactaatacgcggacttcacatgttaggctagtacaaaagtaatggtggtttttgcaattacttttactggcaaaaactgcaattacttttgcaccaacctaatataatcatattttcattttatagattagaaagctatggtccagagtggttaagctgctaataagtgtcactggcaacaagacatactttctaagaacatttctatttctctttttagaccagtgctatctaatagcaccttctataatgatggaaatgttctatgaaacttaggaatgaattatcaccctaagcaagactaattctctatatgtaactgttcacatctagaactgtgccctgggaaatatcccacaggccttgtagatcttgatgagaagcaatcatcccaataagaattcctgtttgtgaggacttctgtgtagctctggtaaaaataaaagaaggctcatgatcacctagcccagatcagtcttccacacaaaggtaaagaaaaatgtaatgtgaaataacttttttctgaaaataatatatgttgcagagacagtcagacatgttagaaaacagtagagagagaaaataatttactataattgtatttcctcatcctaagcaactccttacaacatttacttaagaagcaaatattatttttggaagaccctggcatacgatttctgacaaatgatggaaggaattggaatggagaaacgaaaaaccatcttgcatctctgataaaatcaaaattggcttcagcactcaaaatatgcagggcttggttgtttttgtttagacagaattaaaaaggaacttgtagatcttattttagaattgttttttcacttggctaaaacagtaagcagtataatctggtactataaaagcaggactatgtatttagtttgccaattgttgtgcaaaaataaaagcaaatcttggaaaaaaagttgagaagggctgatccattttaggcactggttacacaaattataaagaatgggtataactctcctggtgaagaaattcacagctaagcaggaaactcggggtctccaacacaaactactctctaatgtgacactgggaaggtctttccacattgtgagcctcagtcaccctatctttaaaatggagataatagaatctacttcataggattattttaaggacaaattagtaaaaatcacatatattatgtaacacatagctaatgaataatagacacccaaatactttcctacttccgtttattcattttgtataagaaaacaggataaaaataacttaaatgaaaccaaacttttaaatcttaacatatttaccaacaattttcttatcctatacttctatctggcaaaaggaaattgtatactgagtaacagcaagaatctgaatgccaattgatttccaaaatggtgcagtataattaggaaattcatgagtcaaattcctgtttatgcctgtactgcaaaggctaatcatttgtttgttttctataagaaggacttgattaaagcctctagcagcaataattaaccctgtgcttgaaggatgcagactcaactagcactgtgtgtgctaaaatctgtaattaatgcataggaatgcatgtaaattaacagatgagtgtcatttacactgatggtacaaatgcaggtttctttttttgggaattacttcagtgttttctgctaaccattacatactataaactcagactgatgtaaacagcattctaacatctacaaagagtctctacttcagaccatgatctagatgaggggttggcaaacttttctacaaagggccagatagtaaatattttaggatttcccgaccttaaagcctctattgcagctactcaactctgttattgcaatgggaaagcagttacaaataatacataaacaaacatataggctgagctcattggctcatgcctgtaattccagcaatttgggaggccaaggcaggaggatcacttgagccccaagttctagaccagcctgggcaatatggtaaaaccacatctctacaaaaattagctggtgtgctggtgcacatctttgatctcagctactgaagaggctgaggcaggaggattgcttgagcccaagaggtggaggatgcaataagctgagatcgtgccagtgatttccagcctgggtgacagagtgagacactgtctcaaaaaataataactagatatataaatatatagctccctctctctctctctcttactatatatatatatatatatggctatgttgcaataaaactttatcaaaaaataggtaatgagccagatttggcctatacaccatagtttgtttaaccctgagccatagtttgctcatccctgacctagattctaattattaggtaatacagcatactgtataatcttagaaaatcaatatttatagattagatacgggcactgaaatataaacctgatgtgaaaacctgacaagtttctgaacttaagttagtctccctcctcacataaaatttagataaaacatgacagactgaatttaccacgactttatcgtaagaaacaagtgactccaaaatatgaaagtacttcagaaaaacagatatatatatatatatatatatacacacacacacacacacacacatctttacttgtaaagtattattattattattattattattaattggtcatcttttcagctctatgttttaaggcacctagaggactcacttactctggaatgaccatagaggatacaaactacacaaaacatactcagagctgatccagtaatgctagaatttaagaaacacctggcagacttaggatcccatggggctgccatgttaaggaagcaatttctaaagtcagacccaaggtacactagtcatgagagatgtccgtcaagaagtccttcaccagtaagtttggaaatgctgcatacgacgctatgaacatgagcttaattacactatgagcattagtactaaagagatatttgtcaaaaagttcttgacaaataagtgtggaacacttacacctatttcagaggctcacagtgaattattataaacttaagatgctaagatgtcctgcataaactgtgcacctttgtccaatttcccaaatgtgtatctattgagattctttatcttgtgggtgaagccaattaacagagctccccaaaactaactttgaggaaagctttcatatagattattctgaacagttacattctttcactctgggtgtgagaaaactgccctactaaacttacatttttaaccacataagagcaaaaacactcatttaggtatttacttacatttaatttgtctgtcattataatggaacttttacttataaacaattttatggaacccaaccaaatttataaaattatttaaagcagtataaaaattacactcacctcaatatactttaaaaaaacgcaagacttattccaaacatgaaatatttctgatttaaactttaaaaaatcacagacaggtatctactggagcactatcaagacacagtgacttaaataactttgtgctgaaggcactaaaagctattaaatccaaacatttgttgcttttgctgaatattgcttaaactgtccatcaggaaagaaggttgaaaaataactgcatagttcatgactttcctatatatgtggctttctgattattgggtttcttctggtggctttttcacaaactatttaatcaagaaaggcaatcctattcttactgggcagggaatagctaagtaatgatttctcttaattccaaatgtttctttcatttgcaaccagaaatttcttacatgacaaagacaaacatttttgtccagtcatgtattttgatatagaagttgaatctccctttggagctaaacataaaaattaaccaaaatcaactcatatcaaaatcaacatgataccctttttctagcatttagcagtctagcataatccctgacatgtactacgcattcaataaatgtttggtgaatgaataaatgaagaaatgaatcagacatttgtcaaatactgtagttcaaatatacaaatactattattttaaaataatttatattgaataatttaaaaatatattcttagtccaaatatccaataattcaaaagatctgaaacagtgataatatgttattacagttattcatttcaatatcataaccattcttttcccatgcacggcaatggagaactaagaaattttattctagacaagataatatacccattcatgatacacagacactagatacataaaacttaattatagagcttagattatattctaaccagtgaatatgcttcttgtgatttttggaccctagaatccatcaattaaaattcaatatcataatattcccttacagaggaatagggcactcctgccttgaatgcttaggcaaaggtacgtatccaaataaaaccaatcatgttaaagctacgaagggtttccctcatttccagtgaaatagacatgtataatatctacttaacagtacacttgcaaattttttcacattagtgaaaagggaaaaacttgttttctcatcacgctgagtatcaatttgataagtttacataagccacaaaatattggtttcatttattcagacagataatatggttcctaccatattccattgccatttatgaaacatttgcttatctcaaaatacattaaaaaatccttcccacataatcctggcaagttatttattttattttaaaatatattaatatttcagaacacacttcccaggacatccttacaacgcatatggcacagacaccacatttcttcaataaaaaataaaagccatttgtctctaaatacacttgaaaagatttcttgaggtaatttttgttttctttactctcaatgaacagaattattaacatctgaatattgacaactttttaatcatcaaacgtccattatatattatggcaaaattaataaactgtaacatggcaatttagatagatccaaaatttcacaaatgatataagatattgttctaagtatttatacacataaatcattgctaatccctggatgccttttataagtaaaatagccagataacaaaagaagcaataaaaaacacacttaaaatatactgtgcaaggaaagtacaattgaatgcttttaaaaatatcagtactctgggcaggttaatatttgccaaaatcgtttgctcctttgaggtttgctggttgatctgaatttattggagttcatttcattgctttagaactcattagcattagaattctgatgattgagggagcagctaatacatactgccccatttaatcttagagtaggcttctaaaataatagtaagaattaaccactttggaacctcagagtagccatatcacaggcaaatgtctctttcaggcagtcactaattgagcccagttactttttatttgtccttcaagataccacactgcatagagcttatttggaagtctaattttttgtgagaactactaggttatttacaagtagggacaatgaaacagacacactttcccttggagactttccagaatactgtgagtttcctgaataggtatttccatgaattcaatatggcttatccaccaattttggatctggtggaatacaccaaaataaaaaggcttactacaaaagctgacaaccagggagcagaaaactgctagatctgttctataaacccaaggaaatatatataattaattagtccagcatttgttaataagaagactgttcttaggactgtcctattaaaagttgagtgagaggaacctgaaaatacctttgtcactattttgtccaattcacttaaattatatacataaattttattacatattcttatctccataataacatgtggggctcaaaagaaagggaaaacattcactatattcaaccatataatactgagttgaaatagggatttagttaaacaaaaaggatgaaagtgttgctggttttaaatgtgtctaatttagttacttacctttcatatcaattctgatgtttccaagagtcagataatggcatcaagaaatagacttggctgaacagtctacacatactcatactgaaacatactctttaaaaatattattaataaagttaataaaatcaaaatgaggaatacaagggacagagaaggccacaattctgatacaataattctgcttcatctctagaatgaaaaaatcattctcactctcattcttcctagtgcaatccagacatcctgcaaagttttcccatggtaccacgtttctgagcataatacatggtgtggtttcattcctactcaggccttcattctcccaggagcttcttattgtttttataataaaagtatcttctgacttcttggaaaaactaggaggtcaaaataaaaacttttcccagaaagcttttaccggcacagccagaacttgctataaactaatatttgctacctttgtatttcatgggttagatattcccacagatgagtggttccagagccacacacagccttttcttggtattatatgtctcatctatttctgttgaaagtgtgtatgtacaaggaagatttggggaaaactacaatttgactggagtttgtaccatcccctgggtatcatgctaacttacataactgtgaaggcaggaggagattaattgaagtaagaatatgtgtgcaagtgctagctatttgctaagcagaataacaacactggaactatctcctggcctgatgtttagagcaacatataaatgctctcaaagcttttccacttgtttctttttttccatagtaatctgggaaagtggttgcattatttcctttttttctggattctacaaatcttttaaaacatgtgtcaaggtattagcttcataaatacttcaagtaggaaaactatacagaagggaaaatagaaatgtgtggactttggagattgcaataaaaaagaaaagataaaaacatacatgtcaaattatatatctagttattttttaaaatcaatttatcagaatacccatttgacaatttaggctggctttcactggagaagcacattaactcagttaagtgtctgaatttcttccgttaaagagaaaaagaaggcaaagtcagaaaatcacatattaacaatgaattgaagactgtactggggcgtgcatgtatcacggtttctcacctttgttgctattaacattttgtatcggataagtctttcttggaagggactattctgtgcattttagaatgttaagtagaatccctggcactaaatgctactagtgtgccccgcccaaattcacccccaattctaagctgaaaagcaataatttttgtaacattatttcggtaacaacatttaacagcattttggtaataataagcagtcacacagaatgtgagtgtaagcgctagggtccatgctaataactttttacaaagataccttgtttattaaccacagaaacaatagctttagttctaattatcatctccattttacagaaaagaaaacagagtctcagaaatattaaataacctgagagttctagtctgtaatcagtggtcagtgaaattatgtcatggctgtttggaaagctaatataacaagacatttctttcatggaaaatggcagtggactgaaatttaatcagggcctctgttctgacctcagccaaaaaatgtgaggtccctgtatgtcagtagtaatatactgggaattaatgtattagattgtattcaattgctcaaggacagctgtttgaaacaatgtattagaaagaataggttacagctcaggataattccttggagatgtgccttgggggcaacctgagggacaaaaggggatgagatgagaggagatgagatgagaggagtactatatctgaggcacaaagcctgtaaatctgtgaatgcatatgcatatatggatttcacaggatcagagaatgtgctgacctttagtgggtaggggttggggtactaaacgtcccataatgcaaaggacagtacagtatgctcattgagctttcaaatgtcccgccagatacccaactggatgaataacttgtgtataattatctgagcctagaacctagctttaagtaaattgaacaccaagtatttttggcacacctttatatagttcactaattttttttcagaatacaacaactatgcaaacctggaggagtttaaaatatatttggtttggaaatttaccaagaattcctcactatttcaaaaaaaaatgtcaccaactgtaacatctctcatagtatgagtcaccgatgtaacacagctccattagtgtgcaaatgtagcttcatattcatgcttcttttaggtaaaagcagctgcctacctcactatgtcttctattaccctcatgcctgaacatctgcatattgagatacacagaattttataaaaatatgtttcctcatatttttccttcatattaccattatggaattatagtgattttaaaaataatatatgttatataatctatgttatctatctcatataactggattatctatgaatttcatttttagagtagcaaaactgtacatgaataaatatatatatatatatatatatttttttttttttttttttttgagacggagtctcgctctgtcgcccaggctggagtgcagtggcgggatctcggctcactgcaagctccgcctcccgggttcatgccattctcctgcctcagcctcccaagtagctgggactataggcgcctgccactacgcccagctaattttttgtatttttagtagagacggggtttcaccgttttagccgggatggtctcgatctcctgacctcgtgatccgcccgcctcggcctcccaaagtgctgggattacaggcgtgagccacgaataaatatattttataaaaagaatatactgaatatgagaccctgtcaaaaattctatcttttctcacacatacaaatacaagacaattataaacttaataaacattatttatagaattggaccagataatttaaagaaaagagaattctacaatgtaaaaccctttaatataagctgttttaataattggaaaacagaatgaataatgtttttgtttgtcatgcccaattatttcaacaagtttttattaataacttgctacatggtaggcacagctgtaggtgttggagatatagaggtaaacaagtctgacatgatctatgctaccacggagttcttattttcaaagtggaaggtagaaaataaataaaaatgaactagaagagcaaagtgcctctgatgagcatgcagaagcatgtttcaaaatgtctgtggtgggataaatagatcagcaacacaccaggccatgcaatttggcagcaaatcacttctgcagtctagctgctgttttttctactctgaatcatactccccctttcgtcatctatgccagattccactgagcttcaaccctaccctcccattttacatacgttgccattttaattaattaagtggaaaagttttgacccatcaaccagagctcaagctgctagaagaagtgaatcgtttcttatgcttctttgtgctccattgtgtccccagtaaagtggtgtacacaggaggtaatccataatgatcaatatatatggaggagaaaatactaagagagaggaacactgtcaccctggcaagaaagggcaggtgaatgggagactgaatgggagatttaagaagtagactctgactctcccttaataacttatttccacttcctgatggaattgcacaataggatgagtatagacccattatgaatagcacatccattgaacaaagttgaaattctgatttagccatttattattgtaaccttaggcaaatacctcaatgtctctgagtcacactttcctaacagagaacaatgaaaacctaatgaggttgttacaacataatgcttcagaagcccataacaaattgtctggaatatagtagttaagtcaataagtatagttcattttcagttcactattttaagagttgtgctttcataactggcaacaaatggtataagcattttacgtcatcaggacatatcaaacacatcatacatcatgtgaactccctaaaaattgaaattgaagaaaaaagctacaacaagaaaaagtagtattacagtatttctatgttcaagtgacaattttttttttttttttttgagatgaagtctcgctttgtcacccaggctggagtgccatcgcatgatctcggctcactgcaacatctgccgctgcctcccaggttcaagcgattctcctgcctcggcctcccaatagctgtgattataagtacccgccaccatgcctggctaatttttgtattttagtagagacgaaatttcaccatgttggccagattggtcttgaactcctgacctcaggtgatccacctgcctcggtctcccaaagtgttgagattaaaggcatgagccaccacgcccattctcaactgacaaatatgagtcacaccaattgtcattacatggtatattgtagataggttaaaagtaaaatcaaagggacaaaatatagagaccaattgaataaaaaacttttcatagctgaatcaatactttctaagcattcaaggtaggaactccttagcccccaccctcctaaataaatgcacataaaagcacacaccctttttaatggtactaaaagacctagagtatacattttaatgaagttaatcactacttcctctctctgagtagaaataatacatatcacatataggaattatatatatcaaatctcactccttattttcattatatcttgtttctctcaggatgttttctttcttcaaatgaaagtcaaacagtatgatattacattactgctcaacttcagctttaatacaattattttaaagctattcaaccagttcttttgaagggatggcgttatgtggaccaccttgtataaacttcaattctcaagctctctacatattgctgtcaacattcagttcattgcagagcttaaagagtatacttcactgatgtaaatgctactcacacagagtccaacccagagcgggttcagccatttatggggcagaacagggacatgcaggaattagggcatagacagactcacttgaagggagtaagcaatcaagaaagttccagcagagctgggaaagaaacctgaatgggtagataggtagtccaggcagtatgctggtacgcagtaggcacagttcaaagaaagaagagaagcaggcagggaagctggaggaataaccttggacaaaagaggtttggtcagagggcctggcatgcaaagcttacttccagttctttataaactgtgaatcaaggcagagttggagtttctatgaattaggtactcaacaggagcttcttcacagacgtccttattactaaaaccagaattcactgtcagaactggaatggcaacatgagagacttgatggtatcaccaactgggtcaggatgcaggatggttccaggacctggagagattggtgtacagcatttttgctataggagataaacagatttagccaagaagaccaactcaactggcacttacacatggggtgcagcaggtgaggaagacagctgggaagataaaaaaagggaaagaagcaggtgcagggtgtatttccttcatttctactcatctctctctctctatctctcacacacacacgcacacacaaactcttacataattgtctggttagggaagtaacattttaattcacagctgacatgggtcactattcatacaataaaacatataaagtggaggctgcaaataattatgtaccagagattctgtgagcaggatgaaaaccatagttcacaaaactgttagtaaataaaaaacaggagagggacggctggccctgactgtcaccagctgtgtatagtcacagctcttcagtggagttcaaagagtaattacagaggagtgagttaaattctgtaactgctggttacacagcatttaatgcaatgatccatttagccatcatgctccttctttaagaggaaaattttaaagcaggctttttaaaaagtgacattgaaaatatggcagcttaaaagtaaattttattagtaaaccacatatgaaagctttgaaatgttcccttaagctatgtcaaaggatcataaataagtataactgtcaacagcagaacagtgccatttttatatatgagtagaaagcacagagaggttaggcaactcatttatgccagacagttagataacagcaagttgagattgaaagcaattctcttggatggatacagtgaagctgcctttcttttttacatttcccaagaacatatttagagaaaatgcaacacttcattctcaatcataacttagcacagaaactgccaaatagaaagtgtttgataattactgaggggggaatgattgaatttataaatgaataaattatacagcctctccaacaagttctgtagctacagactggggaggacagtccgttttcccagagtctgccgggcagcagctgggttagcaaaacacatgaaacatgtttgtgagaaaacagcattggaaaactagtgcctggctctaccctaaaaactcagatcctcttgaggtatgattcttttttaaatgtccagttagttcttccagggaagcaaggctaatacggttgtctcccttatccacattttcactttccaaagtggctgttaccagaggtacacaacagtaacatattttgagagagagagatcacattcacataatttttattaaaatatattgttataattggtctgttttataagttattgctgttaacctcttactgtgcctattttataaatgaaattttgttataaatatgtatggatagggaataacatagtacacaggttttagtactatctgcaatttcaagcatccactggggggccttggaacatattcccctcatgtaaggggagtaatcgctatacataatactagctacttactcactaacgtgatgggcttaaaacaaatacactttaaaagtaagatttagctgggtgtggtggctcatgcctgtaatcccaacactttgggaggccaaggtgggcaaactgcttgagccccagagttcaaaaccagcctggccaatgtggcaaaaccctgtctatactaaaaatacaaaaattagctgggtgtggtagtgcatgcctatagtgccagcgactcaggaggctgaggcaggagaatcacttgaactcaggaagcgaaggttgcagtgggcgacagagtgagactatctcaaaaaatatataataataataataataaatttaatttaaaaaataaaaagcaagatttaacatttatagagcttaatcattatttcgtttactggcctaaatgccttacagatgacattcatcctaacaaactcaatgaggaggtaatatggtcagccccagtttacatacacggaagctcaaggatgggaagatcaggtcttttccccagaatgaaggagcagagggagtttgaaaccagagctgacacttttaccacacacaatagtatccattaatatgaagcaataaggatgccatgaaagatggaattgggagtatgtggggttagaataagttagctaaaatgttctctatgcttggaatgtcacggtagtgactaccaaggcttctttgtacaatactcttttctcaagatttgtgcccttgggtaaatccctattccatgattaaaaataaaaattcagtaaaagaacctgttggtcaagatgatgcaagcagacatcaagataaacctggtttcaaattttggcgctgacacttattagctatgtgtccttgagcaagttatttaatctctctcagcttcattttcaggatataaaaggggaatcataataacttacataaattttttatgaggttataaagttctgaaccaggagccattacgccccataaggcatttttggttatcataactgggagtggatattaccggcatttactgagtagaggccaaggatgcagctaaatatcctgcaatgcacacaatagccctacaacaaaaatttacccagcacagaatgccaataaagccagtaagctgacaaatccttaaagaaatacatttgtgatatccctggcataatattagtaatcaataaatgattctgcggctttatcatatgtatgaaatttgtgaagtaatttaggccaaagttttaaatactaaacactaaaggattcttattccttctttaatccagaagagaaaaagtgatttattcttaattacttttgtcatgtttgatttcttgtaaaatattgttttttctgattcttccccacattaaatgaaattataatacatttcaaatgacatttaaaacaattcataagttaagctatcattctggcccagaagtcttggtggcttataaatgatttatagtatccactgagaacagtggagaatattttagaaatgaaaataaaaaacaagggatcattcaagagttagctttttttgtagtggaatcattccacccctctctattgtctaaggaagtaagttgcagcacatctttaagaaaatgctacagatcagaatcctctgtttatttgtcttgcgcaattgtctcagtgcctttctgggccaaagttttgtttcgctttgtttctgaaagcatcagtcctggaaatgggaccattttcctggaatatttggaaagattttaatcagaaagtgtggtcaagggaacgagagattcctatgttcaacagagaagacagctgcaaaataaaactccttgctttggagctcaacattaataagctttctgtgtacccagtagaattctagatacaagtataagcaccagaaactctcaaacgacactggcttttgtaaaataggatctcaaagccttcatttcagctctcaaaagttaacatatatactatttacaaattagtaatttgcattcttcttttacctaggaacatgtctttacaaaactactattggtgaatgcttttgtaataagcttgttttttttaattcatttatggagtatttattgatatttttatagaaagtcaactggtttttgtgaattgatcttgtattttgcaaccatgctgaactaatcagttccactttccttagccttttctgtatgcaagataatgccatttgtaagtagaggtagttgtatttcttcctttctagtctggatacctcttagtttcttttccttacctaagtgccctggctagaatctccaagacaattctgaatggaagcagcaagagtgagcattcttgtcttgtttctgatttaacgggaatgcagtcagcaatcattcagcagctgtgtgatctcagcagctgtgtgaatttcataaattttctttattaagttgaggaactgtccttctatttctagtttgccattacaacgatttgtttccaaacattaaactaacattgcattctacatcctacttaattatgatgtggtatcatttttagattttgtcgtagtgtctttgctaaatttttcttcagaatttttgtgtctacattcatgagatatgatctatagttttttaagttattttgtctaactttgatgtcagtataatttttaaaacagacaataacaagtgtcggtgaaaatgtggaaaaattgctgatttttcttatcatacactgctgataaaaatgtaaatgatgcaacccctttggaaagcagtctggtaggttcttaaaatgttaaatatacagttaccacatgacccagtgattccactgtcatatacatactcaagagaacggaaaatatatgttcacataaaaacttgcttataaatgttcaaagtgttattcataacaggtaaaatatggaaacaacccaaatatccatcaactgatgaatgaatgaataaaatatgctatattcacaaagtcaaatattattcagccataaaaagaaatgaagtactaatacatattacaatattaggacattatgctaagtaaaagaagagagtcccaaaatgccacatcttatatgatttcatttgcatgaaatgtcctgaacaggtaggtctatagagctataagtagatgaatagatgccaggaactggggacagtgaagaatgggaaggactataaatggttgtgggtttctttttggataatgaaaatattctggaattagcatgacagctgcacaatcttcggaatatgctaaaatccactgaattgtacactttaattttatggcatgagaatgatatatcaagttacatgttatgcacacatacacacatatgcacacacatctattgctgatctcagtttcaagaaacatggaaattaaaactagaaataacatttcttgatagctcatgtaaacatgctgttttaacaaatgaaaacttgagatacagagaagttaaatgacttgtccaaaattgcaaagttatttatataaaatttcaaaaaattacttatagtcctggactgcttctataaccattttcttatacacaaaaattctccgatgttgaaatcattaaaacaaaaacaaagtactactttgactcttccactgttctcaaaagaattttttttttcatgtcatgttgctttctcttaagttgtatgaaatgtcctgggactcctcttatctaacagatgaaaaaataaacattaaagatcaggtatttatctccataaaaaggttagcgagaaagagaacaacagatctgcctccataaggcattaattttccatatcagatggagacagaagctcttcaaaggacttaacaactttttcccagctttctttctctcctcatccctccctccctccctcccttcttccctccttccctcctttccttcctttcctacctagcaatgtaacttttcttaagtagtcctctcttcttagggtaaatgtactccgcattttaaatgatttgaaacctaccaaggtctgttttgacctaaataatggaggcttaaaaaagaattattacagaaaataagcactgtggtaaaccccaagctggtgaagttggtgcacaacaagagagacatattatcacctacatggaggaagtatatatgacacccatggaaggaccacacaaatctatgaatttctagaccttgcttcctctcaggatttacctttagcttctcaggcgtgaacttgcagaagctctctgccagaaatgagtgctcagagtattatttacactctgcctctgggcctatatcaggggactgcaagggctcttctaccctgtatgttagcagacaagatgtaaacgtttaaccaaagcaataaaaacaaaaaaaagcaaacatacatcaaaaccaaaattgtgtatttccaagaaaattactattctctactgagttctcacaaattaacttgtaacttcatagtcaaaatatgatataaagctaacataatttaagcaactgtctctgttaatccttacattggtctcattaccaccattttcgggtgagtagtatataagtttttgtaaaaattaggtaacatttggaacaaatgaacacgtgacttttttgcctactctctatttacaaatatgctgatacagagataagactttaaagattatatgtccattgacagagaaataattatttattcccatccactatgatatttgtttctctcgataatcctgtgaattgactcaagcatatatgatagaggcccatttacacataagtacatgataacatgtattcaaattactgggaaatcttgttaaaatgtagattatttttcattaggtatggacctaagattctgcatttctagcaagctctcaggtgatgctgatgcttctaattctcatatcacactgtaagaaataaacacactctaaccactagaaaaaaaagggttatatatgagatggatccatcatttgttttaaataattgtactatactgaccaaggctatagatgttgatctaatcatatggtttattgtcttccacaacaacaacaacaaaaaacccaaccagatgctaggaaaaaaacacggacttttatagacagagtaatggggaatacttaaatctaggaagttaaattgaaaaagaaaggctataatatgattcatttgaattaagctaagctatttggagaaaaatcattgtaatatcatcaatcagatcagatattttaaccaatgattctagtccctccaagagtactctctgcttctggcccaaaatgaccccaaatggcaatccagacacagcatttgtgatgttgaatcagggtcaacaaggagggattttgttaattcctttcctcataatattatcatttgtatatagatacatacaaccatattctccacaaaatgggttagtataccatctgttatcttagaaaatctagacgcttttctattagctattacaactgagaataatttctggactaggcctgctagttaaaaaaaaaagaagaagaaaaatttaaataaaaaactaaaggcaatataagaaatctcaagcatttgcagaataaaattgcattttaccttaaaataacttttgcaccaatgaatgattctgagactgctgctgactattttccaaattaacagaatactctcaccttcatttgtattgagagtttcccatacttgcataaataacaaacggcatgccaatgtattctacatctgtctgttccacaattgagatgttcctgcagttaatattaacaaaaggcgcctctcccttcggtctgtaattctgtcactgttcttcctatctactttccagttaaaattctgattatcttcctgagtatcccttgaggcctcttgtttcttttttagtagttgctaggcaagttctatgagaatgctttaaaacatcagaacaatccaatgataggtatcctcttatagaatgcttcatggaaatttaaacctggcctccacacattacagcttccacattaatggtattctctatatattcacagagccaagtgcttggtttgtttgtttgtttgtttgtttgtttgtttaatttcccaaagtaactatgttcaaggccctgagacccagtctacaagcttatgggatctcattgtcttatgtcagctttcttatgttgatggtgacttaactattagttttgcctctgaagttatgattttgctataaattgcctttagttttttgagttttcatgaatgttgattataaaaacaaattaagcttcaccaagaaatcaagttgaccagttctgtgttcaattaaattttcgctcccaaatgatctcaattttccagaccacaggtgaatgcttcctaagatttcattcattatcagtcaaccagcaagtactgaatatgttccacatgtttagcattaaagaaagcattctgaaaaatacagccaagatcatcagaattgtgcaaaaatggcttagtcctgttgtctagggattaaggaatgtctctctgaagtaggttataggaatagttactttacaacagatttttcccaaggaaaagaaactctatttccttcacattaaaagtacacaagtgttgtcttaattgtacacaaagttgagaaaagcatgtgttgcaagtgaataatttccctttttgttctttaatctgactaggaattgcctcattaatctgcccatttttacttcaccacaacacttaccaggatgctgctgcctattaagattgttctgatgttaaaaaacaaacaacaacaacaaaagaaaaacactgactcagacatggcctttctaaagtgggacagctgtctaccttctctccttcccttttccctccttatttccttccttctttctccctttcactttcctcctttcattccctgaaaacattctatactggtcaaatggacaacgaggaaaactatatgtagcagtttctttaatgtatctttgtatatgccaaagtacttccaccttactatctttcctccaaatgctttatttttaattttccccaattgacaaatttattttgcaagtatataggtttgaactatgtgtttacacacaagtgacacagagaattcttcagcagtcattattcatggagatgttgccagtttacctgaatgaggaagacaccagcattgacatacatgtttaagcaagatacggtgatttttcccttgaatatataaaatagcagagtgactaactgatagtggtgttacctttaagcagattcctctattctgttcatgaagaatgtatatcttcctaaggaaagttgtgtttgaataaatgcctttcttctgtgtattgaataacttagaaagtgcttctttcaatttagcatacacaatgttctgaaaatagccaactcaataaatatttgtttaatgaattatggtatccttgcactaggcatcagtccagtttaatttgagctcaaataatacaaacatatgtcattgtccttctctttatgaaaaatagagcaacatgctaatcagcatttaattttttgcctactatgcagaagaatatgaaatgaaggtattaagatccagttatgctatttagtgtatgttatttcgacaacgattacaaaatctttgtcatctcaactattgatacatttgaaattgtccagtgagtagaaggtttagactatgcaaaggaaaaacctttatgctgttaatcatctcaaactttctgccattctaagtcgcatgtttagagtaaaagtcaagtagtattttattcttggcaatgggaaaactatgaccgttttcaaaatgaattcctatgtgtcaggtgaccactaaagcaataatttagtccccagtgttagttttgttcatatactgtagcatagaaaatctgcattctgtaccttctattccttgaagatggtgaacacgaaaattaaaagatgtaactatttaaaggatgtaactttttcatttaaaagatgtaaacattgcctttccctcaaacgtgtcctattatgaaaatctaacttacagatattcagatgtttaaaataactgtgaccactttgtctccaaaaggattttgcattttgtaaaagaaagcactacaaatttcttttgagaaacacgcttcagtacaattcattacacatgaatttgacaacttttcatttagacccaattttctatagagattatcatgtggcagatattcataaatgctttatttcaggtggaattttaccttgagatacagctccacataaaaacattgttaaataaccaggtattaaatatagtccgattccaacttccattaagtcatttaagaaaacaattcccattgatgcttgtctgagtgctcaatattctttttaaatcaggggagtgaaatatgaaagtaggcaacatactctggaatttttgttgagcctaagtaacttcatttaaagataaaactgaaataataaacatataatttccagttttaaattttaagagccaagaacacattaggtgcacttctcattaaacaaatgagataaggatctatttcagtagcaattaggagaaagaagaaatatgagtgtcgcaaccattctattcttccctcaaatactatgaaacttataacatcacaattgattatatatacacacatatgtatatagatatacgatatattgtgtcatatgtatttacagatgcaatacataactatttgattgcagctatttttatctcaaggagatttcaagctcttggacactaacatttttatctcatggagagacattacaatgctctatgaatggggagtattagctcattaatatttagaaaaataacagattgtcataaagtagatactatcctgttgaccaaatatttgtatctctcctttcaagcatggaggaaaaaaaaattagggggaacattttgcaaaataaccgtttgatttttaaaaaaaataataattttcaaactgatgcttttaatttaataacaaaataatgttattaaaacttaaatacttaacatgtaatttagaataattatctaatggcccagcttacatttacttttacttgaatggtttttaaaagttttgctttttctataatttcatggagctaaaatattttatggatattttgatgccatgcttatatttggctaggtaaaactcacggttttaatgctgacaagaaattagcaggtcctaacaacttttattcacaaatgaatgcattaataatcaaaagaaataaagaaaacattatactattttaaaggaaacgcttaaaattttaagaatgtgattttctagttaaaattgaccctagtgttcattattttttaggctttttacataaacttacaagattttagttttatgtatttatattaaactttttacatgagaccagtaaatagcttactactactttttcatgttatgttgccttctctcaccatagatttttgtcttccaattccttaaagttgcaccttagtagtaaaaagtgtgtacagcattatcagcttttcatattattttactaattgcaataaaaaataaagctcacctatttttaaaatgttatttaattaacctagttattttgaacactttgtatccaatattttttgaaaagtaagacgactttccaaattcatttatctctaaagtacttagtatcttacatggaagataatgacatgtctgtatgatcttcagctgttataaaatgtcaggtgctggaaattcttaacagagctgcccataagtcaattaaatcatggcgccacatcagcttttcccccaatcccaaaagagttaaaaaaaaaaaaaactctaataacatctacaattaatagcattcctgtagcctgtaggtctggcctgttactttagtcttccgctgacaataacggagggccttattatttttccccctgagcatttattaggcatgatgaggaaaaggttacatctctggaaaagagcacaatcttcaactctcttcaggttagatgctttaatgggcattacattagaaaggcattctacactacctattatattacttctcccaattagaaattccattttaatgtgattgccaaaaatttagtgcctgcccatttgataaaattgagagtggcatttgctaaacatcaattaacagaaaatgtgaggcaaatgttgtatgggtagattggctgccagtggggagaaatgaatgggtagtaatggaaattaatggataagggaaatctactttaatttccttgaaaaatgtgctataacagctatctgcattaataaatcaaacttattgtttaaaaagtgaacaacaagatattttgatttaacaagacagcaatccttccaaaatcatagaactcactatcaggtatcattctcttggatatattcaaactgcaggctttgctttggcaaataatctttcactatccttagctctaaataagatcaaactgtcaataaccaggaaataagttgttaaaatgtcattctccaatttatcattttaaataataaaagttgttttaagtaaacacgtttctttccatgtctattttttaaatttctcctccataatatcttccattttaatcccacaataggctgtggccttttgttaatgctacttcagatacataaatttctgataactgaatggagacataaaaagacataaaacacttacatttgaacttaaaagacaatatagatttatatgaattcttttatcattttataactacatttatctaagactcatttaaagtgatttcaatctgtatttgtttcctctaacatttttctttataacaaatttagttaattccatcatctcatctgaattctatgatcacacaaagccacctaaattaaatccatacctgaacagtctgggtaaattccccatataatatttcttatttaaaactttagtattaactaagtcttttaaggaagtatgggcactgattatgttctggaaaactggaagaatatcattaatcattaagagcccaaaatatggaacagggcatgtacatttatagagatgtaatgatttttagcacagaaattatttaccttaaactaagtactaaatgggaagagagggcaaaaggctgtaaatggagaattcttcttccagttttgcaattaacagtgttaatgtcgaataagtaagtagcttttacctctgtgcattttgcacttttacctcctctgggccagaggaggcaacctgcaccatttctaaggtcttttctagaagtttgatgagtctgtgttatttctgttagtttttctgcttatttcacagtaggctaaaattatgaatgaaaatatgtaaaaataaacttagcatggcaattttggcatagcatagagctcatggataatgattacacttctcaataaaacagttaagaatctctctcggggctaactttttattttaggatatgggataatgctaacgaaaggactagattagaaatttatgattaaaataaaataagactaatactgttaataataaatacttctgataggtagactggtgattctggaaagaatgatggcaaaacttttcagaaagtttggtcctacccattctctttgactgtctcctgcacaaaggcttctgtgcctcttcttttcattttggtacatgatccaatcaagagaatatgatccacatctcaaagttttatataatgcttgcaacaattctctactaatatgcctattgatgatactgtatatttgtattcatcttttccatcttctcagatctcctacaccctgtgtactaacttaatatcagccattaataactgagtaaatggaagtgaccaaaatgaactctattttctgaccaccaattccaccagtccacctctatctgtacccatgctctctccatataatgttcttctcccatcagatgtcaaggttaactcttctggtggtaatctggatcctggatccacttcctgtttctgactcaataattttgtttctgaaactaaatcactcttacaaatcacaaattatctcgttactagatcattcacatcagcattcagaaatgctgtattatattttcacatttaataaaagaaaaataaatatcaaattcccctagtgttgccccgtttatttgctcctcttcaaacaaaattttctcaatttcctctttcccattttcctctcaacacataatagttgagttttgtccctattatgtcactaatccttctgtttaaagacaccagtaatctccattttgtcaattccactggtcacttcttcgttccatgtcgactcatatcactcttctgcttagagcttgccgataaatttctatctggtttagaaaaatgtctgaacaccttagtctggcctatttgtctacttctactgaaacttcatcttcttttccaccctcaccttctgcgccaggtaagtcccagtaacactccaagcctcttcacaatttagtgcccttgtacttagcaaattggccagtgaagtgttctccctgaactccacacagctatgcccttcctgcctttcacttctcttgtcctcagagataccttgccggatgacgcaactgaaagtcagacatgctctttatactgtttttattttctgcggagcactaatcattaattaatatattaattcactgattttttcctcaataatatgagacttataagaaatcttacttttcttttgcttcttcatttccagtctagaacactgcctggcacaaagaaggcactcaaaaaatattgcttaattttctcatctttgtatctcaaatgtcattacacatagtaaatgattaataaatgctggttggtattaaatgattataaactctcttgatgaatttacctacactattattttatgatggtaatttatcagtggcttttaataggtattaatatctttcaggaaagatttgtactggaaatagaaagtataaatcaggaagtaggaactatttgatctctcaaaactatttactatttaagcagttgtttcataaatgttaggaaatgtttgggaaataaaaagagttttaaaatcagtacatatatctaaatttaggacaattgaggcaactctttaatctattaattctatgactatatctagatcaaagctttggttttagggcaaagtactgtagaggccaaggagaacctcagaaggtttgctgaaaaaaatcaaattgcaaagttgattaattggagaaaagacaaacacatttatttaatatgtatatatgggagccttcggaatgaagacccaaagataaagaggaaattgtccacttttatgcttatgttcaacaaagtatgtacagcagtgcagaaaaaagggtaagaactaatgctgatatactgagtggggaaacccaggaaggtctatctgtctagactcttcctggcctctttaagcctgcattccttccttctgggtatagaacatgaccccttctggaatgggagttttagtacctacagtcaaacaaggtatatcagataatttctttatgggtcagtttttacacagaaaggtggagagaaaaagtaatatttgtaggtttttatggctggctttggagaaaaagggttctagtttctgtgacctgccttggggaagagggattataggttctatggctagccttaaggagaatggaactgagagaaaagagggcaggaggtcagagaaaaactttagcttctgaggctgctgctgaggccttcatttggtgatattgttttctgaaccccaacagtacccaaaagcccacaaccgtatattttgtattatcaggacattcttcactcaaatcaaagcatctggcatcccacatttcacctagattactttggagttccaaggtacagcaaaacacattaaaaccaattaataaagaagaataaatttatattaaggtgagcagtaagatggaaacaccagaataaccaaacactcaaaggaccttacaaaaaattattcttgattccaactttgaatgttaatcacattttagagaaaaaataattaagatcagttgaaggaaagcaaataatgaaatctttaaagttcactactcttacagattttgaaaaagttaaacagagggtcgttatgtttaaaatacgttgtgggactctattattgaataacagccttttaatctttgcggtttttgctactagatacaacagtgctcttttaatgatctaaatctttccattagtctaaaaagaacaacttgaccacattatccattatctttgtttccagaaatttactcttgaaattctttaaactttgcttttatatctcttatattttcttctaacacaagcaaaaatatttgaaaatcacaatattttttaggacttttttctttatcctgcaagaaaaggtgactttaaaattgttgccctaatcaagatttgtgttgacttaaaagggtctatctacaaacttcaattttatattggcctaacatgtttgaaaatataattttcttttgtttgaagaaagttcctcaaaataggaccaattgtttcatatttcaatattcacctcccaaattagtgcatagtagacagctaataaacatctgcagaattagtaacataaacataatgcttgttagtgtcaagtggctgaaattcgatgattccaatttctgtgtttaaaacaataacaggccgggcgtggtggctcacacctgtaatcccagcactttgggaggccacagtgggcggatcacaaggtcaggagtttgagaccagcctggccaacatggtgaaaccccgtctctactaaaaatacaaaaattagcctggtgtgctggcaggcacttgtaatcccagctactcaggaggctgaggcaggagaatcacttgaacccaggaggaggaggttgcggtgagccgagattgtgtcattgcactccagcctgggtgacaagagcaagactcgatctcaaaaaaattaataaaataaaaaataaataaaataaattttaaaaataaatatttcaggaaatacttaagttttccttgaaaaacactccattcatcctctttatatttttacacaccttcaaattctttttatgacatttacacctttctgatcccacttgtaaacactctgtaaacattacacagtcagtgtttaaaaatttttttcattaaaaattctttctcaacataatacaaacacagatttacgcatttacaggacaattattcctctctcatttacctttaaatagcagtgtccctgcccattgcttactctaccagtttgatataatggatcctttggtggcaactacatgcattttattttcccaaagagaatcttaatatacatcacttccttcacaaagaatttcagtaagagggaagaagagatatcctggagactcaaaatatcattattaattgcaaccagctaaatctctgataatttattttattcacaaaaaaaaaaaattatttgctgtgaaacaaagaattcttattaggaattattaataaggtattatgaacaacctaaacttgaaggttaaatgtgtgtatatttttatatgcccatttggaaaggttcatacttaaaaaaaactctcaatactcatgttgctaaataataaagaggccatgaaattaaataaatacatgttaatattaatgctttatgttggcctgaaacttgctttattgtggctttgatctacttttacccagggctgccaccaatctatatgccactttgtgggaagtggaatatgagtcacctccacatagagacacagtgacttagagcagcgatcccaaacctttttggcaccaggaactggttttgtggaggaaaatccatagactggggaggggggtggtttcaggatgattcaaacacatttattttgcactttatttctattattattacattgtaatatcgaattaaacaactatacaactcaccataatatagaatcagtgggagacttagcttgttttcctgcaactagatggtctcatctaggggtgatgggagacagtgacagatcatcaggtatcagattctcataagaagctcacattgtagatccctcacatgcacaggtcatcacagggtttgcgctcttatgacaatctaatgctgccactgatctgacaggaggtggagctcaggcagtaatgtgagcaatggggagcggctgtaaatacctggttctctgggggttgggaacccctgacttacaggcaagacttgataaactgatcactagcagaaaatcaactgccatctgccttcttagctaaatgcccctgtgcaaggcacaaagtttgtaaattaactcagtggccctgtcctttggatctaggactaagaattcattccacatggcaatctgtactgggtatctttgtcatggtgtcttccgtgtctgttttcctttatcaattaaaaaaataactatgatctcctattcagagatcctttgcacagagttagctatagaatgtattataccaggagcaatgacttaatccaaatgcattgcaactagaggctgacttgaaactttaaagtggccagggatgcaatcatctgtcccaaatgcagaaccattagctaaacaaatcagaccgactctctcaaagacactggcaaacactggtcacagaaaatgctcagagaggtgcagagacatacatgaactattcctgcagaattcttactagggaagccaattgttcaagggctaatgattttctaattacggtatctatatatggttctcatttgtcttaaagatatctcagattaatcctctatttctgcaacaggaaaggaatgcctactaagtacacagtccttcttgctcttaaaaagagttatctgattcgggagtcattctttaagtccaacatttcatctttcttcattaattaattatatgtaacaaaagagttacatatagagtatatgtatatagagtatagaattgacactcaagcgacaaataaaaacaatggtgctatctttggtgatttataggctttaaaaattatcagacatccttggggcaatataagaaaattatatgtattcattcctagtaggtagaaaatttgtgttaaaccaaatctgtatcacagaagttaatttttataattgtagcttcatattttttatttatctcagtcattattagtggatttaaagaataaacatcatggttatagatttctggcttttgtagtgactgattcaattaacattattaattgagccctgcatattaaaaactatggcatgtaatgtgagagtacagaaagaataaaatatgcagtccttgcactcatgagataatacatctgatgtaaaaaaaaatactaaaaatcatgaaattatttgcacattacagagcagcctgagaagtgcgttctactctaagtgatccaagtttcccaaacagagatcaatgagggtgactcgttcaaagctccctaactaaaattaactcaattattcaaactgccattttttctcatgatgtgaatacagttttactatttcaataaaagttatagtgattattgataaagacttttggtacaaaatgccagaccagggatcagaaatgagcttctattccatgttattctcattttggccacaattaacttacatctataggacaaacacccaacagatctttaggcctgaaaggcagaaagaaaccagtacctggggattgtgccttttcaagcttacacagcaggatatgaagaaaagaggtcatgatttgtgctaaagtaactccaaagaataacatatttatcagaatacaaaacacagatatacttgaggaaaggctgacctaaaattgctgaccatcttgtctggtagtggagctttttcttcactctaaacagtcagatttttagtctcatcatagatacccaagatttcctgttctgaacaagtcagctctttatatttgtggcattatcttactaaggccctcaatgtaattcctgggtagcttttatccctatctgttttttttcccatctaaaatctaatcttcataccaatatgaaataaatctagcgtaattgcaatttgagaatgtaaatttcaagctcttaaaaactacagtgcctaataatttgcattgtaactaaatacatgtgctcacatacccacacactcccacgactcataattaaatttcatttaaaatttgttcccttactatataaaatgtacttgtattttccattcccttccattgtatttcatttcatttcattccactccataaatgccaaccatgagccactgaattaattttatgatcctctaaaatagtggttcccaaaatgtggttccagggccccctggaacacccaagactcttccagggaatccacaaggttcttttcataaaactactaagatgtcatttgtctcattcactctcaacatcttgcaaatgtatactagtgttttccagaagctacatgatttgatgatgtcatcactctgagagataatggaaagtattcttgtatattcttttctttaaataattttctcaactttaatttctaatacagtaaatatttataaacataaccatataaacaaaaactctttgggtctctcagtaatatttaagaacttaaagagatcaagagtccaaaaagtttgagaactgctaatctaaagcaagcttccatttgaaaaacagtgacttaaatggaatcattgcatacatacacacatacaagtctctttccatacttttctattctctgcaaggcaaaatgcaaactggcaccaaatgtcttacaacaaattagctgtgattctactatttcctactattctctgctctttactaggaaactccatctaagtcccctaaatatataatgttcacctctgcctttgagtctcattttatagtatactcttgaaatatatttaacactattttctgctaacataagtcctatctaactatgtggacatctgcaatttctttgcttgccctgcgtcctttcttttttggaactgacccttccggattccttgaattcacacgggaatgcgaattatgtggccctaacctttcataggcctgaggattcataccagtcaatcaaactaccccatacctttggtactagtgtgcagattacatgggaagggctaacccaagagcagtcgagggagatatatcaatgttaggggaagaagaaattgtgttttgttctctaagattgctcactgttaggaaggcaaggagaaggccagccttattaagcaatggcttagggacactgtggcacaattctttttacatatatattttttatattttgtcccagtgtccccttgactagacatctgcatatgtctgtcctttggcattgctcccaataatgcctgtgtgccctgtagactccctattttctgatgaggacttgtactgttttcaaatgcctctctattccctttaagacactctattaatttactttgcaatcaattattttatgttattctttttttttttttttcttagaaactcactaggtgcacaaaggaacaattctgtctctgcaactaagtggggattctttcttgtatttcctaaaactctaaaagaactctaatttttaatatatttttggaacctatttgcttgaattttttcccttgaaaatgattgacaaattgaatgctgtgttatcttaacagtttccttacatcttctttaattgctgtgtcatgcacagtttttcttcacttatgttttgaagagaatatgttatccttcccccaccctaaatgttatccctttttgatttgaaaaggcacacaacttaaacacatgaaatgaagataatttccatgctatttaatgtaaatttggaatcttctaaagtaaaaatattaggggaccaagtagttaatgtctatattaataaaggaaaagtgaatacaccacctctgtaatgttagaagacagaagtactcgggaactgtaaccatgtgtacatttcagtaagatgaaaattgagcataccacaaacagaagacagaagtactcgggaactgtaaccctgtgtacatttcagtaagatcaaaattgagcataccaaaaaaatcatcgattaaataacattccaaatgtcctcagcaagtagactttgttatgcatgcttgggattcatattaagatatagccaaaagaattcatgattccgttacctccttcagaaattgaaaacaatgatcatcaaaggtcaaagatgccttcttatgctaaattttattatcaacaggtcatttgaaattttgaaggcatagcttaatgttcttagaattagcacttcttaattaaccaaacagcataacagaattatagagagggagaaaaaccctcagttaaaatgacataaatagtaatttgtgaagttcaatacctcttggtctgctaattattatatgatgcttcattaccatttaaaataccacatataaaaagaaaaggaaagagaaagaaaatttagagcacattcattatataattttgatttattttacaaatgcaattataatcatatttgggggtcagagataataattttgctcaatatttcataaggaaagaaaatctaatttttcatatgtagtcacattttaatatgagcatattttatatgtgatacataatattatatacataattttacatatgactggcagaatttctgcattatatatactttttatgaatcacttaagttggtttttaaaaacacaactacatataccaagaccacatatgcctcagtaagaagaagtatgaaattatttaaactctcattcaggaaacactacaagtttaaatgaagtaacagaaagttactgcagaataatctctctattcaacaaaaatattacacagtttgaaagtaatgtaagtgggtccaccacattaaacacactcctaccctctactgacctattttctagactctaagtcagagtatggaatttatctaagttacttcaatcctcttatctttctaaaaaccaaaggcagtatgcatttataatgcttccttaactcacatcacttcataaatctgttttcttaaaaaaagtcatatcataaatgagcatgcaaagcacatactgcctcattcaaaaaatgtttaatcattagaaatagggcattgcatctattatcatttttaaagtgttaatgtgatagcaatctgaaacaacaaataaaacatctaagaaaggaaagctatacaccttttcttcttaggattattctcagtattgcagcatgttgatggctttactaaacttaccaggctattttctcacctaaaagttggacatcagtgggcaaaatattgccctactgatactacagtgatctatacattttaaatattctttaactgttccaaaatatatatattcattttaaacaaaataggaaaaagaaacagatatgaaaaagacattacctgtaagtccactgcccagaggaaaatgccattaaaacttattcttatacatattcttccagagaccatactctgaatatggatattatacatatatatatatatatatatatatatatatatataaaatatatatattatagatagatttgtttttaaatggaattataattttccatagtaagctttattcaattcttaataacaacaaatatattttcaggtcaacaatatgtatttgtataatctgcatcaatgttgttaatggctgcacaatatattttcaattaccataccataattcagttaaaaatctcttaccagatatctaatccctttccttccaacttctgatactgtaaacaaaatgttggaataaatatccgattactataatgtgtgcatctttcttagtgttttgcatacaatgcttggctaatgcagggtatcaatgaaagtttgttgcattaatgattggatggatgaataaagtaacaaatgtgggtttttaaaatatcatttaaaggagcacgtctatttgatattcagattttgagtcaaatcacttcacacttctttgtgcttttccccatgaattatgataacgagaaaacatgcataatgattaaatgactttcatccccggatgcttccttaatatgtgtgaacttgtaggactataagtaatgctctgtgtgagataacatactcaacaaatgttctaatagagaagaaaaaacgtaattgttgtttttaaatgtagtataaacttcataggatgctgtaattttccatttatttttcttgcataaaatacatagaattacataggaaaaataatttcagcataactcatatgtcccaactctcctctaggattttctaaatttgatttaacaagcagctaatgagcatttatgtctgacattaagctaatcacaatagagaatatttaaaaccttgatatagctaaaacacataacttacatggtcatcgtatgtaatttaattacagaaagtaagcgatttcctctgtgatatgagaaaagactaagattctccagctaagataaacagatgcaatatttacatcagctggaaggaagagagaacttcctcacccatggacaatgtgacagcaattccatccctattctcagcacagtatcctccttgtttaacaaataccttggaaacttgccagttttcaggtatttccatcttgggatactagccagttattcaggacatgaaaccaggacaagaagccagatgtgcaacatataagagtaataattattttccttttgattcccttatcatgacaatggaggatataacctatattttcaattataaattatttcatagactgacagaatttataaaagttcacctgaatttttaaaaatgatatgcctactatgcacaaaatcacataccagaccatgcagggcttgctctgtgtctcagttaaatctggcaacgaaccttggtcaacctgtaaaaccccatggattctcactgaacacactgtactttctcagaagaaaaggattctacgtatgccatcagaggctactcagtaagcaaccaacaccattcaatatattcatttatatttccctaagtttcttcactgtcaacctttaatatctattttcctgaaagagagctgaagcacacataatggtttcaaacatctgtttgttctaattttaacaaaagttgtcccatgattagaagccaactatttggagtaatatcacgtttgttctctataaataatataattaaattgctacaactaacaggaaaaataggaggtagccaacaatataaataaaccacaaaccgtgtttaacctagatttgcatatcgttctcttagttttgctatggttggaatggttttactagagttaaatttctttaaatcaggagatgtctgattaaaattttgaaatgttgctttctaaattctgctttttcttagctcactgcaacctccacctcctgggttcaagcaattctctgcctcaaactcttgagttgctgagactacaggtgcaccccactacatgtgcctgaagaaagtaatggcaaaaaccgcaattacttttgaggtaattaatatattaatagtttctacttttgttgtatatattaataatgagctgttcattcaaaagtttttacctaaaaaacagtttgctaaaagaaaagccattgcattacaatattttgacagcttttggcttagaaattagaaaataaaataaccaccaactaatataatctttagaacatttttctttgcttttcatcttttgaataagtgacaaatattaattaggaatagtagtgatagtttatgaaggtaataaccactactgtaacatgttaataatttaattaagctagtttctattatgaagcaaatttagaaaaggggagtaaataaatgtacacaataatgcattttatctcttcaatcaaaaaatccatagatgctaatgtaatttgttaaaatgccacaacgctattgaaaaccaaagttgccatatgataaagtgatatttattaaacctatcattccagagagttttcctgccttttgttataaatgtatttaactgaggccatattttcttcacatttgttccctaggtttgcttccagaaagattatctatggtagaataatctttataataaatctcaatataccctgctgtgccctaacactttaacactttagggcaacaaattgccctaaacacttgttagttcttctaggcacagagagctactatggcattaaaatagatgtatgcagcaccacattacattttaaaaagtaattacagatatctcttctgtgatcacctataatgtaaggtccaagcccttctgttgaggcaggaactatcagaaagataaaaattgattctgaaataaaatgcttatttcccaatattataagaaacataactgtctcggcgtagtggctcacatccgtaatcccagcacttagggaggctgaggtgggtggatcacttgaggccaagagtttgagaccagcctggccaacatggtgaaaccccttctctacaaaaaataacaaaaattagccaggtgtggtgacaggcacctgtaatcctggctactcaggaggctgaggcaggagagttacttgaacgcaggaggcagaggttgcagtcagccaagatcgcaccactgcagtccagcctgggtgacagatagaaactctatctcaaaaaaaaaaaaaaaaaaaaaaaaaagaatgaaaagaaacatagaaacatacccaacttattcattgtggaagattgtctcttcagccatttgtattacgtattaattttttttatattatggtttctacttttgtcatacatctattaatgatgagctgtttattcaaaagtttttaaccaaaagaacagtctgctaaaagaaaatcctttccattacgatatctttgacagcttttggctcagaaattagaaaatgaaatgataaccaccaacaaagggattctgcagctgagtatggatttcctcccagtgacaggcatttttgtaagcacagagcctaataattgtttgaataaacaatgtgtgtgtgtgtgtgtgtgtgtatgtgtgtgtgtgtgtgtgtggtgtgtaatctacacagaaaattgaaaaaaaattttcacaatggttaatggtattaataggaataaatccagatatcttaaaaagagagacagagagagagatagagaaagaggagctctgaaaataattcattaagactctttttatcctgaaatccaaaagaacatctgagcttccatcattcatcttaatagtttatagagtcaactctaatttcaccatggatgaaagaataaacttgaaataacaaataggcaaaaagctatggagaaaaagcttacagatttatcttaaaatttagcctgacaatttccaccttgacagttcggtcatgtttcctaaaaatgattagctaaaaacattactttatagtgattcaattgtaagactttctgaagaacaaatcaagactatttagtaccagatataaattattttaggcaactcttttactcttagttttattaatgaaaggactctcttaaagaatcaagtcaggcattgacactattttgttttttaacttcatcagtagttaatttggacttcacagcagaatgtacactgaatacatgctctgaacgtggcctaagggacaacactaacctgacatcaaaaaggcctgttcatattactaacattaacacagcatattacatatagaaggtgattcgtagatagggagtaatgaacaatgattaaagtttacatgaacttcatctttcagatacaactagaagcatttttaacccaaagttatcaataaggcaccatttggcatagcacctaagtttttccttttatacttcaccttaaaaagcttgctgttgactacaaagatgttgaaaatataaaaatataaaaataataagaaatgtctcaatagtttgcatgtctagttgatcattttaatgtgcacctaatactaattttaaccatacacttaataaaatgatccaaactcataaatgtattattccctttccattccaataactctgtttttaaatagtttgcaaacacctaactgacaaattcctgaagctgcctgagagtcatgaaccacttgtaccccttcccaatttattcacttatttattcatttattcattatttctacttaaaaataaaaaatgtgttggtcaaggagttttatatatatatagttctattaattcaccaaattactaaagccatctttaccaatcaaaagttactctaaatttgttacattagaagttcacatttccaaatcacagaagatttactaattattagtctagatatagtataaatattttggcttccactttttgccatttatttaaatctaattaaatgctcttaattgtatatctctaagtttacctctcaaatcagagaggatggaaagatactctttgcatttaggggtatgaggaatccttatcactttctcctcgatagaaaaatcaatttatttccttttctaaggccactgcgagatgcttttccagctccaggctcaaagagagagtgtttcatccctatttcaatggacaccagaatcaatattttctttaggtacttgctaaaaagtagttacattaagtccccacccagtggtactggccttagtcttttcttactataaaagaacatggctattcctgtttcttcctatactagggatctcttcaaacacaggacagttaacaaattgtcagtaactattggtaaacacatccttccagggaaaggcttcacatttatttgcctacatacacatattagggaacttttcttatttagatataatagtgaaaatgtttgtaaaaggcaaacgtaaaaaaagaaaaaacataaaataaaaatctgttcattttaatgaaatgcattatgtcccctaatctgccaggatggatcttgtctatgtaaacaaatttcatagtgactttcaccttcttcaagatacttactaggaagtatcttaaaggcaatgaatataactcttctacataaaattctgtacatagtagagtggatagacattagctactaacaaatatttgctggcaaaaagctagagcaaacattcaaagcatttttttatttttattttttaattaatctattttttttgagacagagtcttactctattgcccaggctggaaggcagtagcatgatctcgactcactgcaacctccacctcctgggttcaagcaatcctccctcctcagcctcccaagtagctatgactacaggtgctcactgccacgccaggctaattttttttttttttttttttttttttttttagtagagatggggtttcaccatgttggctaggctggtctcaaactcctgacctcaggtgatccacccacgtcggcctcccaaagtgttgggattacaggcatgagccaccagagtgttctctgtattaggctgcccagtcctgtttttgtatgactctctatctaagaattagaaaaaggtttctctttttaataaataaaacaaaaagaagaatatataacgaagagtgtatgcggccagcaaagcctaaaatatttatgtggtccattaccgaaaaagtttgccaatctccattttacagtacagaccctttgcctaatatatgtgcctactatatacagggtattagatttccagagaagggaactaaaaaaagaaataattttgacttttcttcctgagtcctataggctgaaggctatatctgggatagaaagggattaatatttccaaaatacttaaaatgtgttttcctcttcatcaaatctgaatcaaacagtctgtattaaaagtgaaaagtatattgccctgtatctttaatatggataagggcaccagagttgtgcccttttttagccaaaatgtagttatgaagaaagaggcttctttaatagatgttaacaaatcaagtcagtgacaaagggaatgtgaatagagaaaccgcttaaagagtaattagtttgtatttaccccaaattttatttagatctaaaaaaaattatctctgcaaatactttatagatctagaactcttttagttacataacactgtcagttaaatttcaccaaatagttactgggagattggaccaaaattgcagattcaacatttgttagttttcctttctgctctaattccatgaaaagacagaatatatactttttaagatccagaagagtgctagaaaacaaatgacagattttgagggctatcttaaaaatataaaacatacaggaaaaaaaatgtgtgaagtaaatctgtagattaccacagactaaaattcacatggacaaaaatgctgtaggtttggtagtataatagtaaatatcaccaacatccatgataggtattctcaaacaaggttaagcaaaaaactaatgattactatacatttaaaaaggatcaccactttaaaagagctatgccaatttccactaaaagaaaaattttcactgagaacttactgagaaatgggaataaaaattacctatattagaagaaaaaccataacggaatcagacttatcttcaacgtcggttaatagaagagtatggagagatggcttcaagcagaaaattctgaatctagaatgttttactcaagcaatccaacatcaagtagaatgaaaaatacaatgttttaagatctacaagaactcagaaatattaatatcaatgaaaccactctgaaagaattaactgaaatgtactacaataataaggaaaaaaggatccaaggaagaagataatggagaatgagaaatagtcaaataaaaagataaacataaacaaatcaaaaatgttaattgaaaatacaggagaattgagatatgggaggctgtgctaagcaagaaatacagttcaaaggcatgaaggaaaagactgatacatttacccatataaaaaaatgaaatgaaaacaaaacttcaaaatgaggaaagataaaaatgtttaaaaagactatataatggctgataaacatatttgtcccatatatgacttacaaaatgtcaatagctagattatataaaaagattctacaactctcaaagaaaaaatgagcagggatataaacagaaaaacactacagagaaattacagagaaaatgaacaaaagtgaccaataaatatatttaatgacttcccatctccccagtaactctgtattaatagagttaataaagattaatatagattaatataattaaagttaacttaacatacagttaactttcatttccataatggaaattaaaacagcaacataattctctctccatgagactggggcaagcaaaacatagtaatattaagtcgtggtgaggagaattaaaacagaagctttatatactggtaatgcaaatataaattaggagagactcttgtaacgtaaattggcagtagtttgctcttgggaatttcatttttataaataaaaaatattcgtagatgaataaatgtatccatgtgtgagttaaatatggacaaacatatacagaatatccactgcaacattattttttatagtaaaaaacattgaaacaacctaaatatttaccaacaaggaatcagtaaatacatcatcttctatgccagaaaatactgcgcagatttttttttgaaaacactgaatatttcatgtgttgttacattgtgaatactaaacattaacatagtgagaaaaatatctaataaattttaaaaagtttttcatttatattttccatttctccttccactcatatatcgattttgcccttatgcaaactacatatctgtaaaaatatctaggtcttttttaaactttttattagcatataagcttttttataaatataattgccaaatattcatattttttttccaaaaaatcgagatagtgctatcaaatatccaaaacataggaatggaaaaaagcaactcacagaaaaaatgcttattagataattctatttgtttaaaataaacacaattgacatagatatatatgtatatatgcgtaaatgtacagaaagtaaaattgaaaaacagcaccctgaaatcttaatagtgctttactttgtagaggataatgagaaagcagtaggaatggaggactcttttccatttcacaatacatttctatatgctattcatcttttacaataaaaatgcacttatgtgacttctacaactaaaggcattcagttatacaaattaaacaagaggagaaaacttttaaaaaacaaaaactcatttttttcactgtcagtcttaacattcattttatttgtcataatttgaggttttaatagttcttcatatgttgactacttattagtaaataaacaacttactatccaattttaaagattttctatttaagttagtacaataattcaatataaaataaaaaagtattaacaataaaataaagattgcaccccacaaatctggatgatgttgaagccatggtcctcattttcttcttctagatattcactctgctattacatagagtcaggccagattaacatatgatttgggaaatgtatgctctttttcccacattctggaattggaatttgtggtgacatattttgaacaattaatgctcctagaagatcctgttacaaacttagaacaaaataataaatgggttattacatctgtgtgtgtctaaagtttatttaggaaatcagaatcttaccaagaaaaaggcctcaaatcagcgcttcatgaccactaaagtataacaacctcccactctacattcactttgtatgaatacacttaaggcagcttctaataaaggatgcatatgttctgtgttattttggaacatatactgtctgttaggttgaaagagcttgtccatgaatcaataataacttggaatctggacatctctttggagattaatggatagctaagtagagctattcacaccagagaccactaacccccattggtccctgtccagtttgtagcagctgcagaaaaggaacactacgaaacacagaattacttttttggacgttattccaatgatcctcagcaagtgtcttttgcaaaaaatcaaaatggattaattttttaggccaggttcactatattctattcaattcagaaaatccataagtctaaatccggatagctgctattgaaatgttcatacactactcaggtctattcagggaactgggatagttctgatgcaacagtgctttaataagatacagattcttccataagggtcagtgataactccaatgttcagctgacaaaaataagtcaggcctaatttaccacatgagtcttgtcggcgctccttagagtttatcctgccaaatcaatgactattcctgtggcataaaccagatcattttctttttaaggtcttagtcattatttattaactcatctagtaaagtactcaccttgaaataatatagactttagatgcaaaccatttacatttattttttccccaaaaagggacttgtgatgaagtgaacagtatggcttcatggcttttactactatgacaaactagacagttttgtttggacaaataagaatgccaattttgtttggaaaatcaaacgagaatgctgtctaaaggttctaaccaaggagacaatccatccgtaaatgactgtcaaggtgagctagccctagaccaaacaaggaagaggttaacagctctaaatcccctctcctgtttaaattcttattacccttagggtatctaaatcaatgcaaccatgtgttgtactgagatataattccttgagataactgagataaaacaaccgagataactcattgatatagcagagtatttaccctaatgctccatgcagagaacacaggcgttagcagctgctgtacctaagcttcaaatggtttttccccagtttattagctgtatgagggtgcctaaattatgcaccctgcctaaaacttcagttttcctttatgcaaaataggaataacaacagtatctactctactaggtggttggggagatcaagtgagatcacggactcctgcctttacctctgctttatgacaacttctctccttgtctttcaatttatttattttctgcctttcccactttttccccccatattttcccctatttttcttttttaaaaaaaatccaggaacttgcgtcctgagagatatttttcttcttttgctttgattcactgtttttagatattctaaattggcaaatttatcccaattggagggataatcagtgagaaataaacaacatagtaacagaatattttgaaatttatgaaggttttgttttaatgtctccaagaatttactaatgacagtaaaataagcagattttgttcttatataagaatgaaatacatgtgttcatctcattactatgactacattcaatatttgagtgagaatacaattgttaaagttatttatgagatataatttacatacagcaaaaaattacccttataagtgggtaattatatgaatcttgacaaacacttacagtcagataaccaccaatacaatcaaggtataaataatttccaactctgttcacccttgcccctacaacccaggcatttagcaatcagcaattgttttctgtccctgtagttttgtgttttccagaataccataataatagaatgatatagcatgtagacttctgagttggtttcttgcccttagtgaaaaccatatgagattcagccatgttgttgcctgtattcgtattttgttcttcttactgttgaatacataaattgcatggatgtaccccagtctgtctatccactaagcaattgatgggaatttgggtggtttctaaaatttatcaattataaataaaaccactctaaacgttaggtacaggttttgatttctggtatggatgtagagaaaaggacttacgttttcacttgtctttgctaatatgtaggagtagcattgcttggtagtatgttagactttatcagaacctgtcaaatggtttaatggttttcccaaaacaactttatcatttctcattcacaccagcaatgcatgagatttttagttgcttgctctacatacttgccagtacttgatattgtcatttttttaaaaaattagccattctaataaaggtgttgtggtagctcattgtgactttaatttatgtttactaatgactaatgatgttgagcatcttttgccttccatatatcttctgtagggaactgtctgctaaaatattttgatcttttttacattgtgttcattaacttatcattgaattgtaagggtgtttgtgtatttaggataggcatgtattattcaatatcaatttgcaaacattttcttctatctcttgagttttccttttatttctcaaatgcacctttgaagcccagtgctaaaaaaatcaatttttaagaaggtaaaaacttacttaaattactacttcacattatttttccctttataaatgtcaatgaaatattatggtcatatgtttttcaaagcttttagctcattacacttttcttatctactttccaaaagagaagactatgcatagttaacagttcaagcgctcttttgaatttctttgccacatagcttattctctagggaagaaacacttacataaacatgttgctctgaagagtacagaggggaaccttagtgacacagtttttggttctgtcatcaggtgtagacatagactttagtttctcttctctcttctctccattcttaatacttttccagtttgggtttgggcctacattcatcctcgagtcctattaaacaggagtatgatttttgttctcccaactcaacaagacaacgtcttgctgagtttccttttctcccaggagctgtttcccagatccatggctcacatgctggccaaggagctgaagtgtcgtagtgctgcactaaaaaagctttcccaggtggagacctcgccatttctcaaatcttagccttcctctctgggataagtaacaacagacagagcaaagaataaaaggaaaacaagcactttgggagcatccaatagacctgggcctatgttctggatctgacattattcatttgtttatttactctttctttaatgtattcattcattcattcagcaaataactctttcagcatctgctctgtgtgccatgctaggaactaggaatacagtagtaaatgagacagacttagctttttccctcaaataaatggcaggtctgtcatttctttgttgtcctgaataagctgttaagcttttttgtgtttcctttgtctattctgaaatggagaaagcagttcttagctcacacatctaatgaatattataataagacaaaccaaaatatccacattttaaaaaataaggtggatgtgatgttctttgtggtcttccatacccccaattttctgcaaaggtgacctcctaaataaattatacctaaggtggaaaagaaagatccaactgcagtagtacctcatcaaaatggatgcttgtgatgatggagagctggttttagcaagaagcccaagccagccagctttctagtatataatcctgataatctactcaactatggtcctactgcaatagcttctgaataaatgctcaacagttcaggttgcctttccatatattttcactcctatactagtgctttgactagtctctatagttgtcattcacccatctatcctcattgtaagcacactttgcatttgtcaatgaggcctttgcacttgaaggagaaaaacatggaaaatagaaccagaaaatagtctgacatcatgtactaaatttccagaaaacagattatctaatatcttgggaacgcgattcaaggagcacgttcttctgagataaaaaacagcttttacaatacaagctattaaaaggcaacgatgcaatacaagctttttattgttaactccattctcataacttcagtttcaataaaagatcccattagaaatgcttccccatgtggcaactgctctggaatttccgccattattttctaagcattttatctatttatatcataaagctataaaagaaaggtctggatcaacagtgtgtacatatgaatcttttcgtctaaaagcctaagactcaatccgagaggggataatataaaactttagaagccacccagtttctgtccaatctgccatgaaataaattcagagacagaaagagagagagaagaataaacctggctgttttctattcataaaggtctcctccaaaagctagtcagttctaactagctaacagaactagcaataatgagtttatttagtataaattttgcatgtgttctcttttattccttaactagtaaagtagatatgagcattacccacattttatagaagacaaactgaggattatagaagttaaataaccttgtccaaggtcatacaggtagcaaacagcagaaaatatttgaatgtaaatattctaccctcaaaccttttattaaattatgcaagatagaactttgaaaggctaacaccctcatcattagcacacagtaggcatataatagaaattatcagctggtagatcagtgaatttgagggctccaaaataggtttagtgcttataaaaagcacagttctttgtagacagaacactacctattatgacaataagctgttggcaggacctgaaagaaatcagggagggccttttgaggattaagaaggtataatgaaaatcaggaagctggtttaatgagaaagaaatgcaatatactttgcctctccgattccttttgtatttggtgtactcatctaggagcaactccgtttgttttcttactgtcactctttttttcacatggcctggaaacgattcatgtttctttagtgatgcatggggagagaatagtttatgcagacaattataaaaaggatggattattggtagagactgatgggtcaatataacatatggtgttcaatgcaactacatatctttggaagttactgacaagtctataggtacagcaatataaagcagattttaccaagtgcataaatttgcagaatgactatattttttaatcaccaaaagctatggactaagccatctctagtgacttgtgaaataacgtatgcaagaaatctaaatacaaggacatacaaagagtagaataatcacaaatatatcaacagggaattatttgaagcatacatgtattaggagtaagttctattacacgagagaaaggtaaatgattgttataggagaaaacaattatatattgtctatgagagaaggtagtcattcaatatttatattggaagatatcattaatagacgataatctaagtctttcattttacaaaatgagaatggagaccgaaataatttatactgtatgcacatttatatagttagcctagggctagtctcagtgtgccatactgccccaaagatttttcgtgaactgaaaattatagtacttttttatttatcttctgttttaggttccctttgattctcagatatttttcttttatgtttctattaactcagccattcaccctttcccttctttagtcactgcctgacacttggttgcaatctacctttatacaattaattagggtgtaattctccaacttgctatgattctttttaattctcagactatcatccaaattctttgtcagccccactttaaaagttgcgaggacaccaacagctcatgctaaaatatttttcatttctggtaaaatgccatgtaagtggaatgctaataaaattttagattccgtataataaatataatccatatagcaggccatgttgctatccacagaaagcttctccacacactatttacataggattcttcactacaaaaatcacatggagaacatcctttccctattctttatctaagctattccttggtaagaggaaaggttgatgattatgctgaaaaggggaacccagagcactttgcaaatttatgttctttaaccggcatgtattttaaccttcaactactttctattttcctacattgactattctaattcatctttccagaacactcacttccattcccaaaatacacaccgacaaaacctaagattttagattttgtttaccatgttctctgtgccagacatggttctaaatcttccatatttatcattcaccacattctttcaagatagggattgtcattgtctctattcacagatgagaatactgagccttagagaagttaaataatccaatcagtcttatagagttgatcccaggtggtgtgatcttagagtctgtacaattaagtactaagtttcattaataaacaatctcacacacacacactctctctctctctaaatttaataacctccatcaaggctacatttccattatatctcaccttgcatttttcaaggaatacacttattaaaagaaaaaatacagacttaaatagggagataacttatcctcaagttttccaattatacttaatcacctagtcaaaagcattcagctttgcataagtccctatattatcacgacttttgttttgacaagagaagaacatagccagagaggcagaacagaatgtacatgccaaggatctaggtttatatctagtctaaagaaaacctcatcataatcagagaattgatttttaaacttcctcttccataaggagaatttctaatttaaatgcagttcactaccagagaatgcattagttctgtgtaatgcatccagaaaatgttcaataaatattaacagataattactaaagttatagataatataaattacacatgtagtacacacatctgagttttttaaaaagcataaattcaaaataggattttaaattatatacaagaacaacaactgcaaaattaacttcctgaaaggtacagcaagcacaggatacaaaataacctgaaccttacttagtaaacacatacaaacggtgatgcaattacactgtttttttaaaaaaaactattttcttcacaattcattctcaatatgattttcagttttaaatactaaaatcactgacgcttaaagtgtctgttctcagtttaagagaaatatagggtaataacattgaatataaaagatcattttagaaaagaaatacatattaatgtatttacactgaggcctaaattatcaaccaatatgttgcttattattaatttcagagagaactgcattgctttaggggctgagaaggggcctaaactgagacataatgaactgccaagctgaaaaggatgttagaggtcattaagttacgccttatagttttccagatgaggacactgagacacagagagtagttgggacaacccgaggtcaaaccacaaattagtggcagagaaaagacaggaactcagaggaccaaacgcagtggctcacacctgtaatcccagcactttgtgaggccgaggtgggtggatcacctaggtcaggagtttgagaccagcctgtccaacaggacaaaacaatacaaatatatctacacaacaaatacaaaaattatcctggtgtggcagtgcacacctgtagtcccaactactgtggagcctgaggcaggaaaatcgcatgaacctgggaggcagaggttgcagtgagccaagagtgtgccactgtactccagcctgggtgacagagctagactctgtcaaaaaaaaaaaaaaaaaaaagagctcagaggatcctagacctcagggtactgtatttgaagatgggacaatcttggaaggtgtcagtgaactttaaataaatagcaccccatctagtagtttctctttcagtcatggataaatgcaactggagacaagtcttggctttacgccgagcaaggcagctcagagattcacagcaataattcttgtgtgactaagcaaaggcctccactgctttaaatccctgcatgctttaatctccagctgtctttctggtgtactctctcagggtagggagggatcttaaagataataacttttagctttgtaaaaagttcagatgattttaatggctaagtatttacataggttatcattttcaaagtccaaatgttggtcaatgaggatattatggaggggaaaagtcttgcctacgtggaatatctatgactttgataatgaagagtgagcaggttctgcaaggagatatgttggaaaatactgagctcccatgactaaaattaagacaggaaataaatcaatctcagaatttctcaaaagatgttaaatgggcagtttgctggttttgggaagtgagaagggaggtggtaattattttaatccgtatttttgtggcacaatgccacaaaggtgtacgtatcatgcttaaagtatattcgcttgaatgagattatcatctcatatctgcttccaggaatagctcagatagaaactggtgctggggttaaggtaagaaatgatgggtttaccttcccttgtcaaacaagctttatcatttagagtaagcacaaggccagtttaaaccagcttaacttttacatgtatgtatgtatttatattttcatagaactacatatttatttctcacatatttaattagtgtcaaagacagcagtgataatagaaaggagccctggaatgaaacccagaaatcttgagttgacatcccagatctgcatgtacctggcttctgcccttcaccaagtcaataccttcaggattctagagctacaagacgaaaagcttagacttccaccagggaaacctccatattacataaatgggggagataagtaggttagacttattcaaatgcagaaaactagaaaattggctgagctaggactcagtcaacagccactctaacctccttctatatcatcttctactattgtagaagatggaaagttaaaaaccatctttcaccaattccctttacattaggattcttcacatggcgtaggtttcatcaaactcgtgaggggggagtaatcattccacagcccacatgagtgggctcacacagtggtggaatccctctttgttattgtttgacgccataggtttcacgtaaggagaaatatgagtcaatgacaatttttacttttttttcaatggatcctggagtttaaaaaactgcaagaaggcactggaattaaatgattaagtttgggtccaggcacagtggctcatgcctgtgatccaagcactttgggaggctgagctggaggctaccagtgtgtaatcaatccacattatatttaaggaagtgtgtttattatgtcttggccttcagaagtattgctccacttgagcccaggagtttgagaccagcctgggcaacacggcaaaaccccatctctacaaaaaatagaaaaattagccaagtgcagtggtatgcacctgtagtcccagctgccattgcactccagcctgggcaacagagtaagaccatatttgaaaacaaacaaacaaacaaaaaaagatactctgcatagaaattaatcacaatttctttaaatatgcaggtttttaaaattttttgattaaaattttccaaaggaaatagctccaacttttaaatatttgaaggggaaaacattttattttatttattttatagacaggctctcactctgtgccctaggctggagtgcagtggcatgatcatacagcatggtaatctgaaattcctgggctcaagccatcctcctgcctcagcttcctgagtagctatgactacaggtgcacactaccacacccaggtaattaaaaaaaaaaattatctggagacggtttttgctatgttgcccagctggtctggaactctgggccttaagcaatcctcccgcctccacttcccaaaatgctgggattacaagagtgagccatcacatcagccacattttcatttagacaatttaatttggaacaattggagcaatgcttctgaaggccaacacataataaacactcttccttaaatataatgtggattgatgatacactggtaggtatttatattttgaagtgccatgatgagttccgaatgtttagataagaaataaaaagggaggactagaggaagtgtaccctccagagaagccaaatttagtctgggaaatagaaatagggtcaatgtcaacagcagcaagatgacgacagaccaatggctgtttacaccagagtctttccaggttttctgacaagttttgtgttacttcatatcttccttatttaatcctggccattaactacaatacagtactaacattttaactcagctatacaaacccaaaacttcaataagtttatcagagacaatactgatatgttaaaaaaattactcacaaaacacatgcatacagaatatagtaatatcacatattttgcaactgtgtccacaattaagacctcctgtactaagtagaatgtcactgcatatagggtattgaaatacagaagccatttcttgtgtagcacccaaggaaagtctttcacattcaaactgccttttacattaatggaagtgccaaaatgatttgcatttgtatattcgcaaatcatattgttttaatatttcaaagaacggatcacactcaccccttatcctatttgattctattaggtcttcaaaaaggaactttgggtggacacaacatacagaaatcctattaagcatatgatttcatgaaggtatgcatgtagagtgtttagaatatgacacatatttaaatgctccattaaaaaactattaatgttaggattagaatataaatctacagtaaaatggtattgatgacagaaacattttaatcttttgtcagtcaattattgatatttcaaagtattttataaattttggtacaacacatacacccaccacaataatgtgaatcctttcaaattcttgttttgcacatatagtacagtataaacttgataaatgttttttaaaattaatatagaaatggatgaatgagattcaattagcccaatgtcagatacagttgttgaaatacattaagtattcaacaagtggatacaaaaatatgtttgaactgccaattatagcaaggtctctgtgtcaaattaaaactaaaactaagatacttcgtatcttgttaaagactggcttaatttttgtcacatggtatacttccaagtgcttttacctgaagaagactaagcatttctccagcatgcctgtccataactagtatttatcctctatgcaatttgttaacatggtacctaagagttgacaaagaaaagcagatacctctttagctagataattcattaatccatgttattttatcattttgtggcccactgtagtgactctcacttatccatttatttgttcaataaatatttcctaagttcctattatgcactgtacaaggtggatactccacagtatgcttaacaggtatggcccctcctttctccaagcttagtttagaaaggcaaataatcaggaatgaaggtgtttatatggggctgaaagattagggaggagtaaaagggaaaaggagcaacacttcttgcacatcttctatgtgacaagcacaattccaggtactcccccatagttcctcttttcagggaattgttgctgacatgtgatgtctcccccaggcacccagctttaaaatttctctcttttgtactctgtccctttatttctcagaccagctgacacttagggaaaatagaaaagaacctacgtgaaatatcgggggtgaatttcgactgatagggaatgacctctccagccacccagtaactcaggtcaaacattttggagccatctctgactcttttcttccatttccactctatggtaaaaccatcattaaatcctgccagctttgcattcaaagtatgtgctaacattaaccagttttcccatttcctccactaccaccctagtccatcatcacatctggtcatacaaaggttactctactgcctctcttgtgcatctgtaagctattctctctatgacgaatgaaacagaatcatattcctatttttcagatacttttcaaatacaaatgattttctgttgaatttagaataaaataggaagttcatgttgtggtctgtcaagttctataaaatctggccttcaattaccgtgcccatctatctctcaatctctgctttgctcagtgtgttcaactactccaggctcccactggggttttcaagcacacctccacttcaggcctgtttcactcacatggagtattctcgctcagagctgcatgtttctttgttgtgtttgctcaaatgtcagcttctcagaagactgaatgtgttcaccctcgctgaaatagtaaccgcccttatccattctctatgtccttatcctgcttaaattttctttatagagcttgccattttctgaacatcaattacattatacataacactcctattgatttctttattatctgccttcccacctgaatatatccatacaaacagggcttccactatacaaggctctatcctcagcacctataacagtactaaccatgtagcaaaatccaagaacacattttttgaaataatggattatttcatttgattcttatatgaaattgctaatattattactattaccaaaaaaaacaggtaaaaaataatgaaacaatttttggaaagagataaaataatttaggaaacagggctcatgattgaggattagatgactagcagaggatttaaaaagtgaagaagtagaaataacagagacagatgttttgattttttttaatttctcaatttctttaattttaatattacaaatgaaatattttggggaacaatataccttaattccgtaaattaatattttaaaattaataatctgctttgttaatttccaataaaaattaaaacctatacatgaagatcatttacaaaagatgagaaatgacacagaaaatatagagtgaacactacttaactactcctccacttttctgtttccatgtcagacacatgcctggtttctgacccttgtcagaccaggaacaaattataatttgaaagtagggcataaagcgctggagttgagacttgtaaggatgtaagagcttacaacaaaagaacataggaaagtgtggtgaaggctaaagagaattagaatgcctttccccatttggtgaatgaatagatttttgtgttttgttttagcatatcttcaggcctgaatggaatgctttgtgtagtaaacacagtaaagctcaaatcgagtttactgcctccatatggttccaaccacatacgtacaatggtagattcatggggttggggggggggggcgtttgtcaggggaggacaagtcattttcctagaaaaggcaattgtgtttctagaattttattaagcaagagttcaaaagcaagccagagcaaaaaatcgtactcagaacatcagtttgttggtgcctttccaaaacagcaatttgataaaagtgcatctgcaagtcttttatctgcaaagttaatttcattattgcactatactgtacttaaaaaaaagatccacacatttattaaaattgtaataaatgaatcacttaggctttgatctcctacaccagttttactgagctcccctaaagggagatcaattaagcatacatttttccaccttttaaaataatactctcagacagagcatttgaatttcattttattaaaatgtaggcacagtaaacattataaaaaataaaattcccacaattcacgctattttaaaaaatatcagcaactgtctcatttcattcttgataggaaaaataaaattttagtttgatgatggggttcaggatataatatccccaaatataacagtttggcatgctgaaaactgcagaagcaggaaggtcactctcatcctcttctgcctttcactcctgaagcacatcacaaaacataggaaagattttctgaccttctcctgaagcaggtcataagatattcaggtgaaagataccctccctatattgggaggaaaggaacatccttgtctctgaagaagggtcacacagaagaatctaaacaaacaccctgataagtttccctaatttattacaattaaatcataccaaatttgtccattcatacttttgtacaactgtccactcttcatcaaacctagcacaaaatacacaggtttaactattttttcaggtcttcacttccttacaaaggcctccatgtcaagtaaaacgtatatgaaataccttgtatgcttttctcttgtttattagctattttgttataggaacttcaaccatgaacccagaatgggtgagggaaaggtatttttcccctcctataaagatatttcctaagtgttctctgacacaatacactaaaaactactttatgacacaaccagaagcactaataaaatgttgtgtttctaggaaagtgctctcttcatcaaatgacatgctttcgtagaaaacagaatcttattcaatattgtgagagttttgatttatttgctatagtgtaccattgcttctgtgttccaaaacacaaaacgattcatataataatgaatttgttaaaatgactttccgtaagaaacacacatttattttccagtgcatataaagagcttagttatgagtctgaaagtatcctctatgtacctaggaaggaagttcccccatcaggacaggcaagggaaaaaattctctgtaaatataaccgaatgaaaacaaaaggagacacatcatcagaaatattacatcatacatgcaagatgacaaaatacaatttttgaagtgttattttctttgctacttaaaaatggaatgacggaaattatatggtggctgtgttcttgtcctggctatgaaactaatagggtgactttttcaaactgttttctttctctgttcatctctaataagaagtggctgcagtagatactctttaagatttcttctaactctaaaattctatggattaagtaatttaaacattttcaaaggtattttcatttcttcatatattcttcctgagcttatgacaaattaattctatgttcaagcatttatggacagactcttccaactgaaagaactggtgaatttaatgatcttgaaaaaggaggagaaataggaggaaacacttaacttattactatccaagaatatcctaaaattctactcatttgagcatcttctatgcagccctcataaggtaacaaaaacaaataagcatagaaagtcttggaggaactactgattcctaaataataatgatttatcaaagtaaaattattgttatcaaccagtggaccagttaggggcaccaataaagtaatgagagatttctaactgaaatacattcacttatttaccctgtagcataataaaaacgaacgtaaggaatatacaacattgagagcattgtttcaggtcattttcacatacgattctaattactaaatattccaggatgagaagaaatgactagagataaattatggtgcctattaaaccttttattgaaacctcctttccaaaaattaatatcacatttaatcatcaaaatatcctatctaaaaatttgatttatttagttgtagtctacttccacatggaatttggagtaactgtgtaagacatgaaagaaattctaattgaaaaaaggcagactgggcaaaagataatcagataaactagatgcactacatgtatgtagcttatttgcctctgactcctggtacatatgacaatatatcctgcttgtacacacaatagtaacatatttctgccacaaggaaggacaaagaaggaagcaaaggagagggggaggaaggaaaagttgactaattgcattttaaactgttaccaaacaagaagtgagttacagaaatgaatcaccactactctgaagtttcagcttgtgaataaagttgccctggctgatactgattattttctacttaccattttaactgtcatctttttagcacattaaggctctcttttcatagacctgcagaaaaccggttttactaatccctttcctcccagaatgccttcgctctttatcctggatgtaccctcacttcctgttttttgttattgttgttgttgtttgcttgtgtggtggtgggggaaaaaaaaaaaaacttagaagacattgaaccatatatccaggtttccggaggtgaactaacaaccccaagtttggggtctagccaaccctttcacagatgctggacagatactaagcaaactactgctcacacacctgccatgaataaaattttaaattcatgacaaagggcaacctgaataaacagattctgggtgagaaaataaagaaaatgtgcagagcctaaaacagttatagcagccaatacataaagtatttgctttcagtaagtgccatttctgtttttggttacttctcattcccttatttctcccttttgacaatattttgtttggataagtcatcagcctagctgaaattttattacacagaaaaaaatgaataattaaaaagttatgaccatttcagaaaactaggctttatggaagtaactttaaagtacgtggttttataaataagcatttgtaggaggctgagacaggagaatcgcttgaacctgggaggcagaggatgcagtgagccgagatcatgtcactacagtcctgcctggacgacacaccaagactccgtctcaaaaataaataaataaacaaataaacaaacatttgctcaaaagggactcgggggtatgattctggtattttccctctcacctataaatgttatgcaaatgtattatttttcaaggaggggaatgcccagtactgggagaccacttctccatctagaggagaattttcttgtgccaaggttactgctaagtttgaaatagaaagaaaagtgtgcttagtaagcactgaaatagatcaaaggaatgaaaaaagtcctaagaaatattaattttagactatagtaaaacttaatgaatgaaccttaccgcataagatggaacatactggatagtcactataatatgcatgcctatatctacatacatatctactacatatagatacacacctgtatctagctattttttaaaatagtcacatttttcttgtgatttctttgtttctgcaactcttgatttcctctgattactcttttaactggatctataacctacatctttctctggatattcctctggtaactctccctcttttattcctcatcttctttattccaagttgacaattagtttacctttaccctgattactcagttataatgcctattcttacttcccaagaaaaaaatctacacatttttaaactcatttttgaattgacatataataattgcaaatacttatgagatatatactgatatttctatatgttttatgtacaatgatgagctcaatgtgatcagcatatccatcagttcaaaccttatcatttctttgtgctgggaacattcagtattacacacagaaaagctatccttcaaaaatgaaaaagaaataaaatatttaacagataagcaagaaataaggggattcatcaccatgagaatggccttgcaagaaatgtttaagaaagtctcacatatggaagtgaaaagacaataattaccaacatgaaaacatgcaagactataaaactcactggtagtgtcaatacacaaaggagaaagaaaaaggaataaaatcttatcactatagagaatcacccaattgcaaaaataaaccataagagaggaagtaaagaacaaaggaaatacaaaataaccataaaacaatcagtaaaattacaggaataaatctccacctatcagtagtaaccttcaatctaaatggatttaattcccccttgaaaagatacagactggctgagtggattaaaacaaaaatgacccaaatatatgttgcctacaagaaacccatcttatctgcaaatacacacatagactgaaagtgaagagaagacaaaagatatttcaggcaaataaaaaccaaaagcaagcaggggcagtcatacttacatcagacaaaacagactttaggtcaaaagctgtaaaaagagacaaatctacattttttcttggatttctcggtatgatagaagctagcaatcttcaaaacgtgtataaatctattgccagtcattgacatttcttataagaacctgtgtagttgtctcacgtgggtccgcagctatttatttccaatttcctttccatttaagacctacctatgcagccataaaaaatgatgagttcatgtcctttgtagggacatggatgaagctggaaaccatcattctcagtaaactatcgcaaggacaaaaaaccaaacacagcatgttctcactcataggtgggaattgaacaatgagaacacatggacacaggaaggggaacatcacataccggggactgttgtggggtgggggaaggggggagggatagcattaggatatatacctaatgctaaatgacaagttaatgggtgcagcacaccaacgtggcacatgtatgtatatgtaacaaacctgcacgttgtgcacatgtaccctaaaacttaaagtataataataaaatttaaaaaaaaagacctaccatttgagcaactatagtcttataataaccttctgttactctctatttttctaagtacaccacatactcaaaaggtaagctccttgccccttaatatagttacaaggtttacaaagcttagtttccagcctgtttaaccacttttcaacatcttgcctctgtgcactacaaattctaagttatttgtagttcttcaaatgagtaagtgtctttttgcttgctctaccctcttctccctatgttcccttagctctaattcctattcatattcaagtttcgccttagctgtcttatcctctaggaagcctcctctacctcccaaatctgagttgcttgtgccctatcattactgttcatcactctgtatcgtggctgaccttctaaatgtctatattcacctataatctatgaacaccaatagagcagtgacctgcctatctgatgacaaacataaccccagtgcctaagctcaatgactttacgtattacttaaaagtcataaatgttaaacatttttctctagtgcataaattacaacattagatactataatgagctataactcttcgtctctttttatttcaaaattctattttgtaacaaattactttgtttccatatgcaattggacatgtttttcagataattatcagaagattaatgagcattttctgaaccatttctgaaatacagaaagggtattcaaaaaaaattattgtccaaagaaaaattgatacaatacttatttggaagtcctgaaatctaagagggttaaaaatatgtgtgcctatgacaatttctgaattatttacaaaattttggtgatacaatatagaaactatttacatactttccttatgagttacttatgaaaacaatgttaacataagttactcgaagtgttaggggtttaggaaaattgtgcataataagcacataaccattatacacatcaaaacgtacttttaccttttgtgtgtgtgtgttttatatattatttttctatttttaaatgaagcagatttgagaaattattgattggatagtttttgataaaggataaaagagttagacaggttaaatacacatttttatgggatgcacttttacatgaatgtttctttcttaaactgagtaaatcctgagataaaatattatcaccaaagatatttagctaaattgtggacaaatacatagagtaacagtctgtagacaacagcaaataattatctggaatattcccttcatttcaaaagttttcatcttaggtatattgtttgaatattttattatcaaaaagccaaaatatgatgaaaaagtcataaagtgataaaatcctaagaaaggaaataacagtggaaagaaaaattaatcttgcacagaatagaaggaaaataaataaacgagaagcacacaaataatcaaataaagaaaataatagtagaaaacaataaacctgttttgtatgctgagatttgcctacagtcttcctataaaattctggaaactatatctagaggttgctctttgattgttgctggcaatgtatcatttggttgggaaatacattcacacataaataaaagagatcagttataaagaaaaatacaaatgtcaaatcaattaaacccaagcagtgctccaaatcaaacaaagaagagagtcagagagtagctcaaatgctattatactatctaaaaagaaggggtttacttttgatcctttgtgtatatgactccatagaacctgcctgagctattctgaagctgtgagtggcgatggtgaaggcagatgagaaagcatgacgtgtagagacaaataaagcttgggttcaaattttctccttgctatttagatttttccaggaatttgttttcctaaatacaaaatgaaaataattaaatttggtttgtgtttttgagaattaagtgagataataatcacaaagttgatcactgcagggtatggcatacaatcattacacatcaattcctttcctctcttgcccattactatctatacagggcatcttgaaaacgtatttattaattgtatttcttataatacatcattttaattgtgtataaaatatactcaaagatactaaaagcatcaatataataatttcctaacataacattttagctctttgtaaatatatataaatataaatttataatttacaaattaatagccacaaatgttttcttggaatgtttttataaaacttgtagtcatatacttctattttttatagactgcttttaatttcgtgataatattaaggttatttggtaggacaaatcacatttttttttagttttaggcaattttttcttaaactggaaaaatctgagacatacagtaaatgaaacaaaaatctgagctgtagagtcaatgaaaacaaagtataactaatttgtggaaaggcaaaaattagaacccagcaatgtactattctactaaatatctttagtttccacataaatcatgagttggcatataacatggatagtctgaataaactcttgttacttaactccaatattgccctaatttcaaggagctgatccagaagaggaagatctgagttgggacttcagaccaatggcaagattcaagcctttcatctccatgctttctgcatttctctatagatattcagttgtgaaacacctggagtttatgtgtagttggctcacaccagctgcatttttgaagaaggggtaaaataagcattttgggttagatatgaaaaattttatgcaacaaatgcatatttggaaactgcaaaatgagcatgcaaatcaatttatatgcatcgatgaatgaatatagacgggctattttcaaagtataggcattctagtgtagcataatatatcgggacaaaaggaatgggaaggaggcaaattgctcagcttagtcatccatttgcaatggaaaattgcattgtcaagttccattatgcctgcacaaatttagacaaattaaagagtctactaagtaattattgataacatacatgtgtatgaagtagagcaggaaagttgtgagtcatttggaacttctcagatgtttctaggattttcattagcgaaaggaggcattgaaagaatgataatataccttactatgaaaccaatttgagacacaacactggcctattcagccatatctcttctatggtgacagagatggataacaaccggaaaaagtgtaaataaaacattaacacaaatcactctgctgaggagaaacgttacatctggttctggaccctgcatcttgttaggatcccttcattcattacttcattaccaggagaattattcaatctgacacacgagaccaagttaaaaaaaaaatccttagaattatacaaactttaaatcctatatttctctcttttacagtgtgtgttcagaatatattctgcaaggttactgtggtattctcttctgacaatataaacattctactacgtttaagacagaatgttcaaccaaggataacataaatccctggaaagtcatataatgggtctcatcttctgaaatggactattggtttgacatttcaaacatctcatagataatccctcaagatggagagtcaccaacttcctttgataatctgctcttgcacttataaatatttatccttcaacaatttaaatatgttttttctttaccctcttcactgaaaacagcaaaacacctggtctttacaggttatgtgcctttttatacataaataagtatataaattctattttgcatatatgtgtatgtatttgacatttatttatactcgctaaacgtatttttaacaaacttccataccagttcacaaaacacacctcattcatgttatattgtgagtcattatacacagctctaccataatttatttaatcaaatccatgttaataaacatttggatttgactccatttacttgttttcactattacagacaacatgcaatgagtaccagtgctaatatatttgtgaggcttgttcaggtatttctgtttaaaaccaaagttcctagagatgaaactgttaaaggaaatacacatttacattttcatagttactgttaaactgcctctcaaaagaactataataatacacactccatccaaagatgcacaagagcataagagtgtctacgttgccacacctttcggccaaaactgggtatgatggtcttttctgtgctttttttttttttggtcttgctttgccacccaggctagaggacagtggcacaatcacagttcactgcaacctctaactcccagcctcaagcaatctacctcagcctcaaaaatagcaggaactacaggtgtatgccacaacatctggctaatttttaaaaatgtttttgtatcgcgctttttgcctgggctggtctcaaactcctggcctcaaacaattctctcacttcagcctcccaaagtgctgagattacaggaatgagccaccctgcccagcctgatggcgctttttaatattttcaacaagctaaacaataaatcatatacttcattttaattcacgtctttacttattattgaggtcaagcttctttttatacatttactagctatttgatattctcttttaagaaattgcctacttgttttgtttgaccattaccgacaatattctcttcttaatatcttgcagtgagacccactaacgtttattgaactcctacagtgggccagactctggtagctcttacgtatataaaaggtgtaagtgctcccctggggacttagaatcaagtgaagaaatcagatgggatgataaattactataataaaatgtgttcagcataagaataagggtctacacaaagccagcattgtccctgctggagaaccaggggtgagcaggaagagggtatcagggatgatttcacagagaaggagaccttacagatgggttttaaatgatgggtgaaatttcactcagtagagattcaatggaaggcactaggtccagagagagtaacactagaaagaaccccaagacatgtgaacacaattattattcagaatataaataatgactggcttagatcacaaagtttctgttgaaagaaaatggtaagaaatgagtctggataaggagaccaatttatatacaagtgcttgcctgccattcttgagaatctgtattttatctttcagccaaaggagcagtactatttataaaggatcactccagtagtagagacaaatggctttgaaaggggacaaaaggagcaatgcctgagattgggaaagtggtaagtagactatagcagcaatcctgatgagggagtatgagagcctaaaatagcataatatcaatagaatcaagagaacttggtcacagaaagcatgtgattaatcctttcatctttctacaactagtcacactggatattcatctctgtggcagcatttattgcattgtaatgaaatcatgcatgttgtctaccagcccaccccactaaaatgtgacgctttccaactcttagacctgtagttgaccaaaacgttgtttcaccaaaaaataaactttcaggtttcctcactttccttgtgttcacattttatgctgcaacaaactcagtatttattaatctaaagtctttttttaaaaaaacttagcctctataacattctaatgccttagtgcaaactgttttattttgatatggaagaatccagtgattacagtaatttgaaatgatggtgacttaattaagagtgtgaagcaatccattaactataatttgtaaaaggagccatatgtttttcactcttttaggtataccattggacttgcattttcaaaaagtaaacctgctaatttttgcttcaactgaggatatcattaacaatatcaccagtagcacacatgtgtaccttattacagatcttcatatactataattaatagtgagttttattcgtatttggatgcctgaattgtttagacttgtatttaggtttcaagccctttatttgtgctgtcaaacgtttagtcctcaagggcttgagagcacagaggtgaacactgcctaagacctaacatctcacctcctcctgtgtgatggcttcttaatatgtggttcaggaattatgaatggagaaaaacaacagaggggtcaaagatgaggctagatttctggtttgtgtaactggctttcctgggaaaccaaaaacatgacagaatacccagaaatgcatgtttttcattttgtgagtactataattttttttctctggtttttgttttctttgttttgtttttaacccaaaactatttttctgccctctaatctcatcctcctccaggaacaattcataccagtactaccaaagaccctttcacccaaagctgtatttcacagaggaagaacaattacataggatataaacggactgagatgtaagagacaccactcgaatattctgtggttatgcagcagggcaagaacatcacacctggtggaggtagagtcagtactgggaggataccctggagatggcaaagcaaacaagaggaagtgcaaggtgagtctgcaatacaggcagcggctgtaactcgagctcaaccagctcaacaacgtttaaggaaacatgaaactggggcaatccactgtgtaaagaggacaagggcagctggctcagggcaaacataagcatgtgggtggagagcctgcccagagtgtattccagggacaccaatgtgcaacaacagcaagtcaagtcactgggggaagtaattcatgggccaagtgttctgtaacagttggtgacatattttatgcaaatgtatctgtgaattataacttcagacactcttgaaatagagttgttttttttttttggcagaaattaggttttgtagggggaggggagagtatttgttttgggctttttccaactcaggacttgggagatttgcacgttaaaaggctttcagaaaagtccaattatttacataactacagaactgaaaatatatttcaaatgttacttagtccaggctgctgaccagaaaaagaggaaccttaagcaatttaaaactagcagttgtctatttaagctactaaggatctctagtgatacagattcacccaccacttctgctgacctgttctcacatttatactagaattacaagtgaatgctgttttctctttccttcggcctaaaccagcacaattttgttcaaatccatttccattgtttagtcctctgtggaccagactaccactgccagttttccttagtccaaattcttttttctgtttgtcagctcatatttttctgtcctacttttcctgcttacaaatgcaatgctatcaagatttttccctttatacaattctggactgcctgatctacagacactagtgagagacattttttaagccactagataacaaaaacctatcaagaattttatgaagttcttgtccatgcaatttccaaggcatgatgggaaattagcaagtcagacaaaggcaacagggaaggtgagggggtcactgaaagtgcagtgatgctgctgctgggatgaacagaccaggatgactgtaacacatttttggaactagcctttggaagagcattagccagctgaagtgatagtgggtaaaataaacagagcgggggctattagaggaaggaggctgaatgtcagaccagttgcaaagaacgaggattggaacatttttagctcagtgaagacagcactctttctcttaggcagataaagataattgaagaggatgctaaccatatggattttatttccactgaagacataaaaaaattaatttatgtcagcagagaaaggatattcattaaacttaagggagaaattttctgctcaggaaaagttattaaacagttaaatggaattttgaaaaagagaaaaaatatgacattgcattagcttatacagacttctttgaaacacaggagagattatcctatgtgaaagggtgtggaggatatacagttagttattattttataaataaaaaagaaggaattacaagtgaagagtctggcctcaggatttacgcagctatgattcaaatgtcaggtttgtgaatttctagtgcgtgaattggggaaaattttaaaaatctttctgggccttaattttctcacctatcaaatgagaaaaaagtcacctactttttagggttgtagagtagaccaaatgaattaatagcacaaagagctgaaaatagtgcctgacacactgtgagagccatttaagattttgctattgttgttgatgttgtcagttggcaggaaaaattccaatgatacactgccagaaatgacagctagagacaaagaatgattatattttctgtaggttaaatgtagacaattacgtatttattcttgtcttttccttcctatttccctttttggcttaagcccagagccagaagtcaagcaatgtatgttcctgtcctgtcttctactaaccagatgtgtgattttttaaattttaaaccaacagttctcaatgtcctcattgtttcaaattctgttaactcttctctgtgtctgtctgtctctctctctcaatttactttaatcacaaatactctttttctctcccatcatcttttctcctatctcctgttcctctcttctggtcttctgtctcattttctaaattatcaaacagctcaagcttcccagcttccctgaggcttgagcatctttccatcctccacctcctatgggcagaagacactcagaattgtgtatttggctccagttcaaattgttattgtctctgtttaggatacaaataaggattttgtccaggatggataatgtcttgggtcgaggagaaggaaggtgcccatcattcttctttattgccaagaacctctgggaacatgaacagctcccagctaacagcaggagaggagcaccattcccagaagatttattctaactcctgaagctctacctatgtctgtacttttatgaaggaaatcaatatatagagtcatagaataacaatggataaacttcaagtgaaaaaaaaatatttaaatatcatttgaagtcaaaaaatacattgtgatagaagaaagacatattttaatccaaccatttttaacttaaataaagggtgaacaggacagaggaaaagaaaatgaatgtctaatatattataaaatatatgtaatgatattaactgaaaaatggagcacgtttttaaacttacaagttaccatttgaaaaaaactactttaaatttcatatggaaccaaaacagagcccgtacagccaagaaaatcccaagcaaaaagaacaaagctggaggcatcaagctacctgacttcaaactatactacaaagctacagtaaacaaaacagcatggtactggtaccaaaacagatatatagaccaatggaacagaacagagacctcagaaataatgccacacatctacaaccatctgatctttgacaaacctgacaaaaacaagcaatggggaaaggattccctatttaataaaccataaagatccttgaagaaaacctagacaatatcattcaggacacagacatgggcaaagatttcatgactaaaacaccaaaagcaatggcaacaaaagccaaaattgacatatggggtctaattaaactaaagaggttctgcacagcaaaacaaactaccatcagagtgacaggcaacctgcagaatgggagaaaatttttgaaatctatccatctgacaaagggctaatatccagaatctataaggaacttaaacaaacttacaagaacaaaacaaccccatcaagaagtgagtgaaggatatgaacagacacttttcaaaagaagacatatatgtagccaacaaatatgtgaaaaatagctcatcatcactggtcattagagaaatgcaaatcaaaaccacaatgagataccatgtcatagcagttagaatgacgatcattaaaaagtcaggaaacaacagatgctggagaggatgtggagaaaaagaaacgcttttacacctttggtgggagtttaaattagttcagccattgtagaagacagtgtggtgatttctcaaggatctagaaacagaggtaccatttgacccagcaatctcattactgggtatatacccaaaggattataaatcattctactataaagacacatgcacatatatgtttattgcagcactatgcacaattgcaaagacttgaaaccaacccaaatgcccatcaatgatagactggataaagaaaatgtggcacatatataccatggaatactatgcagtcataaaaaaggatgagttcatgtcctttgcagggacatggatgaagctggaaaccattgttctcagcaaaataacacaggaacagaaaaccaagccctgcatgatctcactaataattgggagttaaataataagaacacatggacacagggaggggaacagcacacactggggcctgtcagggggtgggggtctaggggagggatatcattaggagaaatacctaatatagatgacggattgataggtgcagcaaaccaccatggcacgtgtatacctatataacaaacctacgtgctctgcccgtgtatcccggaacttaaagtataatttaaaaaaataaataaatatcaaaagcaaatatgtgtataggttccctaacttttctgataaaagaggtttctgggattctttttttttttttcttttaagagatagggtcttgctcggttgctcaggctggagtgcagtggcacaataatagcccactgcctcctagaactcctgggatcaagcaatcttcacacctcagcctcctgactagctgggactacaatacacgtatggccaccacatctggcttttttttttttttttttttttttttttttttttttagaaatgaggtctcgcttttttgtcccgcctggtctggtactcttggactcaagtgactctatttgtactcccaaagcactgggattaccttatttcctagaaagttggcagaactttttaaatagacattcataaatgtatactcttacacatttcactgtgcttttgagtagtgaaatacaatatgtaacttcctatatttagaatgttttcaattcagtaaattaaacatttaacatttgtagcatcacgtataattttaaataaataattacattatttgctggaaaataaatcaatttttcaccaaagttaaagagcttaagctgtatagtggtttcttccatacaacaactatagtcatatgctgccatgccagctatttccctaaggagagcccaggcatgcttaattatagaggaacaccattacttagaagaaaaaacatgagtctttaatttccttgtctccgctggacggggctgtggattctgctgaatctagcaatgtctgagtaacacttaagcctagctgtttccatatacgggccaggtgttgcgaggtcccaaacaacagtacctcctaagctctcatcagttgtgtttccatcatggattagaacccacacagaattcattatgtctataattaaatgaagaaagcccttctgatgtcaggatattagtgaagcaactgttcgtcttggcagctccgcttttaacttttggattgccagatccctcctgggaaccaacctaagaaagcactatttgatgtagcagttgttcctgcagtgtggtgtcagtgcatttctaattacagtccagacagttttgagcgtgagtaactagacaagaggccaggtcagcactttggcttgccaggtcagacttattttcctcccacttctttccaataatagtttctcatatatacctgaaatagtacagggcattcatctttccaactctaagaaccactcctaagttcaatttcaagctatgtgttgggaagccaaacacgcttagccaaaaagaggcactatcttctcattacgacatttcaattaagtgcccactgtaccatcatctagattttcagcagaaccatactctaactcagcaactctcattatttatgtgactgagctagttctttatatttgtgctgactcaccacagaggttgatattttcaataattttatcatccaaactctgaaagagatgaaaactttgtgttgcttgttttccaaaataataagtttttcatcaaaaggacaaaaatttgttgtaatattatttagttgcaatattttggggctttactgctggttatgatagagtagaatcaacccatcaagtagaatatgaaaagaaggttaacaaaggaagcaaataaacaagcgttatgaaaacaaagagtgatgaattctgacaagctattccattttctttattatcatgacagtaggaagcagcactaaatgtaagagtctgccacaaccctcaaatctgaatgctttattataagtcagccatttaaaatagtaccaacctgaaaactagtgaacaaacagcccagcatccctttgataagcgaaatatacaagttgtgtcatacaatggacagggctgcctgctaaggtattgggcatacttggacccaaatcccagctctgccatttacgagctactgaacttttagcaagtgatctcttctaactcacagttttctcactgataaaatcgatattttataaaattatcaagtaggactatggtaagactatataagataaggtagacaaagtacactgcataatgcctttcactcgaaaaacactaaatagtaattttaataaaaactactgtgatttttaacagaatgattttaaattattctcaacttcaagaggtgcttatgaccttacctttaaggagaggcatctagtccattttctgaaataacttaatgtataatattttgggggaaaatcatgtatatttgcagatttagaaaatactatgagagttatggttgaactacctggtaatgccttttccaatatccaattactcattcaagtatttactgaactcttacaaaatactcatcattcaattacttaacaattccagcagttgagttgttctaattggaaaacttacattgcctgattgtgttggtaggatttgtgctccgtggatgcaagtgtaaaataagaacctatgttttatttctaaacattataaagaacataaaagtggaaaatgattcaaattcaaacactgtatacagtgtttaaaacagagtactttctctgcttacttttaaaattattcataaataggtctgctctctggaatactccttggatatatgttacaaatatttgacttttatactcaacatttttcaatatagatttccattaaggattactttgtaactaagcttttttgtatattcagtgcattggtattcactgaacagcatttctgttttaatttgaaaggtttttttttttaagttgagggagagtttacatacagtaaagcatatacattttacgtatatagttcagtgaatctttacaaatgtaaccaccacccatatcatgcccaatgctccattgttttgtcctcttctagtcaagaccactaaaaggtacctttatcccaacctctatcatcatagattagttgtatctgttttaaacttcatataaacagaattatatcgtatgcactcatataattgctgccttaaagcacttattttatttgtttaaattttacccaagcggaataagggaaacaatgtcctctttacttagcttgtcataaaatccatattttaaagcataataataagagaactctaccaaatctgatgcatacttctgggcataaatgatctaaaatacatttaaaatgaccccaaagtagatgtaaagaaatatgattcacatttttataatactattagcattcacaacgtcctacagcaatctacctgctaccatttaatatctcccacaaatttttaagctttgaaagagtgtgtatctattatctactcgcaaacaatctgtgaagtaggctggcattagttcacaatatattagtagtctgattaggtggtttcccaattcgcaaccttagaaaatgaaacagaacattgatggtgttattttacttttaacatatattaagatgtaaagtcccacctggaatttagttcttcagattccaaaccatgttctgtttacacacaaaatacaaataatcatgtggcaagaaaggaatctgagagagcatggtactcattccagtattcaagtagaactacatggaatccatgctcaggagaaaaaacaaaaagccttgcaattttctgaacagctctaaagcaactggccaaaattttgttttccaaagctaattagaacattttaagatttacgtattcagcaaaggccgtgtaaatttacctattcctatacttatgaataatgaataaaagaaaaggaactgggccacaaaattatagagaagtacacaacaaaaaaagtataagatttttgcatactgttttttaataaaccaaaaaactttaaaaaatataaaaataatttattctgaattacatcaaatagcttatatactttttgagagcacagtttgcacagcaacttctaataggtttattaaccctgtaataaaatgaaacctgaatatctattgtaaggcctaattttcagtacatatttataggagttaattctgcaaccagtgtagctgaggaaggagtatagaatgtggtcaacgactattttcaggtactaatgtgtctcagagccctggttttcataatgtagctaagaatgacagaaatattatacagtgccagttctttctatagtcaatcaggataactatacttttagtaatcaatttaattcacatttaatgatatccaaaactgaacatatcagtgacatgtatacatatatatatatatacacaattttatgctgaaaaatataacctacttatgataactaaaataacagcttgcttgaacttttaaagccaaatatattacctatcttatctgcagcatatgtgtaaataactttaatgtataagagagtctcaaagacaagttataaattcaataaatcttttttatactaaaactattaaaacttttcctatttgatagacaatgtactataaacttcaaagtaaatggtatcttcaataagctattaatatagtaaaaatcactgcttaaatataaaattgggatggaatacaggtattagtttatgtggaaagtgaaagcatagtttctacatatacttttgtgttaagtgcttgctaaatcacaaaattctcagaatgtgattttttaacatattttgagtaacagctagacatgggtaacattagaacacagctgcatgcaacagaaacagaggctcgttgtctttataaactgaaactttaggcaggtaatggatcattattatactaaaattccttttagacaagaagaagttctatacatttaaattttgcttgaaagtacccctaaagaaaatagtgtcggtggaaatagtcagtgaggtaatagtaacaaaagtaacacgtggacacttacaaaatgcttactatgtgccaggcactaatctaagagattcacatgaagtcacctgcttcattttcttaagagcactaagaagtaagcagtattctcatcccaatttcacagataacacaattgaggaatagaaagtttgagtttgccacttgaaaccaggcagtctggcccaagagtctgtataatttaacctctgcactacaactgcatctcagaataggaaaacaaaatctcaaaataatatatttgactttatttgtggcattttggaatagtaactcagtttttattattacctcatagtcaaaataaactttttaataaacagatgcctttcactgtcatactttaagagtttcccagaatgcttcctctagatcaaaactattgatgagtttctgtgactcagagccttctcaatacaggtgatccaccttttcctacaatggcagacttcaaacaaaactctggcaaaatctctgaatcatttttaaccactatctacttatataataactacttaaatgaaaacaatcttacaaagattacaagcacctacaaaatattttcctttattgtagtagttacaatgttgattcaaacaacaaatatattttgtcactagaacatgtacttgggggtatactataaagtatggcactgtacttggggtatgctataaagtgtggcactgccactgggttccaaagacccataaattcaatgggtgtatctgcaggaaaccacagtacaatccacataaagggttcaggtaatgcttttcataggtagaaccaaagtgttctgaacaatcaatggccttacatttcaacacctaaccaaacccatgatgactttaacttccttcaagaaagaattgtatttttcccctagtttaatctacagcttactgtgggtgcttaacaaatgatgttgactgacaaacagaaaatgtttcctctttctccctggccccctttcaatctgttctctacactgtagctagagtgacattttggaaatataaatgtgataatgccatcttcctccctaccatccacactacactctttgcattactattttatcacttttacagtaaagacaaaaatacttgacatggtccagaaggttgtgcactgcctgaccccactcctctcaagtagggagttagagctccatgcttaaggcattctctcagtggcacatgctgtgccatctcctgcatcagaattctgttcctctgggctttacctgattaatacttttcctctgccttaatttggttaattctttctcactttttcagatttcagtttaataatcactttttattacgtcagctgacactattttaagttttcatagtatcatgcacccatccttcaaaatacataccacagttttaagcttcatttttttaaagtcaatatgccttctcactagaatatgaggtctatgaaagtaataattatttctgcactaccattttattgcttaagcctagtactctggtacacaaaacaatcagtacttgctgaataaagaaattaataaacaaatgaatgaatgaacaaatgaatgaatgagtgaatgtggttgcctatctggtcacattcacaaagtaatggaaagcaggagctttcttaagtcacatgtatcatactgacatgttcagtgacattaaacaatcaggaagcataagccatacgtgtttatggccatttaaatagagaacatgcaaaaaaaagtgaaaacagtccaatgtgggattttaatatacatgactctaaaatgcacgagacctggggatctggaaatcatgagaattataacttaatttcttattgattatccttgttattcttgtttttaaactggatagctatgaaattcactaattctttcaagttgctagggatctatgagtgctcttaagtagaaataatgttcaaggtcatttagatgagaccataacaacggtccaggcacttagatgaaatgaatataaaaaagctatgtaccctgtaagcattcatcactcaggaaaggtgacatttttgcttagttgagttctgaggctgacgctcagggtcaaagaacataagtgatgcataaattagttttgttctatcagccatttttacgtttttttttcccttgaatataacacctgaacctgaaaataatctcaacccgaatgaactggaaatcttatttgccagacgtcaagaaaaagggcttgggaacaaataaaagtgtttatgctcttacccaggttctgccactaacctggtcatcacacataacctttcctggattctctaacaatacataaataaataaaacttgctaggctcaaacacaaagccaggatgaaattgagctcattcaataaaaatattctggaaattcataggtgcataagttgtttcaaggcactcttggctggaggttgggggagagataatatttttattatcttattatagtcttactttttagtagttcttattgtattttaaacatgaaggcagttaaatggtgttaaaattttaaaagtattatagtttggaccagagataaactgaatttgtttaatatttacttgtctgtttttttccctaaattttctcttaatgaagtgaacttatttattttaaaattagtttttatgaagaacatggcagacaatgtacatactggctacaggcagagctttgttgatatttcatctgaatagaaatcatctatccctagccattaatacatgatctgtattgggagaatcatccattctcaattaattattcaatagtcacttgacacacatgaaatagggaaaataagcaaaatggagccaatccttctaggaagactgactctgcctttatcactccatctcccaattctgtgatactcaaaagaatccaatcttttgttttccttctacgtttcgtggtgatcttttgcactccattttcagttcaaattttcaaagtgactcaatgcttcagaagaatcctaatggatttgctattctgagttgaattatcctatgtaccaggcactacactgttcaattatgcatcttggtaattccaaattctttatcttatagaaagagctatccatttgcaaaataaaatgcatttcagatacatctaattctgcttctctttaacaaattactttttccactcttaactgttcctgattatgcatgatctctgaatccctacattaaaaatgcatagaaaaataaaaattttcatttaaaacaccctcccacacagtacaagctgtcattgtgtcatatttgtttcctaatttaaggaaggaagctatatttcatgggtccttcattaaattgccttctctgtattttaaagtggcattaggatacttaagacaattttcccataaaataatgttcattttaaaatttgtttctattaatcagtgcaaaagtatgcaacttcaaattacagtatggaaattatcatatctacctagcatattattcatgattcacaagtagatttgctagaagaaaaaaactatcttttttattttgtaaaacataactgtaaagcctgctctcataaccatagaaatgtactgttaaagctgaagtgctgtataggccatggaatacacagttttctataattacctaagccaaaatataatgaaaaacaaaaacccacatgaagacagagcgcaacaaaatagccctttctttcttcccctcctcctaatcctgtgaaggctacagaagtctcctaaagaccagttttttttcttcctaactaactctccttgctgtttaaacaattacaaatcttatcaagtcttcatttctcttaaagtcaagtgagagagaactgccaactctaataagatttacaaaggctagttccccttagcactgtcagcaaaaatcaaagacattatacaataaaacgcagccacacagagcttttgtccctatagctttcgaaatcagatttaataattcaccttttttcacccatttcagccacaaatgccatttatccatgtgttgattgccttgctttgacccataagctatctactttaaatcctgacatctcctacttagccactgattcgtctttttcacaccactcactcactttctgttagaggctttgctgtatttatacaacagtattttccttggtcattgtcatgtaacagcaccggcaaaacacactgaagaccgaattttatttctaaagaggagaaaagagaacttaggtatgacttttgtagtttaatgccacactgttttaagccccaagaaccacagaaattacaacttggcctccactacccagataaatgtcattagccgaatatccttagaaaatctcttgcaatcccttacatgcatccctgtttattagtctgcagaagcttcccaatccagcaacatctaaatttctctactactttatttctctttataaggcatttgttaattaagaaatcttatttaatctctaacatttttaaacgtcagctgacctcacacttcaagaaaccgcataaatgacaaaattttacttaaatttcacaaatgttggacttggatataacagtggaaaccaacattattccaaaaagcctcctgctaatgaagaaacgcttcacatcctctctttccctttttccacaacgaaaagcaggtttttaccgctctatctgcaaaaggcagagcactgcccgtgaaccctgtctttctcgtcctttaccacgagtgaccagaaccacgtggggattctcaaccacggccgtggtatacctctcctgtgcttcatttctcatcaaacacatgcccaatcttctagatgcttgtttgcatcttaagggcaaagtctgtgtgttacagatttagaagtggtagagacaagtacagtggtcatataggtgggccgcggcccaatatagggcccaacctgccaaagaacccgaggaataagaagaggccattgtatttgccacttggaagggagtagtgttggtagaaaggtctccagaaggaactcaaacttggatatgggggctgccaatccttaggaggatgtcaagggagaagctgtggaggtggtaaggtagagagtcccccagaaacaaggtccttccctcgaagcgaactgccacacgtttgccaagattaggaagaccccatgcaccagcccggtcccctcctccccgagccccgcccaggccccggcccccgtgggtcgggcgtcgggccttaccttggctgcagtccttgccgcggaagccggttcgcgagcagtcgcacacggcctggtcgtccaccacggagcacacacctccgttgaggcacaccccgccctcgccctcctcgcccgcctcgcacgggcttcccccgccgctgttgggcggctcatcgtccagcttcacctcgccgctgtccacgggcaggacctgcgaggagttgaccctcacgtcacgaatccaccccttgaagggctcccgctccctcaccgaggccagggtgagcttgagcgccgcggcgcgcagttccgggggcagccccccgacgaaaaggccgctgaacaccgtcatgtccctgcgcttggacttgacctccacccacttggcctccacctggtcgatgaagagcgtggtgttgcggaactggcggcggatgcgcacgctgtgccaggcgccgtcgttaaccggcgtgtcggccaggagcgtcgcaggctcagcgcagaagatggagaagctgagctgcaggcggccgccgcgcgtcagaatcagctccaggaagtcgcagaagccctcgtcgtcgaagtagagcacgaggccgcgggcgctgcgagtcttgagctggaagctcatctcgctctcgcagcaggcgttccacttggggaagcgcgtccattggccctcggcgcccggaaactccagcccgctgcccagctccgcccagcagcccaggagcagcagcgagaggcacagaagaaaacagcccccgcgctggagcagcgccgtccccatgctcggggctggggtgcggcgggggggtgccggggccgacagggtcaaaatggtcctggacaccgtgacgaagaaataagggtcccgagagacagaaaggtaaggggaaaggcgggagtgagagggatgtgccctcctttatctagttctttttttcttcttcttcttccaataaccccgccctctctccctgtagtcctcttccaactggaaaacgttgaccccagtggtacagggtagccacagaacttccagaccaaagggaggatgcactttggagacaacgttctggaaaaggcttcaacaaaagatcaagggaaagcactgacccatttgagtctgattaactaatttaagagtatctgcagtgtcaacagatacttaactcctcaaatcccattatctgccaggttccaccagtggtaccaggccaaaaggaagcagtgagagtcagtaaaaagaaaacacttttctcaagaaagtacaggaagccagcagtgagccagtatccttggatgcttgtgaatgcctcaagtctgtctccttcagatgtggtgtcttacagcagaacggagaaagggatgcttgcctctttagggcaccatttcttaacccgaggatagcttcaaaggcctgcttcttctgtcatagcatgggcttcagcaccgctgcagccaaagcctaattccttgtgcgtggtctcacaagttggattttacttctcttttcagccacggcaacagtaggactcaaacccagcagttgcgaaatagccagaagctgttagatgtggaaatcgcaacagctcctcttcttttctctctgcctctgcagggccaagctaagatgccagcacatcaattggttgtgtgttggtgatgcattttggttttatcttgtcttttttaaggactcagacatctgcagagaattaaagtcaaaattaaggtctaaagtcaatatagtattatataaatcattattcagctcataacacaagtgtagacctggtcctattagtaaggcaaagagttaaccttcttgtatggagcttttgttatcctcactacaagtaagtcctaacattttctaatagttaatatgacacttttacagtcagccatgacacccttgtagtttattataactgttagttggtaacccgaagttttaaagagaaatttgattatggttatctttttcttttcgcaagatagtttaatttttaaaatatgtgaggggagaacaaatgcttttaaggatttctacctatgttgtgtgcttgttctgtggacagtaaaaatacaacctattcaaatctcagttaagagattttacaattggcaaattagattaaactgttggcaggaagctgccagcttagacttgtatagcattcctgccattttatttttcttagaaggaatattgatggtttcttgatagtctcttgcaaaatttcacacaagtatagttctcctttatattaatgaataatctgttgtaaaagaaaaccactaattggagccagatttatgtttttggcattgtctcaattgccctaatattaacttctctaaaggtgcataaagtatttaatattttgcctaaaagtgtagatctaactcctcctgaagtctgtatcttgctgtcagccctcacaatttgtgtggtcagaagagctgttggcatgtatgtcatctcagctgcagtggctccaggatgctagaatttaaaaccgtacctttgaatcactcactatactattaaatcacttctctttattcaactctaatctgacaggttcttgaaatggtacagaaatcataatcactgatttttttcctaagtcattttttaaccaaaaaattactcttaccttttgaaaaaaattacaaatgtataatctgttcatgtcaaggaagtgcattatttttctcactatttcttatattccccacctcttgcaaacacacacactgcaatatatatacaccatacacacatgcacacacacaccccaaatttattgtctggatgtagaagctcactacccaattaacactttttttcccttacaagctgaaactagcagtaatttatggcaccgcattgtgctgctgcttctccatggggggagctgagagcatttctcttcagtacagagcaatccccacaggtgtcagctgagagccaccaagctagggtatcccacttcaagttcctcccagatgaaattgatgactggttctctctctttcaacacacacacacacacacacacacacacacacacacagtgtgggtgtgcgcacatacacactgcccactagcaaaaggaaataaaaatctcagttgcttatttattatggctgatacattccacaccatcagcaatcaccagtcatatcttgtcttctcctatatcaaacccgaggaaagaggctcgtcaaatcatctgaaatagcatattattcagtatactttcatattttaagtggactcaggaatctgctaaattttcagtcatttgcaaaataaatctggaatatcatgatcaagagtagtgctttgaaccctttctcaagctcatgtgttagaaaacctttttttttttcttgtgtgtgtaactctgttggagccaattattgtattaattaatgttacattgatcacataaccttttttctcccgtccctcctgccctcctccactaatgcacaccttgacaattttaagggatggtggaagagagaaaaaccgtagagcaatatatatgtacatatagatatatatacattcttatcacagggaggttaactggttttcccagttcttggaggaagctcattgtatgtgagcgagtatctgtatttatatggagaaaagaggattctctctaggtgccagaaagacctggccagttcacaaattagaggatgaaataaagggatctgaaaaacatccttactgcagccaaaagaagaagcgctctaattcaaaagcagactaacagcatcattaatcttttctttcatttctagaatcaaattcatcccaagtcactaggaggatcaatacagtacgctcatcggctgcagttgcatattttaatgtttctgatatcacacacacatacacacctacacctttccatgcacccttcaatatatatatatatcttcataaagaacatgaaatctctgagagaaattttagaagtgcttattatttcacccctggcttttgcaaagtctctcaataccaatgcacagccaaaattctctctggctttcccgcccagtctctaagctccatctctaataccagtgcagtttcttggagctcggggtctactgcacaaattaacgatgggcacagtgtggggctgatgaggtagggaaggaaatatatggagagatattttattgctttgatatctagcctgtctcttattttctttcttttgctaatacatcactgcattcagcctttaagttactaccccagttccaccatctcttcttgccatctatttaaaaggcttcatgcaaaacaaccaagatctacactcctccaccctcccaccacccatctttccctgtgtatttgtggcagatcctggctcagttacaatggggaaagatatccttcttcagcttgcctcgccccatcccctccccccaacccaaattgagcttctttacctgcccggttattcccctcagctcgagccagagcctgaagcatgcatcggtcaaagcgaatttcctgaggtctatggataaggcgactgctgctgccttttcagaggcgtcaggcttgagcgtctatctccaggagtgcgggaggggagaacaggcaacggaggggagcaggaggaggaggaggaggagaaggaggaggagggggaggagagggaaagagctgggaaggaaaaggcggtggtggagcctgagaaggctgggttacgtgacgccgggtgctgtccttctgaaagagaagggcggagctgagctctccgcagtaccatggagagcggcgggcccgtcctttggctggggaatgggtgggctcggcccgtggtcgcagcccctccaggtctggatgctgcggagcgaggtgcttttacctttgcatcgtccccttgcagggggagcctgatcctgggggcggggaccttccgcaagcgcttctaacttgtcaccaccctctcttccccatcggaaagaaagaaagagagagagagagagagagagagag

SEQ ID NO: 371 - DNA, 1114032 bp, Homo sapiens; identical to SEQ ID NO: 370
